United States Patent 10,724,096 (METHODS AND COMPOSITIONS FOR INHIBITING AND TREATING NEUROLOGICAL CONDITIONS) - sequence listing, part 141

SEQ ID NO: 2557 - DNA, 477021 bp, Homo sapiens
cctagatcgaaagtcctttggtaatgatgtgtcatacattctagtcatcaaagacaccattttctgggcctgaagtgttctgctggtttttggaggaatgagaatccaatctctcataagccggattcagaaaataggtcatcgatgtgagttgcagttattttccttccagctttcttctgtgcttgctttagattgtttttctgcaaagggcagatgcagctgccctggctggtgggcagtggagggggatgacagccactctggctttgggcctctgtctgacatcacccagattcctgggtcctctcagttagcatttgccttttgtctgggtggttaaatttctcttgaaggagtaggataaacaccctcttgagtattgctttttacacagacacacaccacacacacacacacacacacacacacatacacacagcatagttcatagtcacttgatttgccacctgcagtttataatagaatggacctgtgggattataaaccactttatttctgcacagaatttctcagcttgaggccaaattgaagggcattagtcatcagtaatttgcagatgtttttaatgtttttcacccaagagaggtttcaggcagctaaagctaagataaatttcctcatgctttggtggggaaatgaaaaatctgatcatttagttaatcatttgtaagagctgtgggtatgtattgttccttagtgactgcaatatcatgacagatttgttaatttggtaacatgacaatgtaaacaatagtagataaattccattatgccatgattcttttcttcctctcagtaattttgtatattcaaggtttaaaatccatagaacattagagatggaacttagagatcaacctagagatcattggattcctctaccaagctctgtcaaatgccagtcctgagtgtctcccctggagcatcaggataaatagctaatgcatggggggcttaataggtgcagccaacccaccatagcacatgtttatctgtgtaacaaacctgcacgtcctgcacatgtaacctggaacttaaaataaaataaaatttaaagaaaggaaaagagtacataatcagtggaaccataaaggtcagttctagtgggaaaattaggaaaggcctcctagaagagaagacatttgagctatacttgaacaggccctatctagcagcatccagataggtggtttgtgaagaagccagttcctactcttacgtctttaccatggttatggtttgaatgtcccctccaaagatcatgttgaaatttaattgccattgtgagaagaaatgggacctttaagaggtgactaggtcatgagggctctgcccttatgaatggattaatgctgttattgtgggagacggctcctagtaaaaggataggttcagtctcctttttctctctcttgagctctcactctcttgccctgtctcactatgtgagaccttccaccatgttatgatgcagcaagaaggccctcaccagatgtggccccttgatcttggacttcccagcctccagaaccatgagccaaataaacttctattgtttataaatgatgcagtctgtggtattctgttacagcagcagaaaatggactaacacaactattatgcacttgcttatgtattggtttggaattattctctaatttactcacgcttgtatggtatgtgtttccttattctgtgtatctctgggtgttatatttaatatttgtacagatttcctctgacatttcacagttcaggtttccgatttcttctttctaaaatctattctctagatttgaaagcattctatgatttgtgattcatatataccatactataacatctagaaaaaatattctgaatagcatactgagcaatggaaatcttcatcatgaattttctaatgagtataaaatgttgctgggcaagtttctatttaaatcatgctcgctaggcttgactaactgcagacattcacagggtgcatgctgcagagtgctttactttcaacaaggtaaggctgtacctccgttagggactaattcagggtattcaacaagggatcagactagaccaatttggggttgttaaggaactaaaactagctcacgagaaactcaaatcagctcatgaaaagaggggctgcttggaagaatgcagtaggaaatttcatgggttacaaggacagacagcaaagcttagcaggcctcagagggccaagatgtagaattcacagtgaacccactcactaatcctctttgtctcactctctcaagcatggtcctttcagtttcttatttctctgttttctttttcttctcaggatgagcctctgtttcatatggtttctgctatcctctgacttcagcacacatttgggtcataatagtctcctctgtagagatctcttatatgtttttttaaaaaatatttattttaaaaagtagaataacatatgcactagcaaaaaacatgactaaaaatgtgtaataattttaaaaagcatataaatttctctcttttccaaactctctgatttttaccacctctccctaaagtttaagagtttcctgtgtagccttctggaaaaatgtatataaggatatacacatacatagagacatacacacaaatatacacataaaatgactagaaatgcaaatattctttgtatttacacaaaaattgtcctctctatacactattcaacacttttaaaacaaatcttaattgtatatttggcattctttccatattaattggcagaaaatttaccttttttctttttggtggttacctgtggctacattgtatttaattttatgtaactattatgatttattagataatctctccatgatgatgggcctctaggttgtatctggttttctactgaaaataatactatagtgaacaatcttgtatgtctatctacttcaagtttaatagagttttagctcttacatctgtttaatgattaaagttaatttttatatgtggtgtaaggataaagattctttttttctttttgcatattgctctacaattgttttagcactgttgaaaagttttcctttctagtatgtagaaatataattgaatttaaaatattgaccttgtttgtatcctgtaattctgataaactcactaattagttctagtaatgtttttataaattccatcagttttttaaatagataatcatgtaatcttcaaattaagcccattttacttcttcccttctaatctggatttttaaattttctttttcttgacttattattctggcttcaccacagtattcaatataaatgatgagagcagacatccttggcttctgatcttaaggtgaaagcattcggtttttcaccattaagtgtggtgttaacttcaggtttttcctagattcctgtatcagatgaagaagttcctttcactttctagtctgttgagagatttttgttgttgtttttaaattttgaataaatgttgaattttttgtgaatgctttttctgcatcgatcgagatgatggtttttcttttatgttctgttaatataaatctaagtgtgctttttttgattatatatgtaaagtaaatgcctaccagtagaattacagagacaaagggaatgggcatttggtagattttgactaataattcctcacaaagattgtttacgctttcgctcatgttgtctcagagtgcttatttctcttaacactattatcaaacttctaaaaatcttgacagtgtgataggagacaaatggtatctcattagtttgatttgccgtttaaaatttactagtgagatttagcatcttttatacatttaaattttttgagtctttttcttttttattgtatatactcttgatagaaaattagctcctgatacaaaccttcttttctatttattttttggaaaaatgttagtacttacaacaattcttttggttgtagagacctttttacttgtatgcaattatgtttatcaatttttttcttagggcttgtgagttttctattctacttgaaaatatttcttgcctacaccaagactataatgtatttagctatatttttttaaaaaattttgagccaccatactctattttggagaaaggaatgaggtagcaatctggcttaactttttttctgaacagccagcaagttaagccagcataatttattgaacagtattatttagtccatcttttgcctattgatttgtaatgtgatttttatcataaaccctatttctttgtgtatttgagtctacttttggtttctagtctaacgatctgactacttatttctacccctgtggcataatgttttaattactctagcagtataacatgttttagtgtctggtcaaattatgttcactaattattcttttttaaaattttcatgttatgtgtttttctttttctgtttctttttttttttttttgagactgagtttcactccattgcccaaggtggagtgcagtggcgtgatctcagctgtctgcaacctacgcctcccaggtttatgttattctcctgcctcagcctcctgagtagctgggattacaggcacctgcaccacacccggctaagttttctgtttttagtagagacgaggtttcaccatgttggcctggctggtcaaactcctgacctcaagtgatctgtctgccttggcctcccaaagtgctgggattacaggtgtgagccactgtgaccagccctcatgtgtttaattttctaatgaagtttaatatcattttgtcaaattcttaaaaaaaaacaaagcggctgggcgctgtggctcatgcctgtaatctaggactttgggaggccaaggcgggtggattgcctgagctcaggagttcaagaccagcctgggcaacactgtgaaaccccgtctctactaaaatacaaaaaaattagctgggcgtggtggcatgcacctgtaatcccagttacttgggaggctcaggcaagaaaattgcttgaacctgggaggcagaggttgcagtgagctgagatcacaccattgcactccagcctgggccacagagcaagactctgtctcaaaaaaaaacaattatttactttcagactaaatttaggaagaattgacatcttcacagtaaggttttctatccaagcataaggtatatggttttgcatttttttggtctcttttcatttaatccattgattttaagattttacttttatacattctgctctgttctcgttaggtttagctttgggcattttactctctttaattcctattaaaatgctattttctttctggctgattacttttaacatatagaaaaatatattttgaaattgcttgatttctagatgctaattttatactcagctcctcaatgaatcaacttaatttttttcattgttaaactttgattttccaggaataaatcattccactatttattttatattcaccatcttcccagtgtttatttctatgtttttttgtctaatcacagtggctaatacttcaaaaacaatgcaaaattttatagtgtttgtgagagatacttgtcttttttcttgatttttattagcaatggttgtagaaatccattattaactaagatgttgacttttggtttgagagatatgtttctgtgctgtttaaatgctagaaaggaattaacccatttgaattttttaatgttctaaaaattagatattaaaacttaccagattcattttggatttccatttttaatggtgtttcatactttgatatattaatgggaaaatcatagtaatatattccctaatgttgcattatctttgctaaattctaatagctgattttttttctgtggttttatgtttgtttatttttaatttttagtttttgtgggtacataatagatgtatatatttctggggtacatgagattttgatacaggcatataatgcataagaatcacatcaggttaaatggggtatccatcacctcaagtatttatcatttctttgtattacaatctaattatacttttagttatttttaaatttacaataaattagtgttgattgtagtcatccctttgtgctatcaaatactagatcatattcattctatttttttgtacccattaaccatccctactccccatcaccactacccttcccagcctctggtaactatccttctactctgtctccatgagttcaattgttttaatatttagctttcacaagtaagtgagaacatgcaaagtttgtctttttgtgcctggcttatttcacctaacataattacctccagtttcatccatgttgttgcaaatgacaggatctcattctttttatggctgaataatattccattgtatatataaacctgattttatttttccatttatctgctgatgaacacttaggttgcttgcaaatcttggctattgtgaatagtgctacaataaacatgggagtgcagatagttcttcaatatactgataacatttcctttggggtgtacctagcagtgggattgctgaatcatatggtagttttatttttagttttttgaagaacctccatactgttctccatagtgattgtgttaatttatattcccaccaacagtgtacaagagtctacttttctccacattctcaccagccatttgttattgcttagtttttttggttaaaagccattttaactggggtgagatgatatctgattgtaattttgatttacatttctctgattattgattttgagcaccttttcataaacctatttgccatttttgagaaatatctgtttaggtcatttgttcattttaaaatcagattattagatttttcttatagagttgtttgatctccttatatattctcattattaataacttgtcagatggatagtttgcaaatattttctctcattctgtgggttgtctcctcactttgtttattgtttcctttgctgttcagaagttttaaacttgatgtaatcccatttgtccatgtttgctgtggctgcctgtgcctgtagggtatcactcaagaaatcattgcccagaccaacgtcctggagagtttctccattgttttctttgagtagtttcatagtttgaggtcttagacttaagtctttaatccatttagattttatttcattcatttgcatatggataaccaattttcccagcaccatttattgaggagcctgtcctttcctcaatgtatgtttgtggcagctttgtcaaataagagttcactgtgaatgcattgatttgtttctgtgttctctattctgtcctattggtctatataactgtttttatgccagtgccatgctgttttggttactatagctctgtagtataatttgaagttaggtaaagtgattcttctagttttgtttgctttgctcaggatagctttggctattctgggtcttttgtggctccatatacattttatgatgttttttctatttatgtgaggaatgacattggtattttgatagggaatgcattgaatctgtagattgctttgggtagtatggacgttttaacaatattgcttctttcaaactatgaacatagaatatctttcccttttcatgtgtgtcctgttcaatttctttcatcagtgttttatagttttcgttgtagagatctttcatttttttgggttaattcctaggtattttatttgtagctattgcaaatgggattactttcttgatttctttttccagttgtttgctattggaatatagaaatgctaccgatttttgtatgttgattttgtatcctgaaactttactgaatttatcagttctagtagttttttaatagtgttttggtttttccaaatataagatcataccatctacaaacaaggctaatttgacttcttcctttccaatttggatgccttttatttctctctcttgtctgattgctttagcaaggacttccaggactatgctgagtaacagtggtgaaagtgggcatccttgtcatattccagatattagtggaaaggctttcaatgtttccccattcagtatgtgggtctgtcatatgcaacttttattgtattggggtatgttccttctatacccagttttttttagggtttttatcatgaagtgatgttgagttttatcaaatgctttttcagcatgaactgaaatgatcatatgatttttgtccttcattctgttgatatgatgtatcacattgattgatttgcatatgttgaaccatacttgcattcctgggataaatcccacttggtcaggatgaataatctttttaatgtattgttgaatttggtttgctaatattttgttgaagagttttacttctacattcatcaggaatattagcctgtagtttcctttttttgatgtgcctttgtcaggttttggtatcaggctaataccggccccataaaatgagtttgaaagtattccctcctcctctatttttcagaatagcttgagtaggattggcattagttcttctttaaatgtttagtaaaattcagcagtgaagccatcaggttccaggattttctttgttgggagacatttttatggctttgatctctttatttgttactggtctatttagtttttggatttcttcatggttcaatcttggtaggttgtatatgtctaggaacttacccatttattctagatttttccaatttattgatatatagttactcatagtagccactaatgatcatttggatttctgtggtatcagttgtaatgtctccttttcatctctgattatatttatttgagttgtctttttttttttttaagtctggctaaaggtttgtcaattttatttatcttttcaaaaaacaaaaaggtttgtcaattttatttatcttttcaaaaaacaaactgtttgtttccttgactttggtgttgttttcttcatttcaattttacttctttctgctctgatctttattatttcttttcttatagtaattttggttttggtttgctcttgcttttctagttcttttttttgttttgtttttttcagatggagtcttgctctgtttcccagcctgtagtgcagtgacacagtcttggctcactgtaacctctgcctcctgggttcaagtgattctcctgcctcagcctcctgagtagctgggattacaggtgtgtgccagcatacctggctaatttctgtattttagtagagatgaggtttcaccatgttggccaggctggtctcaaactcttgacctcaagtgacctgcctgcttcatcccaaagtgctgggattacaggtgtgagccactgtgcccagccacttttctagttctttaacatgcatcattaagttgtttatttgaagtttttctacttttttgtatgtaggcacttatagctataaccattcctcttagcactgctttcactgtatcgtgtaggttttggtatgtagtgtttctattatcatttgatacaatacacttttatgtttccttcttaatttcttcattgacccactggtgattcaggaacatattgtttaatttccatgtgtttgtacagtttccaaaattcctattgttactgatttctagttttaatccgtcatggttggagaagatacttgatataatttcaattcttttgaattttttaagactaatttggtggcataacatatgatctatccttgggagtgatatatgtgctggggaaaatgtgtattctgcagccattgtatgaaatgttctgtaactatctaataggtccatttggtctgtaatgcagataaagtccaatgtttctttgttgattttctgtctggatgatctgttcgatgcttaaagtgaggtgttgaagtctctagctattaatttattggagcctctctttagctctaaaatttacatatcagagtgcttcagtgttaggtgcatatatttacatttgttatattgtcttcctgaattaacccctttgtcattatataatgaccttctttgtctctttgtatagtttttgtcttgaaatctattttgtctaatgtaagtatagctacctctgctcttttttggcttccatttgcatagaatattttttttccatccaaatagaatcccaaagtagttatattcagtccgtgtgtgccttgataagtgaagtaggtttcttgtaggcagcagatcattaggtcattaaaaaatctatttagccattctgtcttttgattggagagtttagttcatttatattcaatattattgataaggacttaattctgccattttgtcatttgttatattttctgattgtgtttgtggttatctcttctttctttcctttttttctttttagtgaaggtgattttctctaggtatgttttgattacttgctttttatttgttgtgtatctgttatgttttttgatttgcagttaccatgaggcttgcaaataatagcttataatccattattttattaataaactaatgataactgatttcataagcaaacaggcaaagagaaattaatgagaactctacactttaacttcatctccctgcttttttggctgttcatatcttattgtactgtctatgtcttgaaaagttgctgtagttattacttttgatcagttcatcttttagtctttctagatatgtatagtttacacaccacaattagtgttataatattctgtgtttttctgtgtgcttactattgccagtgagttttgtaccttcaaataatttattcttgctttttgacatcctttttttcagattgaagaactccctttagcatttattggaggtcaggtctggtgctgatcaaatccctcagcttttgtttgtctgggaaagtctttatttttccttcctgtttgaaggatattttggatggatatactactctaggataaaagtttttttccttcagcaatttaaatatgccgtgtcactgaggagtctgctgccagatgatgactggagctctttgtatgtaatttgtcatttctcctgctgcttgtaggatcttttctttatttttcaccttttgcagtttgattactaaatgtcttaaggtggttttctttgggttaaatcagcttggtgttctataatcttcttgtacttgaatattgatatctttctctaggtttaggaggttctctgttatcatccctttgaataaacattctacccctttctctctttctaccttctctttaaggccattaactcttagatttgcccttttgaggctactttctagatcttataagtgtgagttcttttttttatttttcatttttcttttgtctactctgactttatattttcaaatagcctgtcttcaagctcactcattctttcttctgcttgatcaattctgctgttgagactctgatgcattctttagcatgtcagttgaatttttccatgccagaatgtctgcttgattgttttaaattatttcaatctctattaaatttatctgataggattctgaattccttctctgtgttatcttcaattttgttgagtttcctcaaagcagctattttgaattctctgcctgaaaggtcagatatttctgtctccccaggattggtccctggtaccttatttagtttgtttggttaggtcatgttttcctggatggtcttgacatttgtggatgtttctttgtggctaggcattaaagagttaggtatttactgtgttcttcacagtctgggcttgtttgtacttgtctttttaggaaggctttccaggtattcaaagggacatgagtgttgtgatctaagtttttggtcacagcagcaatatctgcatcaggggacaccccaagcccagtaacactgtggttcttgcagactcatataggtaccaccatggtggtcttagataagatctggaggaattctctggattgccaggtagagattcctgttctctttccttactttctcccaaacaaacagagtctctgtctctctctttcctgagctgcctagaactgggagaggggtgacagaagtacccctatggccaccaccattgagactatgtggagtcagacctgaagccagcacagtactggctcttgtccaaggcctgcagtaaccactgcctggctactgcctacatttactcaaggccctagggctctgcagtcagcaggtgatgaagccagctaggtttgtgtccttcccctgtagggcagcaagatccccctggtcctacatgggctcagtgatgatgtctggaagccagggcctgagtcagaaaccttagggatgtacctggtgctctattatactgaggctgagctggcacccaagccacaagacaaagtccttcccactcttccctcccctttgcatagcagaggagtctccctgtggccaccacccaggccatagtaagaactgcctgactacagccaatgttcattcaaggcccaaatgctcttcagtcagcttatgatgaatgctgccaggcctgggactctcccttcagggtagtaggcttccccaacccctggcccaggacaggtccagaaatgccatccaagagccaaggcctagaactgaggaccctaagagcccacttggtgctctaccctactgtggctgagctgctgcctaagctgcaagacaaagtgtcctttactcttttctctccttttctcaagcaggagtccctccccattgctaccacagttaggtaggtcacacctgaggccagcatgtctttgaatcttacccaaggcccgctgcaaatactgcctgggtaccaccgctgaatattcagggcccaagtgctcttattagcaagtgatgaatcctgtcaggactgggtccttccctttaaggcagcaggtttccttctggcccagggtgtgtctagaaatgtcgtagaggagatagggcctcaggactcttcctggtaccctgtcctaccgtggctgagctggtatccaagttgcaagacaaagtcctctttactcttccctctcctctcctcaagcagaaggaaagagtctcttctggagctgtgcgctgcactgcctggggttggaagaggggtggcacaaatactcccttggctctggctgatgtgttactaggttgcatacccatcaagtccactggctttgagcccagcacagcgtcaggacttgcccaggaattgcagtctttgtggcctagactacctttcagatttctttagaaccccagagcaatttagttcacggtggtgaggcttgccagaactcaagttcctatcactgggaggtgcaatttccccccggctaggttgttctaaatgcttcctccgtggatgctggctgagttctgcctggtgttactttctactgtgacagggcagtactgagttccaatgcaaagttccccaatcactgtgctctccctcccgcaagtgcacagattatctccgtgccacatgactgtggctgggagattgggggaagggtggcatcagcaattcaagattgtctgtcctaccctcttcagtgtctctttcagtaatatgaagttaaaaccagatattgttatcactcatctgattttaggttcttatgaaggtgcttttttgtgtggatagtttttcagtttggtgttcctatagggaggactatcagtggaagcttctgtttggtcatattgctctgcctgtaactcgagattctcctattggctgatttttaatttagtatttttatacaggtattccgaagtgaggttgattgcagttttatttttctgtgctacttttatcatgtttttgtaggaatattttgttattttactctaagtgatttgaagtttttttcttcatgacctggaaaccataaatagcattggaattatctttttctttcttcatgacctggaaaacataaatagcattggaattatctattctttgaaggtctggaagaatttattgttaaaaccatctgagcctgtggctttttgagggctagctctttttttttattattctgaatttcttccattatatgtctacttaagttttctatttcttttgggttcaattttttttatttgtatttatctaagaaagcattcattttataattatttataattacaaaaaatatttacttatttagcgattttcaaagtagtcatataatttttgaatttcttatgcatctttttcttttctatttttatttgtgttttcctctttttcttgattaatctattttatctattttattgttttgtccccagagaacaacatctttaatttaattatatattctactgtttttctgttttctaactcatcaatttctgcttttattttttcttctactttccttatgcttattttatttatctatttctacctttttgaatagaatattaaaaaaaatttctttttaattataatttgcttggtaaaacgtttaattctataacattttgtttttcagcccagcttcttaagttttttgcttgatagtatcctcaatatttttatttttatatactctgtaatttcagttttaactttttgttttatatcaagacctaaaagagttttaatattctcaggtggctaggtttcttctttctattattaatatttagttttattgtagtgtggtcagggaagatttttcaaatttcattttcttggaatgtattgaggctttactttgtggcttaatgtattccttatttttaaaattaaaatatctcattagtgcttgaaaataagttttatgttaaatatgcacttattgatgtgcatctaataggttaatctttttattgtatcatatatttcttattgtcaccttgttctgtcatagctgacaatgtcttttactattattgtgttttgtctatttcttctataagtttatgcttttatgaattttgacatattgtttttgatactgaaggatttatgacttttataagcttattattgatttaaagtctgcccattctaacagtatatagaatagtatctggtgcctagtaattgctcaattactattgttgaatgtaaaataaccctttatgttctttgatagtttttaactttactcttttctgatattaatattatgattctttttggttttgttatcatttacctggtttatctttgacttcttttttttacttttaaagtttctgagttatagactcttgaacagtttgttttagatgtggatatctatagatctgttttttctatgttttgaccttattaaagaatcttaattgatacaacagatatttacctctgtttttaatgtccccctcaccaccacctccactcgtcctctcttactccacagattgtctttttgttgtttgatgtttgtatgtgtgttcatatgagtaagtgtgctttttttgttgttatgtcaaagacttatagtctatttttaggtcttttagagatttgataactttatagtgtttttagcatccatttagcaatttatcaattatctattgcctacttactgaaattagtgagaaaattaacatacatattttctccttattaatattgtctttttgcttggttaccttaattttaaagaggatatttaaatctcagtttcttaatttagcatcaaaaaataaagaaaaatgaggaattttcacccttatttttctgtttaatttgattatttacttttatttttgaaatgtataacatttcccttttgtaaacatacttcacactgttgattagctttatttctaagtataaatgggttcagttcttcttatcagactttttactagggcttcacatttatctcttggttagctggattttggaatcatgtgactttttcaggaaggactcaagctgttgcatgtctgaaagtgtctgttgttgtctttatacttcaacaacagtttggttaaatataaaaatatttgctcatactttttttcccttcgaaactttgtacattctggacatggtggctcatgcctgtcatcgcatcactttgagaggccagggtgggaggatcacttgagcccaggagttcaagaccagcctgggctgttaggaagatcctgtctttacaaaaaataaaaatatttagccaggtgtggtagtgtgcacctgtggtcccatctactccagaggctgaggtgggaggattgcttgagcctgggaggttgaggctgcagtgagccatgattgtgccactgcactccagcctagacaacagaggaagaccctgtctcaagaaaaaaaaaaaaagagctttgttaatatacatggtttacatatttttctggttttgaatgttaactggagagaaacctgagcttttgttttatttgcttttatttggttttggttttgtgtgtgtgtgtgcatcctattgtattagtcagggttctctagagggacagaactaataggatatacgtatatatgaaagggagcttattaaggagaattgactcacatgatgacaaggtaaagccatctgcaagttgaggagcaaggaagtcagtggtagatcagtccaagtcccaaaacctcaaaagtagggaagctgacagtgcagccttctgtctgtggccaaaggcctgagagtccctggcaaaccactggtctaagtccaagagtccaaaagctgaagaacttggagtctgatgtttgagggtaggaagcatccagcacaacagaaagatgaagtccagaagactcagcaagtctagcccttccgcgttcttctgcttgctttatcctagccgctctggcaactgattagatggtcccacctagattgagtgtgggtctgcctctcccagtccactaactcaaatgttaatctccttttgcaacaccctcacagacacctccagtgatatgggcaggagacagggaaacactaggtagaagagggcagtcacctggcaaagaccccacccacaggcatggaaacccatggctccagtgggaagaggcattctgttttcatgcccaaaagttggcttttggcatgccacaccgtcctatcctgtacccatataaacctcaaaccccaggctccacagaagatgagaagaacagaagaacggcagaacggcacagcagagagaagagaaggagcatctgaatgccaagaggaattcagcttggggtggttggagaagagatctgccactggacagccaagcttcaggggaagatcatcttcccaccccatccccatccatcccactgagagccacctccaccactcagtaaaatccccgcattcaccatcctcaagtctgtgtgacctgattcttcctggacactggacaaggacctaggtaccgagggcactgagcttgttaacacttaagccgtctgtggacagcaaatctaaaagaatgcactgtaacacatgcccacttgggctttgggagttttaggtacccacctctagatgctagcatgagtctggagcccccaaggcgctcaccccagatcctgcacctgcctgtctatgtgctccccctcccataaggagtttgagcagacacacagccaaacagtcaagccacacccctgcagcatgtcctatgagaggggtcagggaactctgccatttcaccaggaacaataatttggatcttttaatccaagcaagttgacactcaatattaaccatcacacatatacctaaaaatttgtttctctaccttgatgttcagtaattttaacagaaatatttgtttttctgagagttgttcatttttccctcagatttgtgggtttctgagtgttaggggcagccacaattgatggatatgagctttactcttctttctgaaatgtcatttaatgtgcatattagggtcattccacctgataggaggcaactcctacagcatagctttggaaatgttcctcattttagaatagagcctgattatttctcctacttccttttaagagcctagtattggccagatgtggtggctcatgtctgtaatcctagcactttgggaagctgagtcaggaggatcactgtagcccaggagtttgagactagcgtgggcaacacggcaagaccctgtctttactctccaccccaccaaaaaaattagctgggtgtggtagcacatgcttgtggtcccatctattaatacttgggaggctgagatatgattgcttgagcccaggaggttgaggctacagggggtggtgatcacaccactgcactacagcctgggtgacagagtgagagcctgtctcaaaaaagcctagtgttgagtaatacatgtaaaaagttcttaataaatccttactgaatgtataagtgaatgaacctagactcattttctgctgctgtctttccttctctgtccatttttctctaagtaaagatgaaactgcctttgcaaaaattatatcagtgagaaaattatggcagtggggaagatttgatctagctaacccctctagtgctgttagccttcaagctgccttcagttattcctgggttaactttaggagacatttagtttatagtttaaatgataatagcccttccccaaaactcagctgcctttgcaaagctaatgagagagcaccaggctaggagaaggagaggagcctgaattctgctaaggtgtagatatacctgattggtagccattgtttcagaggtcacaagacatgcaacttccccaattactcctgcagataacatcactatttttgaacctaggatcggtcttttgagatatcttttcaggtttttttttttttttaaacatgtctgacacctggctccacctggatggccaacttctcctgtggccccacccagcagcaactcagagcaagaggacagcttcaactccctgtgattttatctctgacccaaccaatcagcagcaagtgcccagtgcctcgccactcccacccgtttcttcaaactgcctttgaaaaacccctaaccttcaagctttcaaggagattgatttgagtaataactccatctcccacatggtgtggccagcctcatttcaaactttctttactgcaatgccatgaattgattttgtttgtgcagtaggcaggaagaacccatcaggcagttacagggaatgttgctgagatttttcaatattttgttccttcaccatttggcaaatcccatcacactctgggagaagagagtgaactgcttgagcagtgattcttgggatcttctctcattttcactgaatgctactcttcaaagattatggcgtgaagttatatcccttcttttgtttgattattgctggtatattttgatttgtttgctggatttcaagtttccattttagtgttgttcattcattcagttttagggaaaggagatacttgacttcactttgccatctcaccccagaagtcataaaaatttttgaaacaaattcggaacctccagagcagagctcagtttcttcttcctcctcatatttcttgtagaatctagtgtagcttgaatgggattggaatttattaactatttactgaatgcataaataacattttatggtaattttggctaatttatgacctgttattgaaagaagggtagatggtgtacaatcaccttgaaaaaagtatcatttctgattaatcttaagaggggatgggcaaagcagcaaggaatgtgcagtaagacatgggcgaatcagccacacgtcagactgagcatgtttagtgctcactgcaaccctgaagaattgagtccatctattgcttttgacctaatgtgggaaataagctcctagggcctctgaaaagatatgggtgaatgatcagaaatttatcaggagcacctttctcctttgggttttttttttttttttttcccttcttcactaaacacatcagttttaagggcaccatgtgaaatttcatttttgattcctttcattgctaacgtcaaggcccactttacactattcttcattttccctccaggcctttcactggctgcttaagggcagtccacccagctagttaatgcgtatttctctcttcttttatgtgactctgtttacacttgggcagacatagcttcctgccaatgggcagtttcttttcagggacaagatgagaaagatcacagagctttgtagtgatgagtggttttgttcatctcagtttctgcatgttgatattctttctgttttcctccttcaggaggaaggaacaagaattggactagaagaagaaagtcatttgtattcttctgactattgattttccttctaccattcagcagttcagtagttttgcgtaactacagctgtttgggctgggacatcagccatattgtgggactgactatatttcagtaagcaagaagtagattgggaaggtgaatttctgacaatatgagtgtgggtgctttaaatttacttcttttcactcaagttatctaacatagagcgaggataaaaaagaagaaatatgagtcaaatgcctggtagtacactgatgttggggattagctcccagtgtctatcagggagccctcatgaaggttaccataacctagggacaaagatgttagacttaacagttttcagccactttccctggcagcagccaccattcagcagcctatcaagacaactgtccaatcatgaccagaacatcctctttggctgttttactctctcctgtggtgtgtacataatttccatttttagaatcatgtttttaggatgtttcagagccatgttactcctccactctatcttttattaccatttcttaaggagggtccaagttctttttcaaaaaatttatttacaatagaggaagaaaataaaaagtaacatgaggttgctggttaagaaataaaaatctttttgtttcaaaagtccactgcccccagttctgtgatctgttgcacataacaaatttttcccccaaccaggaaacatctgtatggattatttcactataatcctatgatgcttggacttgaatcacttccagatcccacagacacctgggaaattatagagaccattggtaaaggcacctatggcaaagtctacaaggtaactaacaagagagatgggagcctggctgcagtgaaaattctggatccagtcagtgtaagtaacagttgtaaattataaccagaatttggtgttttatgcacactgagttttcaacttcttttcttgattttaggtttaattttcatgaaacctggtatgaaatctcaaaatgggtcatgatttgtcagcttctctgaatgaagggactccacttggagttaaagcttcccttgacttttgtttcttgtccattttactgttgtgttggtttgggaccactgggatcttcaaaagttattctcttggaaagagtaatatattttactacctggtctttctgtaagttacaaagtgacccagacttgtgatattcaatcatcttacgctgacatcttattttagagcaccggggttataatgctgtatgctgttttgcacagtgaggttttacatgtcctatcctgtgataggtcccttcaagcaagttctccataactgctttgaaaattcagacacttttcaataaaaaagatatttatgatagtattattaaagaaaaaatatcataaacattattgatataattatgtaataatagaaggtgtaggttgtaatattagaatgtaataatgtaatactagaaggtgtagattgatatctgaatgtccattgttagatattttgaaggtatggtaatgagattgaaaatacatagtacatatgttttactaagtacttgagcatgatgtcatatctgtacccttccttacacattagatttaatccagcttgcatttttctaccctgtttaggatatggatgaagaaattgaggcagaatacaacattttgcagttccttcctaatcatcccaatgttgtaaagttttatgggatgttttacaaagcggatcactgtgtagggggacagctgtggctggtcctggaggtaagaggctcccattgggtaaccagtgatttgaacagagtgccagaggccaacagatgctttattacctagagggtgttttaaggtacacatttgaggagtaggtccctcctgcatgtcacaggtacctcaccagatgtgacattctcctccacagttcttacaggtaggccttatgctaaaaatatttttgtttctctgcttcagaggtttaataatcttttattctagtacagggtgaatataggaatataattgaaaacattaattttcttccctaacatttaattgtaaacatgtttgaattgattgcaactcattttcaaaaattgttaacccaaggtttacttggcttgccaagtttggatttgcccactcatgttcattagtcctcattttagattgggtttcctgaaaactgactctgagaattgtgtatggaaagtttgttgcagagttcttagcggaggtagacctagaaaaaagtgaggaaggcaggatcaggcaagggagacactgaacagcaatatggtcataacagagacctaagctggtcctctgggaaatggagagctgggcagtttttggaatgttgtcctgaattgtatctccacatcagccaatcattgcctgcatgccatccctgcgaaggagcgtgactttgggggagtcagttctctgaagtggaagccaacttgggtgaggggtgcagctgagggctgggagctgttcctgtttctagcagcatccactgtgaagagggaatctgaagggaacaacactgtatccactatagtcctgcatttttttctccaacaatccttccatacacaattctcagagtcagttttcagttattaatgggaatgaatgtgtgcatctgggtgcaaaagagtcaattccgaacaaatacgattccctatgaggctaaaatgacaaggaaaataatgacagtatatgaattaatatattaggacaggtctatcgccacattctcactaggcctacactgttttattctgggctctgaccttctgaaccagctcatgtctccatgtctgaggtcacgtaggtgacccagcacagtgtggacacaagtggaagccttaagagagaagcaccaggggagaaaccagccctcacttcactgtctggtacctcttgtccacatgtttctggctctgggagggcctgagcctgggacaataagtactggctgccatggcaaccatgtttggggaattcatttgttatattcaaatgggataatctgcagggaaactggtttgaatttatttctgtcacatcagttgccttcctcagaatatataagatgtaagggattttggttttctaattatctttgttcctttagttgactggttaagtcatataacacacttctttggggttttattaactcccccacccccaccccaagaatattaggattttatcttgccaatgaagctgtttaacaatgctatttggaaatgataaagtactgttcctggggtctctgattatatttgtcttcagctctgtaagatctctgtgttttaaacctcgttgtaacttagtaatggaagtacagtgaccaagaaacctcagtttctgcttatttttaactcctgactaaaaaaggctcatatcagacatagagaactgaaactttcaggaattttcgagggcctaaaaaggagccttccctccatgcaaccaggcaggcaggtgggctgctcatacctgaggccacctggtgaatgaacatccttcctgatgaggagtgaccctcagacatggcaactcaggtatggccaaagcagccaggaagtagcacatggacttgaaagatgagaaagagcccagaactatgagctgagccttgcgcaggtgctcccttgccacctgtttctagctttttcagggtgaccacagtaatgaagctgccctgagacactgaattattcatacctctgcaatacaatatgctgtcatttatgacttttgctggttgttttggtccatgccaaagtgggtgatatgagatactgggtgtcctcagtcttttctgtcccaggatgggcagtctaaaccaggctgctacatggtcatgtgcattcagtgcctccaatagtcttagggaaacacaggaattcctagactcctaatactggcagaagcctctctcttcagtcccctagccttcagatgagggacagaggcccacagaagtgagtaacatgcctatggtcacataattggttgtatggcagaactggaaggaaaagcatatttcagcacattttctttcaccatgtgcagctgctcctctgatgttatccattgggtcatggaaacacagatgtgaagtctctcactgggatcgtagcacttcctgaccacacacacagagctggatgacaatgatggtccacatagtaccctattttgttctctctgcagctttttaaggcatgctttaggggactcacacaaaaaaattatctgtttaatactgttctcctcatcttgcatattaagaataaatttatgttgcctttgctctttatttgcctgactgatgaaaggacgagtgagaagctattccacagagcaattctagaggatagaaaaatgttattaataatccccttaaatcacgacaactctgaaaacaaagcaaataaaaatgtcattttctgaaattcattactaattgttagtagaaagcaaacaaaagctctctttcatgatacacacctactatattggaaagatatggagagaaaatacacacacataatagtgttttggaaaatctgtgaatgcattttaagtgaatattaaatttttaaaaatctataagtccgcctttcacctagatgatatacatattaataaattagacctttaagaaaaacatgatgctcagaaaaaatacctaacatgtggtagctaaagcatgaactatattttctttttccttttagtgtaaaatctttggcaggtagaaacttaatttctgcatgaatcaagtgttctacttaaaagaaatggtttggagtactggtaaatgaggctggaaagtaaaacaaacaactttgtcctttaaaccatgtatgagaattagttttacatcttttttttcccttcagagatctcggtataagttcagtatctaatatgtagagccaaagcaaaagggggcggcgggggggggagggagggagggagaaagagagacagcagacagagagaccgacagaccgatggacctttgtccagattttgcttttatccaaggccctagaaagtataatctagacctgaatatcactggaagtgttacacatcaaaccattttgttgatactgtggcatgaattaagtttatcaggttaacaaatcagggtcttagtcatactctgacggactcaaatgtgggactggtggattttgattgaccagaagtggttagaaagtactgcagcattgaacactgactcagtgggttctagagtgagagacactggaatgctgggagcctggatgaaggcacagaaaacttgagactggagaagggaagaactttgaaatggaacagcattacatcccacaaacatatactatatgtgttcaacaaaagagagagagttaagaggctgaggactgggagtgattcttcccactcttggctctattcaataaggatgtgccccaggaagagaatgagatgggaggtcactctcagggcccacttccctctcattgtatgagcatctctccactctgatagaaactctagggtttcaagtgacatagttttcactggtcttgtggcaagccagtgacttttgctggctttcattaaaataaacatgattcgtccaacaccagaggaaaaaatgtgctgttctggaattactgagaggcggacagtgtccaacatgatacttcctaagggattttctgaagtaattttgactgtctttgacttttcctttatgttatctgtagaacccaacacccttaaaagacaaagtctactgaacaaaggggcaccaaaaagaaattcctcttaattctgcaaactgactatgtcaaagcagcaagctagtatagaagctacttgaacgttggagcctaggtctggtgattgtgttgcatgggccattctttaataatgtggaagaaagttgatggcttattgagcaaggaacattttattgcttgaaatgatgactgtcttagcaaatgcacatactgtgattgaatcaatattcaatgacgttttggaaaatagatgtggaatgtaaatgatttttctatttttcttggtttggagcaaaatgctcattaaattctagatgcattcagctaccacatttcctgaatgctgagggcgtagggaggaactgcaggaatgaaaacacacttctgtatttgaatctggtggctggcagagtgggcgggaataaagggctgatatgtcaaccctcagggctggggtgggaggcttggttgccttcttacaattctaaagggattattttacttggtgcatttaaatataattctttgttatgcttttaaaatgttcaacccatttcactgaacatttattctgattagacaattgtcagtgtacacctgatttcttttttttatatccaagtgcccagtcttttttctataacccataggctgcccttgaaaaccttgctggtgggcttatcaacttcacaggacagcttcctttaaaagtgtcctgagcagtttaattatatgtttctgtgagttctgggaagtcagacagctcttatactctgacatttagtgaacaaaaagcactggctgggtaagattcctttgttgtttttaaatccatagctgagttttgatcctgctgacaaatagctactcttaatcccttcataagttctagagttacaaataaagtttataagttggctacctatataaaatattgctgaagaggcctttgttgcaaaaatggccacacttaaagtagggcagggagagagaccaaaatgaggtgtcaggggaaaattccagggttgcattttctgggatcatcacccagcatttaatttaaaatttctctcagtagaattttaatagcatgcttgcaatgcaagaaagcctgtgcctccctgagatgtgagccagggtggggagtggtcctgatgaaggttctgttgtgctttgcatccctattactgcctttcctttagaggagcaaagactattgatattttcctaattctcacagtttccctagactctgtctcttcttcacctttcacatgtggctggtcagaaattcctgtcatttctatctcaaaaaaagtctcccaaatctctccctcccttttatcctcatgacttcttgaccctgcctctcttgattacgtcaatatcttccaatggatactccagctcctagtgttgtcttctgtccatcctccatctgctgaccaaatcatttttctagaatgccagtctgaacattgagacctcctgcctaaaatctgttaatagtttcccttttttatctagtgatatatcatggtattataatatacatagaatattatatgggtagtatacaggtatatattatatgcgtagtatatggatatatattatatgggtagtatacatagtatattataataaagcccatactccttagcagggcatacctgtcattccctgtcattggccttcctcctccatctccctgccccaggattctggcatcctttgtcccaacagtagtagagtatttagaactcatcacacacatgtaccctcacatgcacattccccctcattctttcatgccccctacatttgcacaagatgtccccatgttccttttcacagaatcttctttcccttcatgtccacctgccccaaacccatttgtccttcaaactcattgtaaatgttacatcctctgggaagttttcctagactgtcccctctttgccctccctcagcagagttcacccttccttctttggtgccaccacacttccttaggcacagctctgcttccacattccacactataattactcgtatgtccattactgggcagtgacctctttgaggctagagattgtgtcatattcatgattgagtaataggtaataaaccagacagtcataaactattgataacaaagaggtgcctttcttctcaataactgaactaaactgggttcttgagcccccagcctgactaaaggaggcaactgattctaacccattttgttaaacttaagtccagttgagtgactttgtggagtggcatattccagtatttatatccaattttcactgtccagttcaaggcttagtcatttgggtacgtactcagttttttagggcctcttctctccctcttccctctcccttttccctgggtggcatctggatctgggtacaagtagatgcttacataatgccatggtagtgagggcagaggcttcggaactgtattgtaaccacaaagtccttgtgataataaaactgtattttctccctttggtatctttgatgttcctggtctctgacactccctcctatcatgaggtcctcatgtcctttgtccttatttaaactctaaccttatccctgtccccaaatagagcatgaagttctgagtgtcttacaagttgtgagcagattgtagaaaactgttattgtaatctcaagcatggtctacctcaccatgccatactttcatttcacttgacacagacaccccttgttatcaagaggtctcctcttagatttccaaatgggaagaggatcataagaaactgaaatttctattatcattacccgcttacacagacacccccctcccagagggagcatcctcattctaatcttgtcctcttaatctcccctaactccagttaggggaaaacagtcagatctccctcagaggcctatctaagggttgctggccaaaggggccatcatccgaggctccagttgcatgaccatttggagtttgatgtcatgaaggtgagaaagagacaaactgggttattagaaaacatgtattaaaacaaaatgggggcagggggtggggatagctcaaaagtcttgaggccttttatgtttgcacaggaagagggaggccaaaagcccaactggtaaaaaacttttacctttctgccatcgtgtcaggcttttgggttcccttcccctgagcgcaatcctaagccaaccagtctaaggtttgggaaattaactgttcctagtttggaggatgcatctgaggggagtgtcccatagtacagagagacaattacctatcagtgaagagaggaagagaaagaaaaaaaaaaaggcttttttttttctcaaaggattagtctaaagtgcatcccaggggttcaggatgcactcaaaaggggtacagactgaagatgaatggctactcatctagaaagaggagagcaaggcatccctggttcccttctcttcctagcaaatacctggggtacatgagggagagaaagtgagtcattcctctttcttttcctccatccttgtatccccaagttccagtgactgtgacagggtactgcccatggagtcaaagcggctttcacccttgttaaaagggagtctgggggtgggagtatccactcttacccacgtatgccctatctcctctgctgtcagtagcctttgaattctctagacctcatttatgccacgggtagtatcatgacctttatccatgaaatgggaagcctggcttaactggcaggaaaccagtcatgctcacctgtgctatgccttttaacttccattatcatctacctctggatccctcaaatccagttttctttcctagggctttgacctgaagcttggaattgagtttgggacaaaaatgtgcctcggagaaggggtgttgcatggactccttatcataagccaaatgctaaggtgaagctgtggaattgagtcctcctccaacaagggagagaaaaggatgtcttgtgacatgcccagataactggtggctatagttatgcttgctaagatgtaggtgcatggggcttggctttggttagctcccttggtcttactttccccagaagaaaactctgggtgatgggcaccctatttatatcctatttattcccatcacctggcagtatttgcaggataattgctcagaactagaattttgatccaggtttttacatcacctatcccttttattctttctaagctgcagctggagattcctggttggttcacaggaacaagcagggttagtctaaagggtaggcaaaaacttaaaaacaactaatgagtctagaatttaatgacaaatgtatggtaagttttaaaacataatttctctatctccagtccctcatttttttgttaaaaaaaaatcaggactgagttgctggcaaaatagactttagtcttacacttgacctgattatttgcataaagtgcagcaagaataattgtttctacataggccttttagattggctttgatggaactctgttcctcaaggaatttcggataagaccttttaaagctgagcacagccatgggtttgtatcctcaaatacctgtgagttgggtgatcctctccttttaaggtcccaagataaacttagagctcctggtcctgtcataaagtaacattttttacttactacaggtcaggaaccctatacaggtactgcgtagataaggccagttttcccaaggggcttttagcagctctgcaagtcgagcttgactccttaaagggaagcatacccttccagtcaaagccttggtaaaacagtttctccaattgcatcatactgcaaaagaaaatggattcttatggcactgatgcaaacaactacattgctgtaagttaagaatactcacaactagtttccaaattctggggaagccaggcagagagggacatatatgctccaaattttgttcacaggagtataccttaatcattaaaggccataaatagttcaaaataagtttccttgactctgaaaaacaaaacaagggtcagcaatattccaagcaaaagtcaaaaagatagcttcagttttctatgagttcggtccatttagttaactcttgtttgatattcatgaacatttcagctctttatgagtcctgtacatttttccttttttccaatgtcacaatctccaaagttatcagaaacctgtatttgagagcacctgtcagagtcctgtggcacctgtcagagtctggtttattataaactatcttttgaaaaggaccaaaacaagacaacaattgttgggaataaaaaaattgcccagggtatttacagttagaaacacaattgacaaagaagtttggttatctctcttcttctcaaagaagtctggtttacaataacataacaaccttaattatgatgatagcatatacattagacattagaattttaaaaatcccatacaattttggaacacatattaatattattcatcaaaatataacctaaataatattgaacaccattttggcaattccatgtaactaaacatgtcaaatgatcccttttacctctcttttggatactccagggccctctgtagcatccaaaagctaggtgtcaggaaaggcaattttgaaactgaagtttgattttgggaagcctattaaatatgttagtggtttaaaacactgaaatagaattccagattaccaaaagttatttattttgccaaacgatgactcagaaatttaaaaaagcaaaaaccttttataaccctttacaaattttgctaaagagcagattagtgccttaagagtaccttgttgtgcttttatttcaatgctcaatttacaaaaaaactatataatacccttttgaatttagtcaatctgttcacacactgaatttttgcaatattaatttttacagtccttccatcatttgtttaaactgtcagctttattttatctaattcaaaacagtcctttaaacctaggcaagaatttacatttccatgccttcttgtaatcttttactaaaaacacatcttactgttcctacataccttgcgtgtaaatctatttccagtagtttcaattacatgttataatggtaacccctagcaattttaagtttaatgtaaaacctggtaagttgttttaattatgtgctaggttcaggcaaggtttgactccttccaacataattaagggtgtggttaattccttatgtccccaggccttactaattgtcaagctggcaagttgaaaagttcttaaaaaccaaaaaggcagtttataaccttaaaacatttagcaaacctagtatctgacctgcataatttagttcacctgtgtatatttgacaacatctgcattttaccaataatctttaaggctgtttttatttctcaaagattaaagtcacatgaactaaaacgtaccacagctttaatcttccctttaaaaaaaatttgatccaagcacttgtcttccattagaccaattaattagagcttttttatagacatcacacacacaacacatatgtaactacacagacaggcagaagaaaaccagcagccataagattttcatttgcccatctcctatttggattattggcctctgggtggggccctttaagagacagggctaggaaaacatgcagcttttaaggcctaataaacaggcatgactgggaggcaaaatcagagtttgagagggatctatccacttttaattcctggggttccatgagaaaaacaggtttcttcccaaaacggagtggtgccttgtctgtttttcccaaggagtcccatggccccaggagttatcttagggcctgccatgcatgcactgagagtggcaagccaaatggagaaaaataatttagtcaactgaggaaaagcctttttccagcaaagcaagatacccaaagaggaaaaagcataaaggccttttaaataaaccataacttggacatccacttttaattaaactgagcactctctaagaaaatccttttaactcccttattacccgattttagccatgccaagcagctagtatttctggctttcaaactttactaacgttaacctcgcaggtgaaaccaacaagcctcacttaaggttattatttcactgtgagcgtatgcggtattttcgaaggggataagggtaagcaattcttacaaaatttagaacctttagaggtaacccagtgaaaggaagatgtaagaaaaaggctaagcgttgttcatggtggggaagagaatcagcaaatggcagaagtcacacagatattaactggaaagtactcatttcctaagccaggattgaacctaggcatcattgtgaaatgaaaaacaaaaagcattgccacatggttacaggtcacaatcccaagcacacaaaacaagatggaggcctgcagcaaagtttgctgttggccatacaggaagtcatgcaaagcacaccagattggctacagcttaagaccaacctcacaaatcctttttcataattaaaactttacagaaaatataaaccctgatagttggggtcctggcctggtaaaatgttttcttaaaaaaaaaaaaaaaagccagctgggttctgtggctcaggcctgtaatcccagcaccttgggaggccgaggctggcagatcacctgaggtcgggagttcaagaccagcctgaccaacatggagaaaccctgtctctactaaaaatacaaaattagctgggtgtggtggcgcatacctgtaatcccagctactctggaggctgaggcaggagaatcgcttggacccagggggcggagtttgtggtgagccaagatggcgccactgcactccagcctgggcaaaaacagtgaaactccctctcaaaaaaaaaaaaaaaaaagtctgggggaagaatctcttatttttatgccagtgagtttctccaacagggagagaaacttgggagctggggagccaccagtttgcccgtccagccgacattcctgacctccaggaatgacattttaatatgggggggcataatttctctaccctcagaagaagtcggaggacaaaaaggcttagaagccaaaggaaaaagactttttggtttgcatgtcactcacctttccttaagccctacgcctggatgccaaaaatgttgcagaactttctccttagttccaccaaaacggggtttttgtcacttgaccaggaaagattagattggtagacacataaaagggtgaggagcggaatttattgggagaaaaggaaaaaaaagaaagaactcagcaaagtgagatggagtcctgctaacaggccctctacctcaccgattgattcccaggtcaccacacgagctaaagagagcaggctacttccctgcataaggcgtgaattccccgtggctccacccatttcccccagtgctcgtgtctggctccagtctgctgtggggatgcccatacaagcctagggcacaattgttgcctaatctgcacaaagcatctgatgtaaacacttgcggggcaggtcagagattctctggggaccccctttttatctgcctaggcgtttggctatctcagtagcttttagaatctggtgaaagctctgcattttctccccagtaaactgcaagatgcatatacagcatgctgcctacaatttcagggtatttccatgctctgctcaaaacagttaagaacctttgacttaggatggcttgtagcaaacccaaacctgcacgttgacttctgcaattagtaagagtcatctttggaaatccttaagttgatgaaaaagtattgtagcaggacaagccgcagacaaaactcctcagacaccgagttaaagaaggaagtggtttattccgccgggagcatcgggcaagactcctgtctcaagagccgagctctctgagtgagcaattcctgtcccttttaagggctcacaactctaagggggtccgcgtgagagagtcgtgatcgattgaccaagcagggggtacgtgacaggggctgcatgcaccggtggtcagagtgaaacagaacagaccgggaagtttcacagtgtcttttctatacaatatctggaatctatagataacatatccggttaggtcaggggtcaatctttaactaccaggcttaggtcaggcaggcccaggcctggtttcgggtctggttcctaggcaccgggctacctgccttttgttttgcttttcttttctgagtataaaacaatataaaacaatatgagagggtctgtctctcttctctcagtataactgctttatgtgctcaaacttcagttaagatacaatatatgacaaagaacaaatatgcaaaataaaattagtgtttttaattacagacaaaaaagagagaagagcataaagttgctgagagcctaaaattgaacattaaaaagttaataaatgcacttatgatgcaacttcactccataaactttatctgcaatggcagttctaggaagaactgctggttgggcttctgatacgtgctagcactggagaaatcactgaaatttattctctctcaggtatcaagggcatccatcttgcctctcccggtttttccttatcctcaaaatgcacattaaaaacatagacaatattcatataaagtgaaaaatatccaataagttgccattattatttatatgctttttctttccaaaaatattctttgtaaaaaatttctaattgtgctttatattttatttttattttatatttggcaattaaaaagttagcattttgaacatgcactttcactcataaatcatcacctcaaataaaaaatacatacgcaaagaattagattagactgggtaatggaaatgtgaagtctgagtattccaagctggagttttgtaatctgcaaatttactacattgaatcagtatcagtcggcttttcttaatttctttttcttttctttttcacatgtggtctcctgctctccctgtgtctggcacctcttcttgcagctgtgtaatgggggctcagtcactgagcttgtcaaaggtctactcagatgtggccagcggttggatgaagcaatgatctcatacatcttgtacggggccctcttggtaagaacatctatcaaatggggtatgacagcagatgggatggtttgttcattgcttgggtccttattgcatattaacaatggggaaactgccctatgatatgcaaggattactaacagcaggaaggtgtagccaaatgtagactttcatgagacttttcaatagtagggtaattgctttaaaataagcatgtaaatttcccctttctctttcctgttgtttggtggtggtgggatgccatgcagggccttcagcatttgcacaacaaccgaatcatccaccgtgatgtgaaggggaataacattcttctgacaacagaaggaggagttaagctcgttgactttggtaatgactgcttgtcgtttgttttcttgacgtgtgcagtttagccaaaggggacaatttattgcaatctcagaagactggggcttctctgctacaccataggctgagggacttttccagtcaaacacaagctggagggggtgggggctccagatggatcaccctaggagatgctgtttgctaatctagtttcagctttagaagcaattttataaagattgaaaataaaagtgtttcaaaagaagaacttgatggaaaaacttttcggttttctgctaagaatttcacatctcagggcaattgtctataatttacattttgtcatttcttcttttgcatatgaaaagagaaagcagtttggtctttcaaatgactttcactagccttaggcatacttattcccagggagcagaaggtaaaatagtcctctgggcctgggagctaacatccttttaaattgtgtttactgctgctacatgtgaggctggttgaactggaaacattaacgggaaatggaagtgtgagaggaaatgcagggcaatatcacctaaggccagagaactattaaatatccccttgtaatatcatatgttgatattcacaaaacaacaaaccatttggttttttttttaagtttattgaaggtttagtcttctaaatgagttcagcaatagtacttcagagtcattgttacaaataatgagaaaacatttagtgaaacactttaaacgtgtttttttaaaagaatatttattgtcttattgctaagaaagagttcagtgtaaacatgtatcagtttatcacttgctcagaagaaattacttaaaaataaatgaggttggtttagacgtactagtctatttttactgaaacacaagcaaagaaaaatagcagagggagcattttgtttaagtcttatgctcctctttataaggaatgatataactccaataatatgctgtgtgtatgacatttgaattgtttttgcacgtgattctggggactgtaaatatgttgtgaggggaaacagactgaaaggatgaggatggggtgggaattgatactgatgtattcactcagcagctttgcgatttgacatagagtaaatgttcctaatctttccattagaaggttcctgaactttcagtggctgcaaaaggaatgtctagaaattaaaaccagaaaggtatagttgtttttaccaaaattgtggtggaggacttggtaaaatgggaaattatctaggtcaaatagactttaaagagcttcttggctctctaataaagagaatgtccgcagtcatcccccaataaacccacagatccttggcaaatctatgctcatgtttcaaaggtgtgtcctttgctaagaacacatagtgttcagtttctaagtttttgtcatcaatgacattagtggcaacccttgtcattctcttaaggtctatgtgagacttctgtgtggtataaaagaataccttatgtgtgtaaaatgctttgcaatttataaagcattttcacatttgttctcctatttggtcttaagaagaaccctccgtgttaggtgtgactgttgtgattatccctagtttaaagatgaaaaaactgaggctcaaaggtgaagcaatcacataattagtaaaaagcataattgggatggaaaacattgatttttaatcctgtggacctttacgctctcgtgatatgaagaagacagttggttaaaggacattggagttacattagaattcaggtccccaacattgagccccagataatgttattagtcattttctttttccatttgacaaacacagctttcttgccaggtttccaggcttctaggcaagataaggcactgaaatctttttatgtctacactgatgctctgttacagatagtgcagccgatcttctttctccataaaatgaagccccttattaagaaagaagtcatgtgaaataatttggaaatataataggatgatattttggattgatcctagttgttgatatttttcttttgatttttgcagtgatatagacagggatgtccattagggaaaaaaaaaaatcctaatgatttaaatagagtgataaatgctccagagttgtagtttggcaactacagctagtgagccaaatatgacctacctcctattttcatatggcctatgagctaggaatggtttttacatttttaaatgattggaaaaaaaaaacccaaaatattctgtgacgtgaaaattatatgaaattcaaatttcagcatctataaataaagttttattggaatgcagccacattcattcatttatgtgtttactatggctgcttttgtactattgcagcagaactgagtagttgtgacagagaccatatggcccacaaagcctaaagtacttatttggcctttgtggaaaaagtctgccgattgctggtctagcatcatactttgctcacttttgaattctgatactctttccttataggtgtttcagctcaactcaccagtacacgtctgcggagaaacacatctgttggcaccccgttctggatggcccctgaggtaagctggaaatacctagttctttctttgcacttgttgaatgccttggtactatgcctttttatgggtaagtcatatgctttgcagaatttttagggagaagaaagtccattatcctcattgaactttaagagtactagtttggtcagcgatgctggtgagatgtaacctcagaaaagcaagattaagttatagctatcccacagggcaccttcatgcaattagaagaaagtgtccctccagaagatgcagccccctccaagggccatgtcttggcaaattcatcagcccttgtataaattagaaaaagtcaacttccctggatacatgcagccccagaggtatatggctttgtgaagagccagatttcagcaccaactggcctacagaactatatgcggtggccctggttgtttttttgttaccagatacatagcaacttatcttgtgtactttgtcggctctctgtagtgaaacatgggatttattcctaatttaggtttggcatcatcacagaactctctggaaaatgacgcatgtagaagtttggggaaccttccagctagatgagtcttgctctgaaacaccagtgcagtttagtttttcaggtcatttaattccacagtatgctgacctttgcctgagagcagctttctggattaaacaaatgggttcttttaataaaaggactcagatggtcacctccttagatgtctttccatctctgcatgatggtatttcctctgtgtgactgccaaagtggtctcctaacaaagtaagtggttcacactaatctctgcttaaatttcttcagtgacctcccccgcctcccatcatctatggctctttctttcatactgggtaatggataggcccattttaaagaaaaagaaaaatgctgcaatttccagtgtttacctaaatcttaaatatttcttaaataggttttacaaaacataaaactagatataaactctttgtcatttttatttgcagaagtataaaaccaaaaggaaaaaaatgtattatgaaaaaaagctattatacaatgccagtaacattcaagtaagcagctctacttttatgagacaaatgatactgttttgtgactctccattgtcctttgcagtgtgcttatgtttcaggacacaatagtatgggttattttcagtctggcacacctacaaccacgtaccatgcggctactcagttctcctactactttattccatttcagctagcataatctgtttgttcaaacagcacctcttttgatctccaactgttacatctgtgttggcttggtgccaacttaatagtaaacataatatgaacactgtgtgacaaatagtcatccagatgatctagactatgtttttactcctccttctcccattattattattattaatacaattatcactgaaacaaaaccaaaaacataaaaagttatctagggactttgtgaatcccactttgagaagcactgcaggataaagtcaaaacttctttgaattttgaataaagctcttaatattccagcccctatctatccagccttgtttcagattacttcccccaatttacttgttcttaatgccccaacagtagtgaacagcaggtgactctccaaatccctactgatgtgtctttcctttaaacccttggtgtactattatatcatctggaatggcccccaggcctctggaaaattcctccttaattgacaagtctcaaatgctagctctgctgggaaacattccctaatcccttgcccacattgaggctcctttccctaagtttccaccacgtccttagaccctcccttaatacagtatcaccactgcattgtagttgttggcaggcaggtctcccaactggactcaggtctgccagggacttgggatgcctaagctcttaatatagtgcttgatacagagtacatgctcaaaaaaattatctgttgggtcaggagcggtggctcatgcctgtaatcccagcactttgggaggccgacgcaggcagatcatttgagatcaggagtttgagaccagcctgtccaacatggcaaaaccccatctctactaaaaatacaaaaattagctgggtgtggtagtacacacctgtaattccagctactctggaggttgaggcaggagaattgtttgaacccgggaggcagaggttgcagtgagcagagatgccaccactgcacttcagcctgggtgacagagttagactctgtctctcaaaaaaaaaaaaaatctgttgaatgaatgaatgcatccatctgtaagaaagccaaagggataagatgcacttgcaggacagtttgaggacggcttcacaactattgatattagcaaatttgtctgtagatttagatctgttctgaaaggaaagcataactaaggtcactcaactaatatttggggtgatataacacggaagatggtattcctgttctactctagagcaaattggtattttcaaaatcacaaaatataattaagagaagcattttcttggctttgtacatttatgtataaatggctttgtacatttattaagaggtgtttgtggccgggtgtggtggctcatacctgtaatcccagcactttgggaggccaaggtgggcagatcacgaggtcaggagatcgagaccatcctggctaacacagtgaaaccctgtctctactaaaaatacaaaaaattagctgggcatggtggcgggtgcctgtagtcccagctactcaggaggctgagcaagaagaatggcgtgaacccggaaggcggagcttgcagtgagccgagattgtgccactgcactccagcctgggagacagagtgagactccgtctcaaaaacaaaacaaaacaaaacaaaacaatcaaaaaagaggtgtttctgactttccaactttaactggattgaataaaatatgtggagtgttgaccgggagcggtggctcacgcctgtaatcccagcactttggaaggcggaggcaggcgaatcacaaggtcaggagatcgagaccatcctggctaacacggtgaaaccccatctctactaaaaatacaaaaattagcctggcaggatggcaggggcctgtagtcccagctactcgggaggctgaggcaggagagtggcgtgaacccgggaggcagagcttgcagtgagccaagattgcaccactgcactccagcctgggcgacagagccagattccgtctcaaaaaaaaaaaaaaaaaaaaaaaaaatggagtgtttctgtaggggacagtttatggtgagctttttgctcagattccctggaagtggttcccctgttagctgggaaaagccagcactgcatcctgcctgttgcagtggatcaattgaaaagtaagcagtttaaggtatggacaccttgacagcacgttgcaggagtgaatgtctgactgttcaagtgcaggattctctcaggatgtgtgattgtgtccagtatgctctgggacccaggctgtagctcttgggaatcaggcctgcactattctcacatttttattttctaaatggagaagcattttttccaacaaagtctctttttgcgccataatcctccataggaatgtccacaagaacaaccttccatttttcaattcaattcaacaagcatttatattgtccatctgagcaatgctttgggtcaagaacagtccttgaaagtataatcagtaatggttcaaattaacactgtcttcatatgatggcctgtgtggtatattgatcctgatatgctttcacttctgcttgtatgaataagtggtctttagattaaatacgacaatgcacgcaataccaatgccagtggaataagagcattgcagatgacttgtgctttatttttaaaatgcagctgagagatccttgatcctattttatttttgaggaattgaaccaaattgttttttcccttttttatttccatttttattccacaagcttgagtaagtgtaatatttaattcaggtagctattctacaaaccgggtagctaatggaatgtgaccacagtacaatcaaatgttgatgagcagtcaagacacacagttcactggggcacctcaaagctgcagcatgaaatgactatcatattgtcaatactccctactcattttctcttactacctcatttggacactactaaagttgaaagatactggcagagtagtatcaactcagcagtgtaggagaagagttctgtgggatgcccttagtgtattagaactttgaaacaatactactggggaaataaattgcttggcataataaaagggttaatctaaaagtcaagatcagtagaatttttttttaaaagatggggtcttaccatgttgcccaggctggtctccaactcctaagctcaagcattccttctgcttcagcctcccgagtagctgggactacagggcatgccccaacatgcctggcttaagatcagaacaattttttataaactaaacacactgtatgtgagtagcatactgtgactacaggaaagattatcttaagagagaaagaaaaatttcacatggagactatttaggagattatcatgagcaaaataacttgaacaatagataattaagtttctcgtataataagatcagaggtagtttgttccggagtttgttgatttagcagctcataataatagagtcatgaaaacttccgatttttaaatctccctggctatgactgctgcaagctgcatggcttcattgttctgggactgactttagggcagttatgacaacagtgcctgtgaatatctgaggggcagtagtggctccaacatgccaatagccacaggtgaaggcactcatggtgcaaccaaacagcgagaagttaaagtgggttttcctcctctcttggggttgaagacttttccaccctatatttattttcccggtctgctgtaatcaagtagtacaaactgggtagctttaaacaacagaaatatattatctcacacttctggaggctagaaatctgaaaccaagatgccagcaggcttcctctgaagcctctaggggagggatcttgctttgtctcttcccagctactggaggtttgctggtgatctttggtgttccctggcttgcaagctgcgtaactccagtctctgcctttgtagtgccgtggtattttctctgtgtgtcttcacatgtccatgacttcttataagaacaccagtcccgtcggattagaggcccaccctactccagtatgacctcatctgaattcaactaattgtatatacagtgaccctatttccaaataagttcacgttctgagattctgggggctaggacttaaatgtatcttttttttggaggacacagttcaaccaataacaagctcccaaatactaatatttagcacccttcctttgtattaaatcattcaagtttccaaggtaattagtcaactatttagaacctgcagggctgcaggttatagatgctagcatagtgagaggctcagctttgcctgtttacacacacatacacaaccacctcccctactccacacacaccacacacatagactgtctgcactctctcagcctttggtgtttgaggcaaacgtggttctttctgaaggtacaaagcataccaaattgccttcctgtgtgggcgcccaacacccccagacttttgttctctcctacctactctcaggcaaagcatttttaaaattattattatctcctgagatgtttggccagctcatagtcacttccttgaaccttctctttacctgattaagcctctctggtctcctgacctaaaactttagcctgcattttatgcacttaaaaaaactcacaaaaacaacacagtcttcctattagccatgtttattatctcttttctcctccactatctcctgacagccaatttcttatagtaagtaatatgaataatagtatcccacatttgcgtagaatttttacaaatagtattttaaaaacactgtcatctacctgtgagagtgccactcgggcatgattacattgatgttgtagataaagaatctaaggctttgtcaggccaagtgtccatagacacagagtgggtaggtgggtaatggtgactggaatccatattttgtgacttattcaactaagggatttccaatgtaacccgtgtccgctgttaatattgctcaaccaatttttatatcaaacacatgccaggtaatatcctggcctatagcaaaagggatacaagcctagtttatgttgattaatggtaatggcagggggttaggggtagttgatacctaaaaaactttttctaccatcacatatagcaaagaattaaactcagtgtttgtaagtgactgaaacccaagagaaagaaccaatgttgtcattatcgtttttattgaggacaccagtagactttgaaaataatggcttatatttagctgatgtacactgtgtggccaggctggttgttaagatattaaactattcattctggatggtaaatggctgccatccagagccccttgagtgctcctcagccaccagaggtgccctgtcttttaccctgggacatttctgacctgatgatccagtaactatggggggaaaggtctgtttgacaagcagggatggccagtgccacatgccacctgattgtcagatattttgaacattgcacttgctaagcagaggcatagtgggaaggaaactttcacttactgaggactgactctataccagggactatgataggggcttttaaaatattttatttcattttcacaacagctctcaatagtggatgttattttctccatttgatcactgaggaaagtgaggcttaaagagctataggaggaatcgagcccaaattcacatacctagtaaatattgaagctgtttggcttttcagagagcatgggaatgcaagtcccattttgcagatgaagaaaccaaggcagggaaaggatacttgtactctcactttacagtgtgttcatatgggatattcattgtggaaaatgtgtaccagctaactgagacaccagctcatataacaaagacacgcagagatatagtggaagtatactctgaaattggagtgtgagacatcattttaaaagatgcacatgaaggacctatcacctataatttataggttgactacactttgcaattccgccatgcattaaggatctagtatatgcagcatcttcctaaaacagctaacggtctgtttctgtactggaaaacagacttgtggataaaataaacatttgcttcttttcagaaaattctccccctctttacttccatctgctcattgttgcaaacaagagctaatcagctgagcagagaaacagatgtgctgtgacggctccaaaaatgggtctctctctgcctggcaaagggtcgttgacaagggacggttgccataacaactagcttacactaatgcagaaatatcgcaagctttttgcagccactcttgcctttgttaattatgccattcctagtaaatgatacgataatgctatttcctttggcattgccagggctagagatgacaaatgagatattttgtgtcaaagggctgagaaagacatacaacactatagagttgaattattattattgtcattattaccattttgttccctaagctctagctaatgggtttggttcccaaataagagctagcgtttagcgagtgcttactatgtgttaggtgctaagtgagttgtgtgtattaactcatttataaatcttacaacactaccaaaaagggggtgctattgctagtccaatgttttaggtgaagtagatgagtcacagaaagtaattattcttgtccttggacaagttattaggtgatgccaccagagtttgaacccagatatttgtctccaaagtccttacttttaaccactataccacagcaaattatttaattgtgacaaccagtgtaccagataagtcatgaattgttttttcccccaattcttaacatagatgagaattatccttcctaatatatgaaggaaaatgtaatatttcaatctgatgctaaaagccagtgtaattaatgcccaagagaaggatatggaaaaaataaaataaagttctttagaattgaatttaggagatttacattttactcttggctctgccactcattttctagaaaatgattgtggttcagttattttaatatggcttcagtttgaataaaaaagcacaaattttagagtcagatagatttgggagcaaatcatagatacctgctacccatataaccagtaacctcaggcaagttacttaatatttctgactagtaaaatggggagaagttaaaagaggtaaaatggggagaaaaaaacctgcctgaaaagataaaatgaaataatgtactgcaactgttcagggcagtgccagacgcaataggggcttctaacagtggtggcatatgttgcccctatgcctacctctgcttagcctgttctcatctgtaaaaaagaagaaattggcttaggtagtctttgccttttaaggtcctgtctattttacagggaacatttactgtttttagagggaagacctgctttcagttctcatattccatggctctgatgttccacaagcaatgagggtgggatctcaccaagttcccagtaagagtgaactaatgttgatgccgtggctgctaggttccattttacctggctctgttaaaagactggagattcatgggaccctgtctgccggtcatatcactgtgaggaatgcaggctttgggagctcaggagagttaaatgagaggtttagaacttcagatcattggctgaaagacctgcctaccttctccagagacattcatctctgagattccgtaaccttttgctgttgcctggttcaccccaggcattgtgtgtcaggctcaaagaaacagattccttctctggttctgaggctggccctggcctgcctacatttgcagagtggttctgtcttctaaggccctgaggcacaacccagacgctcagtgttccagcaggcaaacggcccaaggtgcaaggggtggaaatgactggatgcagccccaggttttcacctcagctccagcgatagttccctctcagctggagctctgtggggaggttgagtcatgtgtcatatgtcagtgtggaggcggggggctgattctggaggaggtggtgatatgttattaccctcttcctggtgggtctaaatataagaccctatctgagggctttagatcccagatgtgcagaagcatgtgaggcccagagcagaggcctcacatcccctccgagtgctgagtgagaagtgctaagccagaaatgtcaaaggaacaactaccaggagcatttggaatttttaaggctgtcctcactcctctctggggaggtgagaagggtcaaagcatctgctgttgccccttctcttcatccaccaaagaggaaaagaggaaaaactgattctgttactgcaggaacagaagtgtttgctgaaggaatgtcagagttggcctcagctcttcctgagctctgggtcccaaattacccatgactgacctccagtcagtgcctccactgccctgttctgggtacagtctcagcccatgaaagagaattcccacccaagccaaactctacatttgcttccttgcctgatggccactgagccaccatgagagcaaatgggggagagcagtcagcatgagggatgggacctcagaggagccttgagtaggatgaaataggaacaagtagaggcagatggactagtgtttcttgtgctctattatgtcccgggtatttctcatacttttttgtgaggggaagtgggggggtacagggtcttgctctgtcatccaggctggagtgtggtggtgtgattttggctcactgcgacctccacctccaggtctcaagcgattcttgtgccttagcctctctagtagctgggattataggcatgtgccaccacgccccgctaatttttgtatttttagtagagacagggttccatcatgttgcccaggctggtcttgaactcctgggctcaagtgatccacctgttttggcctctcaaagtgctgagatgacaggcatgagccacagtgcccggcctcccataccttttttaattttagagagctaaacagaatcactctctaacaggaacatatgacattctcaaggacatccttatttgcatggtgctgtcagcctgggtgaggacagaaaccacagatacttgccgatgaaggggtatgtccaagtgggaactttcagatactctgattgatttgcttcccttcctgtttttcagatgtgtcatgaaggagaaaaacatttttttcctcaatagtttctgattgggtgctctccttcagttctatcccctactagctgtggccttgagcgcatatatctcttaactttctgaatctgtttcctgacttggtgtaataatacgtgacctgacaagctgtaaaatggactgaattgtagaggttctccttgtccttaacatactctggtggaaatggagcactaactggcaaaagaaaggggcagcaagggagagtgaagggacagggaagtgagaggcggcaggaaatccatctgcttaatgcttgcgtgctgtgcctatgggttcatagcgtagatgttactgtgactgcggctctctgaatatggactctgtttggaagtggctcagcattctccataattataaggattcccaagagatgcctcactcaggaaggtggtaggtaaccatggagtttgctcctgctttggtcatgaaccaactgtgtgatttcagacaaatcaactgactctcccctcaggccctcagttttctcttctgtaaaagaagggggttgaatgagtgaatcttaaaggtcctttcattgtccatctctgtatgaggaagctctggaacaggcaaggacagtgggattgcactgggtctccaagcaaatgtgctccttcactttttgagtaccaaggacacatacgaaatttggacatgctaggagttctgtagatattggtcctgagtctgagaacgggacttaacacacaagtaagaataaatgatctgttcccagggcttcagggaatttaggtgcaaaaatcagtgtgtgggctgacctcaaacccagagtgagttcctcttctaccctccactagctatggtgggaagctggtgtagtgtaagcgtgctttgagtgtttttaatttgaacctggctttatttctctgtagacttaagctgaaacttacaatcctgggaaaaaagagacccatagaacatcacattataattagagaccttcctgaagttcataagaacagtctaatttaaattatttctgacaatttcatagtgtacaaaatgtggatttaatcttagctctagttttagttttatgaaagaccatccccctgccaaatacttcaatttcagttcatctagtccatattccctttacaaaaaaaaaaaaaaaaaaaaacaacgaatctcaaatgtatcctctcttgaaattatgtatcatcataggtaagaaacttcatttgtttattcagtatctcagcttataacactttaagatgttcatttgtaaaagtgataaaaatatttgccactggaatatttatactgtaaccacaatttctgattccagagaagttctgacttggaaatctttatgatcaataacatttatcaattatgctgcatgaattgtgtaagcaaattaagaatcctatttgccttcctacctctcagcccatcttatttgccagtctattgcctgcatttttgggctcaaggtcagccaaggattaatagctttaggtctgtttgccttgcctcttatttagctgaatgtagctcttgagataacagcattttgcctgtgtacttgagtgaaattttaatcctgacctttggttataattttggattgcatgaatgattctagtaaggtgagaaatcagaacatagaaggcaaacctaattacatttttaatgacatttaaaaatattagtggaaaattagtctgaataatacctgttgtttaagtttgataaattatttcttatgacagcaaaaatactataatactatttgcttgaaaacattgcttaaaattacattattggaagaaatttcagcccagcagctctctgacataaaattcgataaatggtttaactattttattagagaaactaggttttctgaatctagaagctcatatattgactgtttttatccctttcacatatagtataatacagatgatctttctggataatgaagatcttgagatgagaagctgtaagctcaggttcttatacaccaagtctttgtgcaagagagggtggaactcactcctatcttggtaactttatcaataagtcctagtcatggatcatgatggcccgagaaagtgaaagtactctactcatgccctgtgcttacagtagaaagggatatagttgggaagggaatttcatttgtaaaactgattaaaaaaaatctgccactggaatagttatactgtaactacaacttctgattccagagaagttctattttagaaagccttatgttcaataacatttatcgattatactacatgaataattatgcttcattcttctggtattaatctcatggggacctagtttttttttttgttttttttttttcgagacagagtcttgctctgttacccaggctggagtgcagtggagtgatcttggctcactgcaacctccgcctcccatgttcaagcaattctcttgcctcagcctccggagtagctgggatcacaggcatgtgccaccacgcctggctaattttttttttttttttttttttttttagtagagacggggtttcaccatgttggtcaggctggtctctaactcctgacctcgtgatctgcctaccttggcctcccaaagtgctgggattataggcgtgagccaccacatccagccagggacctagttatataatcaagatacaacctttaacctgccaacttcttgataaagaatcccagcagtcaacaaatactccagaagaaagaaacatgcccttgaaaattaaggcaaacttttcaatatttatttatattttcaagacaaaaaaacataaaattcgcttctttctattatagaaataatccatgctctctatagacattttagaaaacataaaagatcttaaagaagtaagtagataaaataattattagccatatgtcagtgatccagtgatatctactattaacattttagtgccatagtaaaagctgaataaccagcattttcataagcagtgcttcggatgaggcccatgaaaaaggggttgcttggtttgcttgcaaagaagaggtacagggagataaaatattttgtcaaagtcacccagtgagagggtggcaaaaccaaaacaaaaatgccaggctctgggattttctagcattagtcagaggtgaaagtctcttcgtgacccaagagctgctgactgttgtttttctctgccattttctggctggtggctaaggaaaggaacagccatcttcaacagaacacagctgaccctgctcaaggacagacaaggggatgatatgtgtcaaagcagttgtgcatgtggtttcatcccatagattcccgcaggagaggggaggtgttccctctgtggggtaggagggagtgactgggggtagatttaaggagtctggatctgtgaactccttagcctgaagaaggctaaagagaattgcctcaacaattgaagacagataatgactagcctttgctccaaagacctgtcaagctaagccattagtgaaaacttgtttcttgttctcaatcttctccagaaagaaaagtttttggcagctaaggtggtaatgaccaacatttgggagtctcaacccactgctaggtaaaatagctattggccttgggcactaaagctgccagtgcatagatattgctagtaatccagcattagtgtttttcttcttcctaaaataagcagcagtgtagtctaactgtaccagaagagccgtaagtttgcatttcaaggtaggaacctggacatgctccattaaccagcttccaaacaattgctctgtcgctgaagctcatcttccttaacagaggcattattacagcaaccagcatattttcatagaccttaagaccttctacaaaacattggcaacaaaatcccctcaaagttccagccatcctgttcacacctcagaataatgtactgttcactctagctaatttgtatggcagtgttagcctctcagtttgagatactacccaaagatcacttacttggaagtcgcaaagtcgtagaatattagagctagaagggatcgtataggttatttatttccaccttaccactttatagatagagagaggtcctgagaatataagtgatttgttttcagatgtgaaagggtgtgcatttgggatcctggacctttgtcaacaccgtctcatttctctccactcctttaatgtgacttacagaacctggaaaacctggtcccaaagacgtgcacttacttgccttcgtcagtctcctttcttaatggagcatcctaacaactgattcagagagttctttttgaggtcaccttctcctggggacaagggaagaaagaccattcgaccatccaagcatccttaactcagctctatttaacctagagacaaggagaatgttgagctaaagagaatgatagtagtgttttctcttaaagaaatagcttcagactttggtattggattgatagggaatcccattccaggatgttgaccttcagttgccctgcatcctcttaagagtgcttctttaactctcatcgtatgtgtaacctgcagaaagggctgtttcctcctggtaaggagcaatcctgaatgagagacccccaaagaagatggagttgaaatgacaaaacctcagaacacctgagcgtagtcaaaatatgagtgcagaagctgataattttaacaattttaaccaactgtaacttttattatagatagcacttatatggcaatgattcatttagttatccttctccctgcctgggttcaaattctggccctgacaattactagctatgtgatgccaggtaagctgtttaaccatgctatcctcagtttccacacctgcataagtgataatagcacctactttgccaaattattatgaagattaagttcagtgtgtatttgactttctcttcccagggcctactatcatgccagactaatgagtactcaataattatttgtgaattattttattagcataattttcaataaacttccttggaaggctgaacttaaataatttctttgttacatgatgcactgaagagaagaattaggccaagatatgattttctattcatcagaatgagctgaagataatgtttgtctgtaaagagaagttgaaaccagatacaagttttgaatattttaggacaacgcttgagaaatgttagaatatctccattttcacatttagatatgttcttagaattgccttttgtgtcccatccaagttggctagaagctgatttgaatttctccgcaaaagttctagactatgggtactagatactttttattgtcttgcttagccagcagtggtctccttctaaaatcttaagcatttagagcccatatcctttattggacgtgttagtacacattgtcttagggcatttatagttgtcatggtttgtcatttaattatgataggttcaccttatattttgattggccatagctcctattggggaaggacagagtcttatttctctctccctcacaggccctatcacagtgtcatgaataacagtgaactatttgttgattgataggtctaaaattatgtttgtcttacactttcgaaagtgtcatttctgaaagggaaggtgttgaatagccttctctagggatctttaaaaataatgtaggttctcacctgattggggtgaggaaagggaggtctttgggggcaatgaaatggcctttggttctgaaactggaattgtttgaacttcagtttgaatgtacatttgaaaataacgtgttaaaagtatgacaggatattctattcagaagatggggctggggccaggccaaggatgtggatatatagaaaatgttcttcagctcagaagagaagagtacagggcaattatgagaacaagagcacagagtttagagcacattttgcacagttggcacattttgccaggccttacaggtccaatgcactgtttctggaagagagcaggaatactagttttctatcactgccataacaataccacaaacttagtggcttaaaacacctgtttctggccgggcgcggtggctcacgcctgtaatcccagcactttgggaggccgaggcgggtggatcacgaggtcaggagatcgagaccatcccggctataacggtgaaaccccgtctctactaaaaatacaaaaaattagccgggcgtagtggcgggcgcctgtagtcccagctacttgggaggctgaggcaggagaatggcgtgaacccaggaggcggagcttgcagtgagccgagatcccgccactgcactccagcctgggcgacagagtgagactccgtctcaaaaaaaaaaaaaaaaacaaaacaaaacaaaaaaaaaacacctgtttcttagtcttaatctgtttcatgctgctataacagattatctgagactgggtaatttataaagaacagaaatttattttctcacagttctagaggctgggaagcctaaggtcaaagtgctggcatctggtgtgggccttcatactatgtcctcacatggcagaaggcagaagggagcaaacccagtcctgcaagcccttttcatggtagcattaatccattcacaagggcagaattctcatgacctaaccacctcccaaaaggatccaccttccattggttgcactggggattaaatttctaacacatgaattttgggaggcatgttcagaccatagcagttatcttacgattctctagatcagaagtccagtatgagtctcaccaggctaaaatactcttctccatttcgaagtgtcccaggcatctgaggcttaatatatcctaaatggaggtccactcttcaccccaaacctgcccctcctactgtcttcctcatcttagtaaataccaattctattctggtggttgctcatgtcaaaaactttggagtgttccttagctctcctttcttctaagccctgttcaacaaatccagttggctgtacattcaaaattatacctagaatctgattatttctcgccatctcacaatctctcatctggatccctgcagtaacatatttaactggttttgtttcttctcctcataatctatcctctgcacagtagccagagtgatcttgctaaaacataagctagatctgtcactcctctgctcaccacagtcagtagtctcatttcatttggaatgaaaaaaactaaagacattatgatggcctaagagggtgtctctattactctggtcttcctgtgctcaccattataggtgttgcccctccctgatgttttggatcatcagacattgaagtctcccacctggccatggccatgggtcatcctggtggcagattttaggtcaaataggagttcctggtcctccacatcctctggctcactcctgacttctcctatcgccattgtgatagtcatcagagtctgagtgtaggagatgttcttgcctgactcaaaaagttgataaaaacattcctccacagggttacagactcctcaacccaatgacaagcccagggtcattttctggttctgctgctcttgtacctagtcaggccaagtaactggaatggcagttgtttctgtgatgcataccattgttggagtttgaggaggggaaagatgctcttagaaaaagggaagggtggagtggggtcatttctactttatgttaaccatgtgggtcttccaacatctctctgcttagttggttatactcgcgggaatttcatgcatctcaaagtacacaagcatctttgagaacaattgttgcttgttattgaattcagtagctggtaatgaggtgaaggatgtagacaaagcctttccttaaagaatagcagggttgggatggtgtggtatacatccgcttcctccccttgcactgttcttgttacttagacggttcaatgcatgctttttaaaaacaaaactgacacatttgtaaaagctaatgaacgtataagataataaattggttatacacaaataaggcctagaatgcacacatcttattactggaattcaatatcatcgtggccaagaaaactgagaacggggctaagatcagcccagggcctttttaggacatctgatgtggcagtagggttgatgtgtcatgtcctgcttttgtccaataggtcattgcctgtgagcagcagtatgactcttcctatgacgctcgctgtgacgtctggtccttggggatcacagctattgaactgggggatggagaccctcccctctttgacatgcatcctgtgaaaacactctttaagattccaaggtaagacacaagatggcgctcttgactcattagttctttgtgaaagcgtctggttagagggataataaatagtttgcaagcaatttctctccaaacctgacaaagcctgattgtgaaatatattttctttgaaaaagcaaggggggctgggggggacagagaagaggatgttcctgaaagataacataccccaaggaataataagaccatgttggaacaattgcctatttttagcactcagctttttctgagatactcattttttgtactttgcacgataagactacgaatggaattgtggattaagtaatctgtctaaatgctagtgttttctttttaattacatactttctctagtattcagtgaaaacatatgtatatcatattgctgtattcactcagactagcattgaaatgtatcagaaaatgttacatcagcgctatatcttactctccatcccttaatttccgtctcagtggaaaattgtgcggaaagaggtctgtttggagagcatttaaatgcaagtatactttctattctgtgtattcattagtggtttgtacaagaggttgggttgcctttcattggaatcgggctgatgtatggccagctcacggctctagttatggaatatgaagctatccagggactccttcccaaccagggtgcagattgagagataatttgtaccttccatatgtctctttcaaaggaaggctctgggcaggctgggagccatttaactgccttaacaatacaaatgttgacctttccttatctgcacaatcacacagctatcacagcctttaaaaatttctcctgattgcaatttgcatttctgattaggtctatttatatgcagatgaggctctctgatgttcatcatcataattttatcattttatacctaatccagatgtgaacaaccaccaaccactattccaaaaatgattcccacccaagccagagttagtctttttgcctttttcgaatcacaaaaacaggtcacagcgattagaggagcagacgaagcacctggctttttaaattaatagtctggtgaacattcaaaaggatataagaatgcaggagctaaaagctgcattgtgtatagtaataagtcagaaaatgggaaatggtgtctggaatgatttgtgtgtgtgctttgatttttttttacaaatggtttacccctcaccatttatttaatgtggcaacataatttcctgaatatcaggattaaggtgtagcttctctttagcaaaataatatgtacttttgataagagatcatctatatttttttcctttcttgttatgtatttgtatacagaccaggtgttcaaaaatttcttaaggtgataaatgtgaggcagcaaagagtgtgtgtttttggcgggggggaggggggtgtatatgtttaaatagacccttccactctattgactccacttagcttgcttctgtgcccagccaagcttcttctaataatctcatattctctcaccactcatctcttccatcttgggagaagcctccagatctccagatgtggaatacgagtaactaagtctctactgcctgcctcgggacagagtggatcccaagaattgggcaattgttagaaaaggatccttatcccaacttagtttaaggctttgtttctctccccctagtgtaacctcctgcccttttaatgtctcttggttcctgtgcaaatgatgaatcagattgaactaggcaatgtcagcaataatcagtcagcagattctcagtgtgattatgtgtgctcatgtgtgttcaacacttgccattgtcacaaccttaatggctgacgtgacattcttggacaagaatgataagaggttttattttattttattttaaatcttagcatatttacgtacattgtacagcttttttcttccccaaaccaggaaaaatatgttgggtttatattcaccaagttatttactttaaaattactctgtcaattagaattgcacagttctctttgaagggttatggattgaccaaatgtgtgcatcctgtgtgagtgctacttaatttctagtgctaaaaatgtatcctttccccagaaaagctctttgatgaaaagtacagaaattaagcatttatgtattttaaaaaggcattcaaattatttacctgtgtgtttcattggaatcgatctcagttcagtgcctgtctgtctgtctgtctctctttctctctctctctctctccgccccctcagtggagaaaagcaaatgaaaaataatgacaaaaatcctttgaatccatttggcttcagaattaattttttttctatttgaatgtgactattttcagtgctttggaattcttgtcagtgaaacaatgaaatccttttcagggtatgttgggatccagaatactgcgtgtggcttcttcctctggctttcctcactgaccttttcccggcaaccctttctttactggaaataaattgagtaaattacccagtaagggaagaaaataaaaccttgatggagtcagggaagaagtgactttcacaagttaaaaaaagatttatgagttaatgaagtgctggttacctgtgagcctcagatgtcaataaaacaggtaattaggaaggttccctgggtattgtcaggaaataggtggcaacttgccttgatgtggttgatttgcctgtacatgggtctccttgcttttcccttttcttcctttatccaccttctcctttctcttgaccttcacattagaagatcacacacagggtcatcgtgacctgctttgaaatactgcgtgactcacaatctttcccactttgcaaacacacagaaattacctgctgattggcagagcatccactatttgctgaacctgtcagcatgtgtcatctcgtctaacgcctttgctccaaaaaagtcacccctctctgactgtcactgctctgtctgctgctatttttccccaggagttataagagagcaaatgagtgaatatcatttctctcaacatcagtggattcaactgtctctcatgactctttactgaggacttctttaaaattccaaaggcttaaaaggatcttgaagatgacctggatatatttttcccttaaaaagagatccgtttcatagatataattgcaagaatcaatagagttagtggaaatatacaattatgttggtctcttgacaagcaggtatctttccttagctttgagtctttggctaatgacccccttgacttccatagaggggagtgaggaaggctgtgggcatcagtgtgggtgggttcactggtcagtcactgacagctgcatcatctgcccatttatttggggccaggtatgagctgactctgtccattgtctcatcacacattgaatatttccactttattccttgtggaaaaatgcagaatgttttcaggattctcagcagaaatgtctttggctggaaatggacagcacaggctggcctgaacattccagtccctgaagctggtgattatcccttcctaaagagaatttccctgcagtacacaattcaaaaaaaggacagctcatgatcatcaccaatttgcatttcggcttgtttccctcactaaatctaggttgttccaaagtcacctggacccagctgtatttgtttcttagggctgctacagcgaatgaccacaaactcggtggattaaagcaacagacatttattctctcacagttctggaggtcagaagccccacatcagcgggtcagcagggccacactccctttgaagactctaagtaagaatccgtctttgcctctgccagcttctggtggctccagcttttccttggcttgtggcagtatgattccaatctctggcttcgttttcacatggccgcctttcccacgtctttgggtcttcttttctggtctcatataaggacatagacttagggcttatcctaattcaggataatttcatctggggatccttgccttaattacatctgcaaaaattcttattccaaatgaggtcgcattctcaggttctgagtagacatatcttttggggttcacaatttaaccctttataccaaccaacttttatgtttaccacattccctgagaaactaatttgcgggcaagatacaagacaattagctcaatgatcatggaaaaataatagctgctaagatctgtcaagtgctaactgtggggcaggtacagtgttctgtgttttagaaacagaaatgcatttaatccccacagcaactctgtgaagtaagtactgttaccactattttttccagatgagaaaactcaaggatgttaggcaggcttgcttccctccttttcagggaggaaaaatgatttgaatctgagaagtttgactctaaagcccacatgttttgctactacattgaaaagttaaagcccttccttaaattatattatgtgttgatgaattacatatgttgagcactgaggggactggggtatatggaaatgaatagaaagtggtcctgccctttaagaagcttacagtccaatatctttcctcctcccaattttaagctgacattatcaacctgaaagttagaatattattagcatcatgactgaatcagccaagaaacggaagaacagaaatcaagagtgttgtcttaggtgaacataggctgtctctggctcattgatttatgacccgcaaaccagaaatctctcccttctccaaactccccttaaaggaactgctttttagttcctaatttagaacacttaaggcaagtttttaaactaaagaattgtggaatacatgttacataaaagtagaaaaatacttcaggatatcttattctcacccagaagtttctgtcttatctcaccttccttgcaaagttgtatctcccgtgtcagggctatttctagtatagccaacaccttctctccctttgcctttctcttattttttctcttcccttttatttatttgtttttttttttagtaggaaaagctcattcttggtcttgaggaaaatggaaatctgtttctggcatgctaagttggaacacactttctcatgaaagcagtattttcaatggttatttaggaggaagcaatagaatagctgaagttctctactttggatgcattattagatttttgtggctaaatagagctgtatgacctagtctaaggacttaggcttcctctagagctttatacttatggaaaaagaaaatgctttccaagttcgaaactaccagtttacaaaagagctttggagcacaatccactgggaacttgggaatgcccttgtcctctaccctaggacgccttaaactttgttcgtccagactcaggcttgggttgggtgcttgagttgcagagatgacagagtttttgctgtcaaggagcacatcagtttactgcctcctcctcatttatcggtaaaggtgaaacggagagagtttggataacaaaaaggagaaatcagatttttgggaacccagggtctggatccttgtggactgcctggatgctgtgggtagtggggcagatgggcaagtcactgcttgaaatatttgtgtgtctatttgaagagcttcctcagggactcagtgcctacaatcgactctcatcctgaaataggatccttgggctaaatttttatcttacataggcatttttttttttaagattccttttgatgctgactttcctaattcacaaaccaaattgttcctatatgggaagcagtagtctctgcctgctcctccgctgtgagatgcagaggcagcagggagccctgagtcaccagtaattgtctcactattacagaattgtcacaggacattttcctttagggctgtgaaatataaaggaaagaaattaaaactaaactattgttgaagtgtaatgagtgaggggtgctgagtgtttaatggcacagtgaggctggatttgccctggggagtattggtttctcttcaccaacccaggtcacttagctattggccttttgagcaatgaatccccacgatccaagcttcactcataaagcaagaagtgctagaagaattagcatcatttagcatttattgagtgcctaatagcaaaaaaaaagttttaaaatattccaatagaaaaacagttatgttttatgtatctttttctttctttgagagatttctaatcccatttttaatggattgccttcagtatgtaccctgttccagatccccagaatatcttctgggcccaggacttgacactccctttccgtgggaacccagtagctggaggcatctggcagaaatgccccagaaggctttcactctgtggaacacattgccaaattatttttaaattcgagttgagcagctggggccattcagtcctatgtaggtactgcttgctgccccctgcctgagtcctggcaggcagggagaatttagctttgcaaggtttcatttggggatcaggtgacaaagcaggagcatgccttcagggactttgggtccccaccactactgagtaagaagctcaccctgagagacaggccaaaggtgcgaggggttgattcccagcgctatctgtgccttcttctcattaccctggtatattattttggcacaactgactgtggctaattccaacccacctcctaaatgatggagagatgggcaaagaagtaggcaaggaaacagagctcaaaattgtgctagagttgaggcaccctggtttcctctctactccagaaaaaactaaggaataaaggtgaggaataattataactgcctttatgggttggcataatggtaggggcaggggtaagacagggatgaggagcaatgaggtgatagtctaaaggaaggttcttcacagctggagctatccattcctggaggatcctagagtcaagtgaagccagtatcatttgaaggaaaatatagtatagtggtccagcatggttgtttgtatcagttaactactagtatgtaacaaaccatccccaaacttagttgcttaaacaacaaacatttatgatttttcatgagtctatgggtttctctgggtggttctgcagatcttggctgggcttgctcatgcatctgtgatcagctgagaatgtggctgtgttggttggtctaggatagccttggctaggatgacttggctctggtccatgttgtttcttatcttccagcaggctagcctgaggtagttctcatattggtgacagggttctaagcacagatagaggaaggaacagaaaattggaccagttttgctctcaagttattacagtgttctacagtcaatctacacgggttcaactagcagctccatcactttcaagttcaccagtgtgaacttgaccaagttactgcatgtctgtgtgtgtcagtgtcctcccttataaaatgaggatttgagtaatgtcgacctcatagagctattgtgggagttaaagaatgtaaattggtcagaatatttcatagtaagcattcaattcatgctggatgctaccaaggaaaatatctcaagggcatatttatactgtaaggaattttctttcccttgtagctgaagaattgaaagcttctattcaaaaagagccacccatgagatcagtcatttgaaagttcagctaattgattgattgatgattgtatgaggaattaagagagaatgaaggctgatttctgaagtccctactacttacattgcatctatgtgaaggactctgccattagtatccattgtcacaactcctttgtaaatagacacactcttaagagatacggtcacatacacctcaccctcacacacatacatgaatgctgtgacaggaactgcacatgaggaagcagggctggccttagtctccactgccatgatgtctacaacgagtggtgatgctgtcatcctctgaagagaactagggccatggtacttttcctttgctatcagttctatcagtttttgtggtggttttgtgctcggttgatgagtcgtatgactggtcttggctgcctccttctatagggtccttttagcccccttagtaggttcaaccttctccagggttctagaaatttttttgtctgcagataaagggacaatagcaagagttctaaacttagggtcattgattcaaaattgagtcccattttgctatttcctctaccacagataatattttttttcccagccccacctggaaaggctcaaaacattggcaaaaggagacagaaaactgaagccaggtcaggggattgtaaggagagcacctggttgttgcagataagttcaggtttctttggggaggagtgatattccaggtgctgagggaatatacaagtgagactgctgccccactatcagtgctcttagaattctggagaacagaaacagtattagaggagtagaaaagggagaatgtgcttcaattcttcaaataagggaagagggcagagcctgcagactactatctggtgagcttgactttcgccttgggataattactaaaatttttttcattttctccttgaatagtgtgtgaattcttagaaagctgtgatcactaggaattagcacgggttcattgtaaacaagccatgtcagacaatttccttatttggtgttaatttgagactggtatgaatggggactattttagacataatatatttgtatctttggccttaagtaaaatttgttgtgacatcttagtggctaagatggaaaaacatagactggagaatggtggtagcgatggaatcacagcccgggaaagattgtgttgaggaacactggataattgtgtcaatatgaacacactggctggggtaaaattgtgtcagtatgaatacactggctgggggataatcgtgttggtatgaacacactgactgcgggaagttctgggggcctgaggcaggactctgctgaccgtcctgccaactgaacatttaaaaatatttaatgaattggaggacattggcagcctttctgtcacattcaaggaaggggtggttggtgtgctggatgacaggcttggaatcccacaatgtcttagtcgttaaaggcaatgggggtctctaactagcaaatagaacccttggaaaccctggtgaactgtataggctgaaagagccgtgagtttaatagcccacggtgaaaaatgaattatttgtagctgtaagcccaatggggggatcaaacagtaagaccatcttgcatgaaacatgaggtttgatagagcacccactaccagcatcccccaaagtggctctgtcctagccagatggaatgatgtcttccttctgagtgccagaccaaaactgccataagggagtcttaccctggcagaactctaaacctgaagctgacatttcaaaccgggattcagatgcctgggttccggttctgctcctgctctgttactattccatcatttcacctttcagaggggaataaatggctaccattcttgagcaaccatgttctgcactcagataacagggcttatgtaaagttttcttaagtatcctctctatattctgtggcttctcaatagacaggaatgagaatagctactaactgcagggctggggccactcactgcagcagcaagtctcacccaggacagggtcctcagtccttgatatagataagaatatcctgggagctttaaaaagataccagtgcctcatgtataggtatgtaacaaacctaacaaacctgcacgttgtgcacatgtaccctagaacttaaagtataataaaataaataaataaataataaaaatataccagtgcctgggtaccattccccaggaatttcaatttaattggtttgggtcaagttcagcatttatatacaaatacaattaattttacaaatataattttgggataacatgcatattattttatatttacaagttccctagatgattctgaaggggttgagtaaaacccttccctgaaacaactatcagacccttgtttgtttttttgttgatattttaaaactacagagtctccctctggaaattcttgctcctaccttcccaattcccaccccatggttgataattgagaaatgagagatgatatcaatggaagtgtgttgcacattatgaagaatgtaaaagtagaaaaaaggattctagcagaatagccagtggtgaagttatgggttgaactgtggtgtgccccctacaaacaggtatgttgaagttttaacctccagtactttatttgcaaatagcgtcatgtggacataattagctcacttaagatgaggttatactggagcagagttgatccttaacccaatgtgactggtatccttataagaagaggaaaatttggacatggacacacacacacacacacacacacacacacacacacacgaacatcatataaagacagacacacaggaagaaggccacactagaagaggcaaggaaggatcctcccccagaggcttcagagggagcatggccctaccaacaccttgattttggatttctagcttccagaactgtgaaagcataaatttctattgtttaaagccacctggtttgtggtgctttcttatggcagccctaggaaactagtacagtgactatctagtttggagtccattgctcctagtagcatcctggaggtctgcctagggcatggttagggatgggacaatgcggggagggagggaggtattcttcctaggagagtcctaggggtgggtataggagttagattggccagccttccattcttcaacccccactaagtggcatttctgtagaagtcaagacaatcttacataacatacttggcagttctcagtctgcttctagataggaagtgggtacatgagagattcttcctctcccttgcaccagacagctgagccaagaacttccttttctatccagactcttctgcagtgctcagggtggagaagggagctctacgtttcttctctgagttcttcccagactcagtacttccagaatgaagtacagaataaagatatggcttttaatgttcaatctttccatctcagaacacagtagtacttggggacattgagaggtagctgttgtggcctatctggcacaggtcctctgaagttaggatttccaagaagattcaggtgtccatctgggcaagggtcaagcacctgtggaatatgatccgaagagcagcaccatctgcttcttatgtctcaaaggggcttaaaacctgcacagagggcaggcagcatcctgacatcatgcttcatcctggtcatggggaatgggcattgacttctaccaggcctcatcaaggtttcgttctttatctccacgccaagcaactggcctatttagggtgtcttagttcattcaagctgctataacaaaatacctgacttagactgggtagcttacagacaatagaaacttgtttctcacagtcctggaagctgggaagtccaagatcaagatgtcatcagatttggtgtctgatgagggctcactttctggttcatagatggtagcttcttgctgtgtcttcacatgggggaaagcatgagggggtctctcttaggcctcttttatgaaggtactaatcccattcatgagaagtctgtcctcatgacccaattttctccagagaccccatttcctacaacaatcacactggtgattagatttcaacctatgaattttgaggggacataaacattcagaccatagcacaaagaatggtgaggagcactgtgtggggagtcccctcctgaaccctcctttcttcttgcttcctctacatctgaaccttcagcttttgcttcctttggcctcacattcttggtggcaaatttggcttgctctctggattcatggttcccagctccccctctttctgtgccacctgttgtttggactggaagctcttgtgttcatgctgcattactcatcagtcttgattggcaagacccctcctggctgcccttactcctacagtccacacttatctctgatgaaaatatctctttctttcctccttccttccggaagggtgaagggataggaagtctcccacttgaagggctgaggaggggtttaaagttagtcaaacctaggcctccaagtcacagggatcctatctgcctgataatactgctttatatttatgtggttctgatgtcttcaggctcagtcccatactagcaagatctgagctgcatacctcttgtgttagttttaagaaactgcagtaaaaaattaccatacatttagtagtataaaacagcacagatttattatcctttagttccgaaagtcagaagtctgaaatgggtctccctgggctaaaatcaaggtgtcacagggctgtgttcctttctggaggctctaggggagaatctgttttcttgccttttccagcttctagaagttgcctggatttcttgacttgtggctcccttctatcttaaaagccaccagtggctgctttagtctttctcacactgcaccactctgacactgtatcttgtacctccctctcccccaatttaaagacccttttgattatactggacccaccaaggtaatccaggataatcttcctattttgtcagctgattggtaaccatacctgcatataaacttaatcctctcttgccatataacctaacatattcacaggttctgggtattaggacacggacatctttattctgcttacaatgcctcccaaagtattgcccaagaatttttagaaaccttcaagagcgtgctccttatgtactcatagccattttgagctatcattattgtgtggcctctgacttgttgtttctcttccatctagttcttctttggccacgtttactgcctgcttatctaccatcagaacatccaggcctttgcaggctattcattctggtaactcccaaagcctccagtcctgggtgccaaagcactggtttccactcagaggaagggaggtagcccctatcctgagctctgagccattctctgccacttaggtccctgagcaactctgcttgtggccagagcctcaccattttggctctcctctctcaacagagtaacatcaactccctctatataaacgggcctttctatttttatccttattcttttaattagtccaaggagctagagagaaaacaaacccacaccaccctgcccaccttcctccacatttcctctgccccaaacctaactcttttggcctcagcagtttagtaacagatgttcttattcatatcaacatttgcttgagggagaagagaaataagggagagttactgactattcctgtggtctccaatgcaggagcatctgaaccaatcccttggagtgcagacagaaaatattagaacttctgttcctaagtatttcaaatcaaaaaacaagaaaaacaagaaacaaattatgctttcctattactaagtataaagatgatcactgctgcctttgttcagtccaaatgttggacagtcctgtctggttgggtttacagatgaatcatgaggcagctccacagcaaaaaggctgaggaagctccacttgtgggttcagttctagaattctggaaagcattttcatttaaaggtgcctcattagtggttatatggcaaacgtccttgagtttcaataaagagaccttcacaaaatggacaagtggctttaaaagatttctgtaaagaaacctcagactgaatctaattctactaatacaagcaaaagtgagcaacagaaaaaaatggctgaaatgctggcacttctcctcctatgacaagctcttcatcagccacttgaggtttagaacaatgacaggctaatcagatctgccaagaaatcattaaaaaattcaaaattaccatgaagactattggaagtatggatttatatccactattattgacgatgagccctcttcataagtgtgttttatgcatgaagttattagcatgacaccatcaagattattcagcattcagatcagaaagataaaccactacaattcaactacaaaatattttgggggtactgttaaaacatgttatttatttcatcttattcattttaaaatttagtagcacttgttcacaattgataagaaaggaagtagttactggaccataggctcaacatttgttactgatgaagtgtgcagtcaaaaaagtttggaggccactgtcttaaaccagtagctttgggccccagttcagccactgtgaaatgggagcattccctgacccccatcacaggacgtgacaggggtgtggcttttctgtccggttgctgctgctgctcaaacccattacaggaaggggggcatgcagatggacaggtgcaggagcccaagtgggcgtgtgttacagtgcgttcctttaggtttgccatccatggatggcttaagtgttaaccagctcagtagatcctctgcctttttgcaagggtagagggccagtgtgacagccttctgtatccagagttcttgtccagtgtcccggaagaactgggtcacacacagacttgaaaaatgttgaatgtggggttttattgggtggtggaggtggctctcagcaggatggatgaggagctggacaggggatggagtgggaagatgatattcccctggagtttggctgtctagcggccgactctcccactgtcccgagccaaatttctgatgttcagactctccttatcttctcatgccgttctgccattcgtctgcttgtctgtgcttctccttctggagcctggggtttgaggtttatatgggtacagttgagggggtgtgatgggccaaaaagcaactttttggggtacaaaaacaggaatgcctgttttcacttagggccacgggtattcgggcttgagggtggggcctttgccagggaaccgccctcttctacccagtatttccctgtctcctgtccgtgtcaactgtacatagcttttttacaattgtttgtcccttcacgatttacatttactgtcttatacagtttctttgattctttactgcaactctgataggtagggttcttttttttctttatgttagagttcagaggattcaggactcagtgttgtgattggctcaaggacacacagttaataaaaacaaataagtggcagagggcaagcttgaagagatctgcattcaatcaagattgattgcaaaatgcaccatttttaggaaaatggtttttataggttgaatcgtgtttctcagaaaagatacattgaagtcctaatccccagtgtctcagaatttgaccttatttggaaatagggtctttacagaagtaatcaagctgaatgaagtcatcagggtggaccctaattcaatatgactggtgtctttatggaaaggagttaatttagacacagagacagacacatagaggtccaggaacgcctgggctaccagaagctgaaagaggcaaggaaggatccttcccttacaggttttagaaggtgagtggtcttgctgaagccttgactttggactgctagtttctggaattgtaagacaataaatttctgtttttctaagccagctggtttgtggtactttgttacagcagttctaggaaactatggtccattgctctggaaagggtctaggatccaaaagcagctaaaaccagtgatataatccagtacaaccataagcagaggaggaagcccagagactgggagtgagttttcctaggtgatatggctagttagagagatggttagttagatccatggctggatctcatacattcttactcctaagttcaactttgagaccaggagaagtaaatatggggaagttggcttacctctctcatcattaggcttggtgatctgccttgatctggcatagttcaccgttcttccaatgacttcaaaggaacaaatgggaaatatgttgcatctttgccttgatgataatgcacttacctgaagatcacagtcctcctgctggctccacccttcacccccttcctttccacagttcacatgttatcacttcagtgtctattaaaaaggaaaaaacccaactgttactaaatatgtatatctacaaggaaatagttcattggattggtaataatatgctctccaactggaaagggattttaaaaagtcaatgcacctggcacaaaattgtaagtaaggaaagaatgaccttaggtgaaaaatgtttgccaaagagtttggcaaaatacaagacatttaattaaaattattttaattctctaagagcatgtgtatgagtagtggcctacttacacatggactataagttgatgcttggaactagtttattcaatcacttattaaatatgttttgagtatttactatggtcaggaactgtatcaggcatggcaataaacaaaacagtccctgtcctcttggagcttacattctagagggggaaagaaataataaacaagtaaaaataaataatatgctaggtgacaatatgtccctgtatgaagaaaaataaaatgagataaagagaatacagagtgacagttggggtggggtttgttatataatgtgctgagagaaggcttctctgataagatgaagaaaaatgtctcaagggaataagggagcaagccacatttggaggaaacataagtgcaaaggtcctgaggtgggaatgaggtgggaacatggtggggacattttaggaatagcaaggagaccaaggcagctggagcacatgagaacagtggagagtggtagatgatgatgccctggagagagctggggacagatcatgtagtgccttatgagttattgtagtgattttgaatatttctgtgaatgagataggaagccattagggtttggagtggaaaagtaacatgaattagcttctgttttaaagggatcttctgcatactatgtggaaaatggaatattagggaaggaggtggtaagagtagaagcagagactcaaggtaagaggctcttgtcataatttaagtaagggataatggcagcttggaccaaggtgaaggtagtgagacatagttggattatggatataatttggaggtggtgctgacaggattgcttatggatttgatgtagggtatgagagggagagaggacttactgaaaatctcaagatttttggctcgagcaactgcaaaacaggagcttccattttccaagttggagacggttgtgcaaggagctaacttggtgggagtatgcagccgaatcaagagttccttttcagacattaagtttgagatgcaaatttatcatctgagtggtgacattgagtatgcagttgatacaagtctggagttcagtggagacacctagactggagacataaatgcagaagtcatcagagtctagaaatttaatgtcatgggatgagtagaatttacctgggcagtgggtgtgtgtaaagaagacgagagctcctgagggctactcccacatttatagataagaaagatgaagaaaaaccaggaaaggagtttgagaaggagtagccattgagataagagaagaataagggtagtattccagaggccaaggaagaaagggctaagagagtaaatgatcaactgtatcaaatgctcctgagtcaagcaaggtgaagactgagatttcaccactggatatgacaactcagagaaaactggtgatgctgtgaagagctgttctggggacggggggcgggggcgggcagtgataagacggctgattagatgtagccaggaagtgcctctcccactgagagaaaacaaaatatgcagtaaatcatcacactttgaacagatcttttgagaaaaaacactgaaagttgataagagaggtgatgcagacaccaagattgaagagggaggaagctgggaagcccacatggagtcactgagcaccacgaccagctcctggtactgaaaaggttctcaggaaggggtgaatgaaggaactctgtggcactacactcccgccacaaacttctgggatcccagctagaaaagatcccatgatccctatagacatttagatgggcaggaggagctgcctgtagagtagacagaggtaaagctagaacctgcatggcgcccagaaggttacactcatgtggggcagctgcagcaaaacaccgtagacgcccacccgcaaaggctctccatcttactctgaatgaccacagccctcactgactgccaacctgagagagagcagagctgcctttcctgcgggactcgggggggcgcatctgatctgcatgctcccagtgtctgctggcccctcccaaggcctcctgcctggctgctcccacaagagggtgtgcaaaacagagccaccactgtcctacctgcgtgttttgctagtggactgggagcagttcagcaccacccccagcacagctggtgcttgacccagaggggtcagaggacaaagccacaggccttgtcccaacttcccagggtgtgagcacaccacccagggatattgagctgagatctgtggccagagcttgagtgagagaggaggcctcactctcagaacacagagaggagtgaggcacaggttcatgtgccagcatgggaactgggtatcccaccctgtgcaagaccagtctgggaagggtgtagcctgttggctagccacagcttctacctgagggagccccatatccctgaacacctggaatcgtgcagcaatctgggtgcagaaggtttaggacaaaactagttgagtgggcctgctcctggggcagacactggagggagatctggtttgggaagagagagctgggcagaccccatagtcctctgctgggataaaagccccaggccacaggtgccacaccagctgcacacccatggcactactgctctgcctggggatcctacgcccttgactcattgcatcaccagaacgcctgcacacatactccatcacctgctctgactctgtcaacctcagagaatgagtgggtctccttgtgacctaacctttggcttgagccgctgctaagacaggtgggagtagagcccgccagggtccctactggggtgaggaaacacaggtgcaatgtcagtcattgtaggaggctccctcaaaacccaggagtggacttagtaagggagtcatctcttgtgctcctccccccttccctcaccatccctccctgcccggagcactgctgtgcacacactgaagtacaaaaaaggtacataactaagagcctatctgctggcccttactcttaagcactgtctactggattgcagcctgaattatacaaaaataagttccttcagcacccaacacctgtgaaactcaatacaggaaattagctacaaccaaggaacccatacagagcactggccctctgaaagcaccagaaacgaagccaattgactgtatacagcatacaccacagtcaaaccctgaagggaaaaaaaaacccagaaccccattcaagcaacagcaaagtcaaaaagaaaaacaccaggccccctgagatgagaagcaatcagccaaagagctccggcaattcaagaaatcagagtgtttccttacctataaagtattgtactagctccgcagcaatagatcctcaccaaattgaaatgtctgaaatgacagacatagaattaggaatctggatggcaaggaggctcaagattcgagagaaagttgaaattcaatccaagaaagccagttgttgatacaagagttggaagatgacatagccagtttaagaaataatcaaactgaacttctggaattgaaaaattcactacaggaatttcaaaatacagtggaagcctgaacaacagattagaccaagctgagaatttcagagcttgaagactagccgtttgaatcaacccagttagacaaaaataaagaaaaatgacttaaaaaaatgaacaaagcctttgagaaatagattctctaaagagaccaaacctatgactcattggcattcctgtgagagaaggagagagagttagcaatttggctaacatatttgaggatatagtccacaaaaatttccccaatttcacaagaaaggttaatatgcaaattcaaaaaattcagacaacccctgtgagatactatataagatagctatccctaagatgcatagtaatcagacttttcaaggtcagtgtgaaagaaaaatcttaaaggcagcttaagaaaagaatcagaccacttacaaagggaaccccattatgctaacagtggacttctcaacagatatcttacaagccagaagagaatgggggcatattttcaccatttttcaaagaaaagaaattctaaccaagaatttcatataccaccaaatcaagattcataagcaaaggagaaataaatttttttccaggtaggtaatcatgaaggaaattgatttccactagcctgctaccacaaaaatactgttaaggacatagcccacagactctataaagcaactacacaattgagactacaaagcaaccatattggctggttgttattagcaaccagctaataacatcatgacaggatcaaaacctcacataacaatattaaccttgaatgttaatggtctaaatgccccacttaaaaggcacagagtggcaagttgaataataaaacaagacccaactgtctgctgacttcaagagacctatctcccctgtaatggcacccatagactcaaagtaaagaaatgaacagctatcatgcaaatgaaaaataaaaaagagcaggggtcatcgttcttatattagataaaacagactttaaaccaagaatagtaaaaaaggacaaagaaggacattacataatgataaaagattcaattcctcagaaataattaactatcctaaatatatatgcactcaatgttggagcaccaagatttataaaacaagtacttctaaatgtatgaaaagacttagacacaataatagcgggggacttcaacaccccactgacagtgttagatcatcaaggcaaaaaactaagaaattctggacttaaatttgacacttgaccaattggacctaatagatgtctacagaatattccaccccacaatcacagaatatacattcttctcatctccatacagaacatactctgatcaactgcattctcagctgtaagacaagtctcgataaattcaaaaaaattgaaataataccaaccatactcttggaccacagtggaataaaaattgaaatcaataccaagaagatctctcaaaaccacacaattgcatggaaactaaacaacttgctcctgaatgacttttgggtaaataacaaaattaaggcagaaatcaaaaaattatttaaaataaatggtaacagagatgcaacataccaaaatttctgggatgcagcaaaaccagcgttaagagggaagtttatagtgctaaacacctatgtcaagaagttagaaaaatctcgaattaacaatctaacatcacacctagagaactagaaaaacaagaacgaaccccagagctagcagaagataagaaataactaagagcagaacagaacaaaatagaggctccaaaatacaaaggatcaatgaaaccaaacgttggttatttgaaaagataaacaagatcaatagaccactgactaagttaaaggaaagagagaagactcaaataaacacaatcagaagtgacagaggtaacattacaaccaatcccacagaaataccaaaggtcttcagaaacttatgaacaccttcatgaacacaaactagaaaatctagaggaaatggataaattcctggaaatgtacaacctcccaaaattgaatcagaaattaattgaaaccctaaacagatcaataacaagttctgaaattgaatcactatttaaaaattttaaaaacctggcaacctaaaaagctatggactagatggattcccagctgaattctaccagacagacaaagagctggtaccaatcctactgaaattatccacaaaagtcaaggaggacagactcctccctaacttattctatgaagccagcatcattctgataccaatgagacagtgaaaaaagaaaacgtcaggccagtatccctgatgaatatagatacaaaaatcctcaacaaaatactggcaaactgaatctggcagaacatcagaaagttaattcattacaatcaggtaggctttcttcctgagatgcaaggtgggttcaacatatgcaaatcaataaatgtgattcaccacataaacagaattaaaagaaaaaatcatatgatcatctcaatagatatagaaaaagcttctgataaaatccgatattcagttaagacaaaaatcctcaaaaaactaggcatcaaaggaacatcctgaaaataatgagtcatctatgacaaacccacagccaacatgatactgaatgggaaaaagctggaagcatttcccttaagaactggaacaagacaatgatgcccacgttcactacttctatatgtcatagtattggaagttctagccagagcagtcagaggagaaaacgaaataaaaggcatccatataggaaaagcaaaagacaaattatctctcttcactgatgatatgatttgatacctagaaaaccttaaaccttaaagactccacctaaaaggctcctagaactgataaacgacttcagtaaagcttcaggatacaaaattatcgtacaaaaatcagtagtatttctatacaccagtcttgttcaaactgagagccaaatcaagaacactgtccaatttacaatacacacacacaacctaggaattcatctaaccaaggaggtgaaagatctctacgaggataactaaaaatgaaacactgctgaaagaaatcatagatgacacaaacaaatggaaaaacattccatgctcatggactggaaaaatcagtgttgttaaaaaggccattctgtcccttagcaatctatagattcaacactattcctatgaaactaccgatgtcatttttcatagaattataaaaaactattctaacatttatatggaacaaaaaaagagcccaaatagctgaagcaatcctaagcaaaaagaacacagccagaggcatcacgtcactcaacttcaaactatactgcaaggttacagtagccaaaaagcatggtactggtataaaaacagtcacatacaccaatggaacagaatagattacccagaaataaagccactataaccatctaatcttcaacaaagtcaacacaaataagcaatggggaaaggactcccttttcaataaatcgtgcttggataactggctatccttttgcagaagaatgaagctagactcctacctattaccatatacaaaaattaactcaggatggattaaaaacttaggacctaaaactataaaaatccaactggaagcctaggaaatgctattatggacattggccttggcaaagaatttatgacaaagtcctcaaaagtagttgcaatgaaaacacaaatagacaagtgggacataattaaacacaaattgataagtgggacacattaagcttttgcatagcaaaataaaatatcaataaatggataacttacagaatgggagaatatattcaccaactatgcatccacaaaggtcaaatatccagaatgtgtaaggaacttaaataatctaacaagcaaaaaacatataacccccttaaaaagtgggcaaaggacatgaagagatagatacatctcagaagaagacacacaagcagccaacaaacatgaaaaaaaaaaagctcaacaccactaatcatcagacaaatgcaaatcaaaacaacaatgaaatatctcacattagtcagaatggctattattaaaaagtcaaaaaataacatgttggtgaggctgcagagaaaagggaatgctcatacactattgatgggaatgtaaattagttaagcagtggaaagcagttttgagatttctcaaagaactaaaagaagaacgaccattcaacccagcaatcccattactgggtatatgcccaaaggaaaagaaatcattctaccaaaaagacacatgtgcatgtatgttaattgcagcaccattcacaatagcaaagacataggtgcccatcagtggtggattggataaagaaaatgtggtacatatatatcatggaatactatgcagccataaaaagggataaaatcatgttctttgcagcagcatggatgcagctggatgctattatcctaagtgaattagtgcagaaacagaaaactaaatgccatatgttatcacttaaaagtggcagctaaacattgggtacacacagacataaagattggaacagtagacactggggactactggagttgggagaggagaagaagggttgaaaaaccacctattgggtactgtgctcactacttgggtgatgggaccaattgtatcccaaactgaagcatcacacactatacttatgtaacaagcctgcacattcactctgtcaatctaacatgaaagttgacattttctaaaaaaagaattcagttgagaaaaagagctgttttgatggagctatggggataaaaaccaaattggaatgggacctggggtgctggcaatagcctatttcttgactctagtgggtaattatactagtgttgggttatgtgtgatatatttcatagtaagaagagaggggaaacaaaaacagtcatttgagatagtgagcatagacactcttatgagaagtatgctttaaagtgatgcagaaaaatgggatggtacctggagaggaaaataaaggatacattttttcttttctttcgtttctttttgtttttgtttttgttttgagacggagtttcacccttgttgcccaggctggagtgcaatgacacgatcttggctcaccgcaaactccgccttccgggttcaagcaattctcctgcctcagcctcccaagtagctgggattacaggcatgcaccaccacgcccagctaattttgtattttttagtagagacggggtttctccatgttggtcaggctggtctcaaactcctggcctcaagggatcccacccgcctcagcctcccaaagtgctgggattacagatgtgagctaccacgcccagccaagaatacattttttcaagactagcctaggcaacatagctagaccctgtctctaccaaaaaacaaaacaaaacaaaacaaaacctggacatggtggcgagcacctgttgtcttagctacttgggaggctaaggagggagaattgatcccgtcaccagattgaggctgcagtgagctatgattttgccactgcattctagcctgggcaacagagtgagtttcaatggtcatcagtacatgtgtgttttaagtagggagactgccagtacacatgcataatcccatgatatgtgtgctaagtggccacatataatgtgatctttcatcatgaagtgtacacagtataaaaagttttaggggaaaatgcctggttgtggcatgatgctatgtttagcattgtttcgcattgtttcatgctatataggatgatttgatcctgtcagcatttaatctgcatctttttggctgatggtacaaatgtctaagaatgacatagattaggcaggcttaatcaaagttcaaatatataaatgttcaggaagattggaaatagaatataggatagcatcaatagaagatatgtatgtgtgtatatatatgtgtgtgtatatatatgcatctccaatgtaagaaggactactcaaagctggggagatgtagtgatcagtcaggcagagcttctgcccttgagagttcgcagtctgtttgaaactccatattgtgactaagtgtacacatcagacagaatggaatgaaggtataaagaaagggctctggaaatgtaaaggggaaaatgattaattttgaccaaggagatccagggaggccttgtacctcatttaagctgaacctacaaggggcagaattttcaaaaggatggggattggggccaaagtgatccttcagaacgttagtgagaacattagcaaaggaatagctgtgcaaaagtgggtccaggtctggagttgctggggtgagagacggggctagatggttaccttgagaacagaatgctgagcatcttggtagccatgcagagccattgggtgggactctggggaactggaagccatcagctgctttgagaacagtgacaagaaatttacttgtgttttagaaagatccttctagagacagtaaggatgagttggggaaaataggagggaggaggcaaggtgaaatgtgaggagcctgtaacaagcttgtaacaagcaaatcagcacagggcagaggatgggacaatgaagtaagagttggccatgtggagttggtgactggttgtgtgacaggttctgagggccaggaagaaatcaaagctgatccttgtccacgtttgggtagatatgcgtccatggacaatgtgtggaagccaccctctaaatctgggggtcccagtcagaaccctgggcctgtgctcttccctgttcaggttgctactctagcatcatctttgctcactcctttgtgtatttagggccatttgtgtatttggttatctctctcccaggatgtaagagcctttgaagtctaggactataaatttctgaatttttgtatctgtcgtagcacctagcaccacatttaatgcatacttaatctactcaaaatgcttttaaatttaaaattaaaacatgattttgacgttaccaatgatcatttgatcattgcatcattaaatgacttgaaggataaattggtttggtaggaattaggagatggtaaaaaattggagcgactaagcagcaggagatcttagaaccagactttggttatttattgctgtgtaacaaacaaccctaacacttagcagcttaaataacaatttgtggtttatcatgagttggtaggttagaaatgcaggcagggcttggctagacggtttttctcctccgcatagtgagtgtcaattggaggcatcaacttggctgctacattcagcaggcaattgggctgggttggaaggtcttagaagtcttcatttgaagggctggcctgcccctccacacctgtgggtgtttcttgtcaggtgggatgacagactgagaaaagaaagagacacagaggcaaagtatagagaaagaaaagtgggcccaggggaccggcaccggcaccagtctctgaattccctcagtatttattgatcgttatctctaccatctcggagagggggatgtggcaggacaatagggtaatagtggggagagggtcagcaggaaaacatgtgaacatatgtctctgtgtcataaacaaggttaagaaaaggtgctgtgctttgatgtgcacatacataaacatctcagtgcattaaagagcagtatttctgccagcatgtctcacctccagccttaaggtgattttctcctatctcagtaaatagaacatacaatcgggttttacaccgagacattccattgctcaggaacaagtaggagacagatgccttcctcttatctcaactgcaaagaggccttcctcttatctcaactgcaaagaggccttcctcttttactaatcctcctcagcacagaccctttaccggtatctcgggctgggggacggtcaggtctttcccttcccgtgaggccatatctcaggctatcacatgtgggggaaaccttggacaatacctggctttcctaggcagagatccctgtggccttcctgttgtgtccctgggtacttgagattagagagtggtgatgacttttaacaagcatactgccttcaagcacttgtttaacaaagcacatcctgcatagccctaaatccattaaaccttgagtcaacacagcacatgtctctgcgagcacagggctggggctagggttagagaatttttcttagtacagaacaaaatggagtctcttatgtctacttctgtctacatagacacagtaacagtctgatctctctttcttttccccacattcgtttaaatgccccagtgctctgttacatggcctcctttctttacctggctttttcacagtatggtggtctcagggtagttggatttcctatgtggcagtcatcatccaagagggtcctctcccagtacaggaaagcagagctgcagatcttgtaaggctcagtcttggaagttacacccatcacttttgccacattctactggtcaggacaaatcacagggccagcccggttttaaggagaggactacacttcttcaaaggaggagggacaaagaatttacagtcatccttaatccaccatgcagacattcaatctgccacgtgctggttgtgtgatttcggatgagttatgtgaactcttctagctgacataatatcagtgttattgggtgctatgagggaaagagatggtatggcaaaataccctgatatatagtagttgctcaataaataatagctactattattactactgtcttatgctcttaaaggataaatacaatgaaaattggaaagaggatatttgttggatttgacatttgagagactttgggtgatggcttagttttggaggatggcagtagcaaggtaaggagcaaaagctagtggcaaaagttaagttgtaagtggatttgagggtagtgagtgcagcttgtcagtgaaaagggaaatcctgctgtcatgtgggaaaatcaggttaagccaaaggggcaagtggagaggtagaaaatgaagatatgtgagaggagataattgttgagggcagagttttaaaaagccttttaaagattttacagaattcatatttagaatgctgtgattataagccagaaagctgttggggctggctttcataatggcaccccatctctttactgaaactgttcttacctcctgacagagggttgtcttgccctcacctcccaaagtcttcctctagttggagacagacttttaaagaatatgtagctcctctagatttttaagtcttggccttaatttcagagctccatgaattcttagcttataaattacatagctggaggttccaaactctgaaaaggtttatgcatttcagaaaggttctaaaagaaagcactcttttatataacttggaaagtaattgtgataaaaacctacattatatgtgaatttgagagtaattatagcatggctggggccagaatcaactaatcagagttattaggaacactgccaggtacccaattcccatgccaagatttgagtgatacagagacagggcacaggcaaggtcaggctaggtcagggcatgtggcaggcatgggccaagacacaaagttgttgtcaggtcagagggatatcaaaaccaggagcatcaagataggcagagataatggaagtaaaggactgttagtccctggttgcattacagtccaggtaataccagattttattgcttgaagaaaatttgtggtcctactgagagtctccttttaccttccagtcctgtacttttttctccttttctctagttatgtgtacatccctctatttcttggctcattctaaaaagtatttaaaaccatttacaaaagcacagagtatgcaacaagatgaaaacacatgacagaggaattttgtatgaatacaacataaaataaagtagaaaaaaataggaaaaagaagattaagccaaggggaggctggtaaacaaaatgcataccatacttttctgttcacttgtggatggcacacttacttctgagctccctagctgtcaaggcaaaaaggaaaatatagtcagttacactatttacagtattcagagaattaaacacaagcagaatactcaggatgggtaatcataattatgatttttatggtaaatccaataataatttttcagtgtagattgacataatgattataaagaaaaattcagtcaaaattaataaaacaatgcagcctcatgtatatagctccctggtggcttggcctaatacaagattaatttttggattttttagagtaatggattgagtgcctaccttgcccataaaactaaacagttctaaactcaacaaaacattaatttttaaactagctgtatgtcatttcttggtgtgctaagttaaacaaatgcatttctaggtaactgatcaaggtagtttgttgctggttatgggctaattacatttttgtaggatatctactagaaattataactctggttttagaatattcttaaggtcattctttcaatggctgatctatttcttaacagtttttgtcaaagagtcctgtgctttgcatatagaaatgtgcttattatgcttttttctgtcaagcagagaagtacaaggactctgacacaaatgagagaaggaagttccaggttcttatgtaagtgtcacaatacctaggggtctatagtgagttcatacctcttagttcacgacagattctcatctgtggggtcaaaagtttattgaaagtcaataaaagctgtaaacagccccatgtcatttctaataggtttcttctgatggcaatagagtgaaacagtggataatggaggaatgacaacacttggcatcctctgcccctcttagggaatatcagctgaaaatgaccaaacttgcagttttccagaagggaaactggtatatagattttattgttttgaaaaccttaaaaaagtttacaggtaattagaatacataaataagccaaatgaaggaaacaaaccccactatctgattaacatcttgatacacattttctcagacatttttctagagatatatttctgtattagagccaggaaagctagctagacatcttcctgttctcagtggctcaacagatgaaagtttattttttgttcacagaaaactcaaacagcagctgggggtagggtgggaattgggttctgcacctcacagtctttggggaacccagcctgacagaggctctgccatatttaacaagcagacccatcatcttgtagggccccttagtcctctgctggatgctcagcattgggttggcagacacaggtagaaagaatatggaggactgcacaagagtggcttccattccttatgcccacattccattggccaatacttagtcacatggtcatacctaattataaggctgggaatataatctagttttgtgtgcagaaggaaagagaattggtttggcagactagttggtttctgctactcacacataatgtattattcttccataaaaatagaattatgctgtatatacagttttgtatctgtttttaccatagagacaagataaatatcattattcacccaagatgtgggggtaagttcccttagctggtcttgagctctgtagtgttattcattccaaaggctcatgtcaactggtcaagacaatttccacttttcctgtcatgaacagttagtttatcttgtagaaactttcttcctcttgatatctgataggaacaaaattgcaaatatagtaatctgtggtaatatttattttcgaggacatagatgatggaatttgaagaattggcctggagacccagagtaagatattagtgttcagaaaatctggcatttgggcacatagttgtgaaagagcttagggttggacagaatccatgttgtagggaaaaaatggataaagaaactgtagaaagtccaggtgtggtggctcatgcctgtaatcccagcactttgggaggccgaggcgggtggattacctgaggtcaggagttcgagaccagcctggcgaacatggtgaaaccccgtctctactaaaaatacaaaaaaattatctgagtgtggtggcaggcacctgtaatcccagctacttgggaggctgaggcaggagaatcacttgaacccgggaggcagagtttgcagtaaaagaaagaaactaaaggaatggagtggcctttatgcatcacacctggatgacaaaggatatataaaagagaatttggaagtgatttctggagaaaagggcaaactccactaaagtaggatcctgttgactgtgatgaaaacaagccataatgggtgagaaaatggcagaatgattagacctagcaaaggggccaaggtagtgtgggcagaataaaagatgaactaaaaagaaggaatggtttgacctagagaatccaattgtaaaatctataggccagagtgatttaaagaaagaatactagtgaaaactggtcaaaatattaaatcttgaataatatagctttatgtgcataagactatgtgcttttctagatagtcatttattcacttcattgaacatttttgcctacatatacctctactacaaacttgggggctagaagggatgaggaaataaactttaaaatgcaagtcatatttactgccctttagtcctatagttgtctagttggaaaaacacataaaactgataaataatgtgataaataaaggggtaccaaattagcaacacacagatggaaagaaaatatttacaacacatataacagataaaaattaatatacataatatataaataacttcttcaaataagaaaaagattggccacacgaaaagaagacaaaggatagaaattagcattccacagaagaaaaatacaaatggccattcaaaacatgaaaaagaacttaacctggtcaaaccactatacatataaatcaagaaaatgtgaaataaaacaatgggacattgcatgattcaggtaagaaaagtgcgtgataggtgcacttctgtttcctgaatccagctcattgtagggattgaggtggggcagttctgcccgagtgacggtaagatgccagctgtgaatctgcttttgctcaggtggttgtacaccttacaggctgcctcttaatctaaggggttcctgccatacagagtgtgagcccggcatttaaagatatgtacttttcatatgacaatgcccccaaacattttaaacattttttcctaggctccagaggtagcctaggaaaacaatctgactgggttctccatatttggagtgagtgtattggtcaccaaagtggcatatttctaaaagaccttcaaaggaaattttgactatacaatatgtggttctcaccttaccacttcagaacctaaatccctcctttcccaatggcatgtgattttatgcttccattttttttccccacctatcagagtagcaaaactgggaaagactgataataagtgttggtaagaatgtggggaaacaagcactagcactttcaatggaagtattgatagaggcttttagaggacaatttggcactatcaaaatttgaataaaaatacacttggcacacttggcttttaagaatccatctataggcatgccacgtaagttcattgaggtaatataccagaatgttcattgcagcattttctcttaatattaggaaaaactaaccaaaagtagggaaatggccaaacaattaggatatataaattctgtggaataaaatgcatctgttaaaaagaatgtggtagagctgtatgtcctgacatgcaaagatttcaaaaccagaggtcctcaaactttagtgtgcatcagagtcatctgcaagccttattaaaacacagattgctgggcttcccagagtttctgattcagtaggttcggtgaggagcagggcaggaataatttgtatttctaaacaagtattaggagataacgatgctgctggtctggggtccacatgttgagaacaactgttccaaaacagtgttaaaggaaaaatatcaagttgcagattattatgcacaatatagtcctagttataataaatctttgcatatttgaatggtcataaactcatggaagaaggctccaaggatatacatcaaatggttaacagtgctttcctctgaggaggggagttattttactttttctatgctactgtattatttaaatattttacactgaggatatatttatatattacttgtgttaaaaagggaaattacaaaaactaacaggaagagtgcaaacccattctgctccaccctcagaactagtaagtgtgctccgtagttgtaagaaaaatagtactagagtttggatgagaaagactgatcgtgataggatgtatcctgaatcaagaaccagagattttaaaaaatgatagggtttagaacaatagaattcaaagctttactttgaatttgctcatctctcagactctggacgcagctggcttagatctgatgtatttgtttacttttctctgagcctgttctgtcagattttggattagatttttctagtccttggctttgacttcatgttgtttaaaacagtagtatccaccaacatgcacagtttagtctcctgtccttgctgccctgccctgtatagaagccctccattgcctgacagtcactgctagagccattttctatgtttcctccaacgtggcaaggctgttggaatggtagtttaggagaggacgtagcagggtttgagagggttggaggtgtgaccccagggaagaagagtactcaacaagggagctacaaccgatggctagccattgcatgaacttaaacatttggcccttttcactgtgtgtttcataagccttttgtagttgaatttggatggtaaatatgagataaaggaagaaaagtattttattccaacaaccactacagccagttccacatccatggagttgggtaacacttcaccgtttataagcatatccacatttattatctaagttaattctcagaccttgaaaggcagttatatttatttgccagatatagaaattggagccggtaaagattgctactaagtagcaactttggaagtcacatgcaggttttgtaacctggtttccaggggttcagaaatgagaaagacttcttcctttccccttcaggtattattttagtatttgttaatggagtaaagaaatgggtggggcacagggaatgttaaagtggtgaacatttagcctttaactggaaagcagcataatcttaaaataaatgttattttgtttttaaataatacacacatttccttcaacaaaatggaatcttataggtagctcatacatctcttgaataggggcctctggtgcctacagatataaataaatcacactgagagaatggtgaaccatgaaatgactctgttaacatgtcatctgtctagaatatattttcaactctccaacagaagtgtctcaattatgaagggaggtggcctaccaaagttgatactttgatatttgatgcttttaacctcctccatcagctgcctttgcctaagtgtggaatctggcccagtgcatagagtacaacgtggcctaatggctgagagtcattgtaactggtgattttaacatgcaatgaactctgaagctcctcaaactgtgctatcttgtgaaggcatgtatcagtgctacttgtctggtcttattaaggaattctgaaaattgctaattgttataataagaattttaaccacaaacaagccaaatttactgaattcttcctttatgcccagcactgactgatactatagtgggcttcggaaatgttcccaaaatgacttttgtttttaagttactctgaatgtagtctcagaatttgaggtggggactagtaggttttagtggcctatttgtattcaggtttcagtatataataatgtgaaaatagctctttgtatctagtaaacttgcagatgccagctgactggtgagggactgttatatttctacatttcatcttactgcttctaacccagtgatgtccctctttctaaatagtgacagaagggaaacttttttttttttttaacttggcccatggaaatgggctattccaatggttctcaaagcttggtctctgaaccgatagcatcggcatcacttgggaacatgttagaaatgcaaattcacaggccctagcctagactgactgaatcagaaactgggagtggggaccagtgatctgtgttttaacaagccctgtgggtgcttctgaggctcactcaaacttgagaatcctgggatggctcctttccaacccttctgttactgccttggtgtaaccctcatcagtctggaccactggagcagtccccagctggtctccctacttccagagttaacctgtccaatccattccccacatcagttggcctttgatttttgtctcatcaccagtggaatactcaacactctaaagggagcccaagttttcctccttcagtttactcacccacaaggagtagaccaaggcaatgaatgcagtagaccacagtagtgacagggcaggtagaggtgggagtggtaactaccatggtttgagagtgtctcccaaaaaccatgtgttgagaacttaatcccccgtgtcaacagtgttgggaggtggggcataatgagaggtgactggaccatgagggtggagtgactgtattaatgctattattgtaagagtgagttcttcataaaaggacaagtttggcccttttctgtttttcttttgccctttctttgcccctttgccatgggacgatgtagcaagatccttaagccttcagttttgtacgtctcaatcttgtacatctcataatactattctggtataatgaacagaaaatgtattagcttgtggataccaatgtctggattctgttacagcagcacaaaacagactaagatagtaaccattatgggaaggagtattgggtcaattgctctttctcctttttcttttagatgggttggggtggggtagtgtatatgtgtttcccttaggatcagctgtatttgccatttgagacttaagatcaagagggccaagattcaaaagtggatctccaggaagaatccaaagagactactcagcccggagccaaggccaaaaggatgctctgagcaatctatagtctggcccatctcacccagtgaccatgtgggggtttgaggtccaagcctcaactgataattaaaagtgatttagcctggagcaacccacctgcatttctgtcttgggaactggaggcgaaactagggatctcagaatgctgagaccctgggtccttgctgtatattatcccaataagtctagaatcctcctcttgcctcacacccctggatggcccacagctgcccaaaggatgaagttcaaatctcttgttacagcctagaaggtctttcaaactctagttcctgcttattttctcttgagtctgcctaaagaatcctgctctccagccgtatcaaattaagtctctgaagaagacatagtctttcatcgttctttatgtttaacacatactgtatcatctgcctgggatgctcatttcttccttcctctcacgtacttcatcttccatattccccttggacctgccactatctacatggtgaccatccttcaaaactcagctcatatgtcacttcctcggtgaaaccttcctcaaacccgtcaagcaggattggactcgtgtaattatcacataaagttggtctaatacatatttttttgtgacaattgctttattcctggaataagacattttcaggctcaaaaggaccgcaattccctagcccctggctattaatgagaggcctggagaccccactttaaatggcagtgggggggcacctggggaagccatagatgtggagctgggccaatcagatttcctttcttggaaattttaactgagacatagagagtcatttaatcggtgatgtgtgtatgagctgaaaagttggaaagagtttgggctggtctggccatattagacatatatcagatgcataggcaaagcaaactacgagagagagagagagagagatcaagactgagagagagaccaagatggctttagacagagggagggagagagaatgagagagagagagagacactgagagagagaaagacagagaccaagctgacgttagacgtaggtgagacaataatatccagggattaatccaaatttccagccttttttcttttctcttcctagcttttttacttgaggcctgtctgaatgtaattttgggttctcagattcattggaatgctttatccctttgcatccttaaataaaactcctttaactcaagctttttgaagcaggtttcttttcagtgcaaccgggaaagctttgattagcacaaggattctactcactgtgttctcagttccacatagcaaagtggctacttttagtaggctcggtaaatattggatgagtgaactaacagtaggcactaaagatgctgcagggcacccagaaaattattctgtagagtcaaaacctgaaaggcatagggttgtgtgaggaagagagggaactgactacagaggcatgaagctactatttggagtgatggaaatgttctatatcttgattctagtgataattccatgactctatgtgcttatcaaaatgcacagaactctacattgaaaaaggtgacttttactgtatgtaaattttaacttaataaacttaacctaataaagaagcaataaaaaagaaaaaaacgcaaagtaaaataatattttctctacaacacattaatttcctaatcaaaaatctttaactttttttgcatcattttacccaattctttttcttttttcctgggaccataggatccagataatagaaatgttgattatgggacatgatattgctttttgacttgcttgacattattcaaaaatgttgccaaaatagaaagtactatttctctactttccagttctgagtactgataaaagcaaaatattatgttcagaaagaaataagcccgtatttctgagctccagcttctgctaggtccccatttaatgttgttgcctaactactaactatttgatttgaaagctttaaacaatattgattatactctcctgagcaggcatctctcagacttaaacattgcttcataggatatttaaacacgccaattgaaaacaataataacaatgacaatttatgaaggttgcattcccaaatgtatttgagaaattctagtttaagaaaagtgaacatgtttctttatttcaagacttcccgatgtcttagaatagtcagacatcaaatttcatccacagtttccagagttgctatttctttcccatacctttgctttggaacttgatctaatggaattgttactgttactatgacatttttcatgtgtactatgtcctaaaaacactgtggttgcattcattttattttatttttgagagatgaatctagggcctcttgaactttttattcgtagttatgctgagtactagcttactttaaaaataagtctccagtacttgtgaggaagactcattgtcagagcatgaaagatttttctgccttttgttttgacttctaagatacgtttctttattaaggaatagttttatgctttgcagaagatgcattgtaccataaaaaccagtaaaatctgtgcattaaaaaaaatacctggatttaaaccagttacttggcattctgtgaaggtaaaggaatacatttttaccttaaatgatagtgtttatattttgttcacacagaaaaaaacaaaataaaaacaagcaactcttagtgattctgcatatagttatagtggttgtggacctttaaatattctccatcagttatgttttttaaaagcagaattttgtaaactttactaaattcaagctgctctcctgtctgcgatggctgaggacattggaagaatacttctgtacttttccatgacagccagtgtcacctcctggaagcaatcattcgtagattacttataaattttactcctagaatagcaatggtcactttagacaaatgaaatcatgcaaagagctggtatcaatttcccacctatacccactttcacccaagtcaggagggggcaatgtggaacttggtgtgggtccaagtcctaagtgaattattcctagtatagcccgttgaaatggcaaataaatggccacttagagaatgtttgagtgaaacaaattggtcgtctgttatttttaggctacttattcataaaatccaagctatattatctctggcctcatgatgctctaaataattttctgttgtagaacccatatgcttatggttatccaagagcttctaaaatctactttggtaagatgaggaaatattttatatagtatacaaaccctgtattttatatagcatacaaaccctgtagcctaaccgtcctgccatcttaattgtacagtttgctgctataattattaatagattgtaaattaggaacatctggccaattattagaaacacaaaaataaatcatgaaattgatatgagagcctaaagtgatgaccatcaaaaaggcaggcaggaatattttgtatttggtccttcacaggtaaataatttaatgcctgcctaatataatcagttacctttcttgtaaatttaattctttgatctccatttccttttgtagcagcaatttccaacataaatttcagcagcagaaaaagaatcaggaccctataatataaagcaactgtttttttgctttataatgtatttatgtggatcatcattctcatttctggtttctatatagtctaaaaggcaaggatagttcccctccccaagatatgggccattttatggattatataataaatgggctctaaaggtaaattgttattattcaaaaccagctggtcaggcaggcaaggcagcttagatacagtgaattctgttttgctctagtggaaaatgtcatgctgacaaggtcagtgctgggaactggtgtcatccagaagcaggcatgcagcacctggggaaggctgagaaggaggcccctgctctgtttgctgttggtcaaatgagtgccagaaatgcagggcttcagcagcacctagaagtccaggtttagcagtaggtttgggggctcacataatctgtactagtgattgttattgttaatcacataattactagtgtgttgttagagcatattgtgctttaaataggatttcccaagaaactaaaacgtcatggtgtttttcactgaccacagctgtcttgtggcaatctcttgagcagtcaacatctatggctggcgcaataagtcattaaatcaaaatacatcaattactggttttcaaagagagtcttgatttctgcataatgtgacttacataagggtaactgtattgttgctgagtgtgattgcacaaagaactcactgggcactgctttaacaaatgaaagcaggtcagagggaaatgtatcctttataaatggcttcatctattcattcaatttaggaaaccatttcttttaggctggtaatttaaggatagcactgctgaggactaggaatttgtttttacctgtactatttcatctgattataaaagtaatatatgccgaccaaaaaaaaaaattacacaaataaatgtcttacagagaatgcaatctgttgaaatcctacccctcagtaccactgtcaccagtttgctgcacatctttcagatattttccatgtaaaatacatacatatgcatttctgcaattcgcttttcccctgtagcatttaaggggatatgtattttagaaggacattttctgatatatctgaatattcctgatagaaattaacttttctatatatcagcttttaaaaattatgtgtgtgcctggaataggttaagatagagacattttcaatgcctgtttattgctgtaatattcaaaatccctgagagactgtggatagtttattagacagaattagaaagaataactgcagtactaagctttttgctacagagtgggcttccagtgcacaaagcattatgattatttggagacaatctgtagccttggaaacaatatggcgatagtgacatcagtagcaattatgtgtaatttttatccccagtttatcaccaaggtaaccagagcaggtctccctgcttgaaattttaagaatgtcgtagtcttatatacagcaaggatgtaggaaaggattatattcagaattctttctacagttcattctatttcccttataaaagagctctttagaattctaatagcacacatctatttttggcaacagccgcaagtttttgaagctattaaatataattccaaatattgtagatactaaaaagagttcattctagtgcataaattttttctttttactgatacagaatatttgtgcatatattgatgttcatgtgatgttttatgcatagaatgtctagtgatcaagtcaaggtatttaggatatctgccctcatgtgccttataattttatgtgttgagaacattcgagtcctcatttctagctattttgaaatgtacaataaattgtcactaaatttagtaaccctactccactaccaaacatcagaacttatcccttttacctaactgtatgtttctacccattaaccaacctctcttccttatccccctaacccccgccacatatacccacattcttcccagcctctgataactattcttctactctctaccttcatgaattcaatttttttagttcccacattggaatgagtacatgcgatatttgtctttcagtttgtaggttattttatttaatgtaatgaccttcagttacatccttgctactgcaagtgacaggattttattctttttttatggcagaataatattccattgtgtaattccattgggtaaatatatcacatattctttattcattcatctgttgacagacattgaggttgattttttatctttgctattgtgaatagaaacatgggggtgcatgtatcccttttatatattgattccctttcctttgggtaaatactcagcagtgggattgctggattgtacagtagttctatttttaggttttctgagaaatctctttactattttccctaatggctgttctaatttacattcccatcaatagtgtatgaaagttcccttttatctgcgtccttgccagcacatttgttattttttgtctttttgataatagctattctaattggggtaagaagtgatctcattgtggttttgatttgcatttccctgataattagtgatgttgagcattttttcatattaccccttggtatgtctttttttgagaaatgtctgtctttatcctttgtccacttaaaaaaaaaaacttttaggttcaggggtacatgtgaaggtttgttacataggtaaacttgtgtcatgggggtttgttgtacagatttatctcatcacccaggtattaagcccagtacccaatagttatcttttctgcttctctccctcctcccaccctccaccctcaagtaggcctcagtgtctgttgttttattctttgtgttcataagttcttatcatttagttcccactttataagcgagaacatgcagtatttggtttcctgttcctgtgttagtttgctagaataatggcctccagctccatccatgttcctgcaaaagacatgatctcattactttttatggctgtatagtattccgtggtgtatatataccatgttttctttatccagtctaccactgatggacagttaggttgattccatgtctttgctattgtgaatagagctgcagtaaacatttgtgtgcatatgtctttatggtagaatgatttatattcctttgggtatatatccagtaatggattgttgggttgaatggtagttctgcttttagctatttaaggaataaccatactgctttccacaatcactgaaataatttacactcccaccaacagtgtataagtgttttgttttctccacaaccttgccagcatctgttatttgactttttaataatagacattctgactggtgagagatggtatcacattgtggttttgatttgcatttctttaatgatcagtgatgttgagctttttttcatatgattattggctgcacatatgtcttattttgaaaagtgtctgtttatgtcctttgtccactttttagtggggttgtttttttttctcttataaatttgtttaaatttcttatagatgctacatattgaccttggttaaatgtgtagtttgcaaatattttctcccattctctaggttgtatgcttactctgctgatagtttcttttgccgtgcggaagctcttaagtttaattagatcccacttgtcaatttttgcttttgtggcaattttgccatgaaatttttgccatgaaattttgtcatgaaatttttgcttgtttctgtgtccaggatggtgttgcctaggttgtcttctggggtttttatagttgggtttttacatttaagtctgtaatctatcttgaattgaattttgtatatggtgtaaggaaggggtccagcttcagtcttctgcatttggctaatcagttatcccagcaccatttattgaatagggaatcttttccccattgcttggttttgtcggctttgtcaaagatcagatggtcataggtgtgcggccttatttctgggctctccattctgttccattggtctgtgtacctgtttttgtatcagtactatgctgttttggttactgtagccctgtagtatagtttaaagtttagtaatatgatgcctccagttttgttctttttgcttaggagtgccttggctatttgggctcttttttagtaccatatgaatttttaaatactttttcctagttccgtgaagaatgtcatttgtaatttgataggaatagcattgattatataaattgctttgagcagtatggccattttaatcatattgattctttctatccatgagcatgggatgtttttccatttatttgtgtcttctctgatttctttgagcagtgttttgtaattctcactgtagagatctttcacttccctggttaactgtattcccaggtattttattctttttgtggcaattgtgaatgggattgtttttctcatttggctctcaggttggctgttgtcagaattctcctcccaaaaacaatatatattcttctcattgtctaatggcatgtactctaatattgaccacataattggacataaaacaatcctcagcaaatgcaaaagaaccaaaatcacaccaaacacactcttggaccacagtgcaataaaaataggattcaagactaagcaaattgctcaaaatcatgtttatattcctgaatgacttttgggtaaataatgaaattaagggagaaatcaagttttttgaaactactgagaacaaagatgcaacacaccagagtctctgggacacagctaaggcagttaagggagaaattaatagcactaaatgcccacgtcaaaaagttaaaaagacctcatattaacaacctaatgtcacaactgaaataattagagaagcaagaacaagtcaaccccaaagctagcagaagctgaactgaaggaaattgagacacacaaaaaaagcattcaaaagatcaatgaatccaggagttggttttttaaaaaaattaataagataggccactagctagactaataagaaaagagagaagatccaaataaacacaattagaaatgatgacgggaatgttaccactgaccccacagaaataaaaataaccatcagaaactactacaaatacctctatgcccactttttaatggaattttttgttgttgtttgagttccttgtgtattctggatattagccccttgtcagatgaatattttgcaaatattttctcccattcaacatgttgtatcttcactctgctgattatttcctttgccatgcagctttttagttaatatcttcccatttgtctacttttgttgtcaattttgcctgtgctttgagggttttagtcataaaatctttgcctagaccagtgtcctggagtgtttcacctatgttttcttctagtagttttatagtttggggtcttaaatttaagtctttaatccattttgatttgatttttgtgtatgttgagagatagggttctagtttcgttcttctgcatatagataaccaattttcccagcaccacttattggaaaaggtgacctttctcactgaatgttcttagcacctttgtcaaacatcagttggctgtaaatatgtaggtttactttgggtttatctttattctgttccattgatctacatgtttgtttttataccaatacgatgctctcattgttactatagccttgtagtatattttaaagtcaggcagtgtgaagcccctagctttgttcattttgcctaggatttctttggcttttcaggctcttttttggtttcacataaattttagggtttttttttctaattctgtgaaaaatgtcatcatattttaatagggatgcattgactctgtagattactttgattagcatgatcatttaaacaatattaatgcttccaatccccaggccttgggtagcgtgctagagtgggtgcagtagcagtgcagtgagtggggaaagcctattcttaaagtgcatgcaaacacagagctgttgaggggtcagggttgctatcggtgatagccacctcaggcaggcaggtttgaggctctgaggagtacatactttggctcccctttccccagcatgcagatcactgtgtgggctagagttctggggactctgtttttccagtgaatccaagtagcatttcaccattgcagtcctctgggtggactcagggggatgccagtggtgtgctcccaagaggcagagatgcagaggctgttgtaccctgggctaggatgcagtttggtggggctgggctctcaaaatcgtgctgtgctgccgctgcctggaactttaggaatgtgtgggacccagcgtgagctccttctctagggcaatgatattgtatagactctgggagctctctacttcagtctcaaggagagtcaagggactctcctgtggctagggttataggagcctaaggtgagaatgtggactgctggagatccctcttatccatttcccatgctggggaacctatcaaggctctcaggggatcccagctgggctgtcacttgcctgcttctccttcattgcctcaggtgtttcctgtgacttctttacttatatgttctatttaaagtgtgactatctacttgctatttttgttctttttgcagaagttcgtgtcctgtacctctggtcagccatcttgaacctctcccctatagtgtttaaattttatgatgctctttcctgttagaatatctccttttgctcttaactgtggttatgggacatacctttttggtcttttggtcctttgtaaaccccatacagactggctaattcctgaaaccagctgctgtaaagctacaagccactaataacaatcataattgtctcttcctagattggaagattctggtcagttaattgtgtgggttaaatatcagaaggctagaggtgagcagtagtacctctggttgaaattggcagtttatattggcactttctggttgaaagtagcacattatatttggattcctgggttattcttgatacatttggataagttgcatactgattctgaatgagtgaataggtggatgagtgagtgcaaagatgcatacatgtacatcactgtgcattattgtaacaatacattggcttctcagttttccaagaatccctttgtcccatagctgagcagctcttatgaattcttcacacatatatgctacttctagtcctttccataagtagaactccatggaacaaataccaaaacaatgactactctacagttcctttctgatctaggctggagaatgtttgtgtcagatgtctatccctttaaagctggggggaagaaactgaaagagaggtgcagaggaaatgcctctaattatgggaccaatttaatttaaatgtccaaatgagcaccctatatgcaccaatccttggatagggcagtgaatcaaacatggactttcaagggttccagagtctgatagcaaagacagatatgtaaatatcattatcagttaaactgtatgacattccctatattcaaatgttttgacctaccaaaagcagcagtctctcatggttcagctcaatacatgtcagtatgacagctaagataatagaggtgtgtgtacatccagcaggggtgcagagaggggagaggcaggcagagtgaggactctggaaattttttcaggagttaagacctacaaagcattttggtgaatgatggggaaaatagggagaaaaggaaagggagcgaatgaaaattttggaaaatataaaagaatgtatttcctgaggagagtggcctacattgttaaatttgattttgtttttatgtttaaatatttaaaacataccaaaaagcttaaaaaatagtatgacctcccacatattcaaaataacgttttgagaaaaaggaatttgcacatttgcttaaattcctttttcttcataaatcaaatgtaataagggtaacaccactatctatcctacttgtctctctcctttcctatagatgaccatcacaataaaattggtgtgtatttttcttatgcattttaaaaaactttcattgcatatgcatatatttataatatagagtatggtttgattgttttaaaatgttatataaactgtctcatactgtacatatccaattgcatcttgcttttgagttgctaaacatcatgttttgaaaacttatccatgttgatgcatgcagatctagtttattcagtttacctgctgcatagcattctgttattggactatatcatactttatctattaatagctatgttcttactgatgggtgggcatctacattgttattacaatacaaataatactctacttgtcttcttgtggacaagggtgaagatttctctggaggacatttccagaagtagaattttgatgtcagcttaatcagatattaacaactcgcattccaaagggttttttttgtctttattaatttataggtacatcttatatattcaggatactaacattttatattttatgtgttgcaaatatcttctgtcagtctgtgaccttttttttttttgggagacagagtcttgctctgttgcccaggctggagtgcagtggcacaatctcggcccctctgcctcccaggttcaagtgattctcctgcctcagcttcccaagtagctgggactacaggcatgtgccactatgcccagctaatttttgtatttttttagtagagatggtgtttcaccatatgttggccaggctggtctcaaactcctgaccttaggtaatccgcctcccttgtcctctcaaagtgctgggattacaggcgtgagccaccgtgctcagctgtgacctatcttttgactttatggtatttattattgtgcaaaaacttttaagtttaatgtcaaatttctcgatctttttatttttgggtatgcttttcatgttatagaaatcattatttatgtgaaagtcataatgttgtatttttttttttttacaagttttaaaggtttgcttttctcacttaaggtctttaattcatctggaattttaggtttatatacataatatgagggagaaacctaagtctttcttacatgaaaagccaattgttccaatatcatttactgattaatgttttaccaactgatttatcatgtcatgtctaccatatatctagatcccacctatatgtggatctatttctggtctctgttttgttccattaatctgtttgacaatccttgtgtgaataccacacaatttgaattattgtgctttgataataatttttgatattataaagcagaccccttttaataagccacatcatgaagtgtggtccaggtttgaggatgggtaagcagaacttccaaagcagccaaagcaatgtaaaggaaatggacaggtttctccgttgctctgttttatctcattgaactatatctgatgttcacagttcttggtagtcctaacagagtaagatgccttctacatctgattaacctaaagctgggggcatgaatatatgtcaataattctacactgatcttggggtcttgcttgctgggagtactggggcagttggtttccatctgtacctgtaccacatgatgtaggaagtttcccatttatatctatttagaggctttcctggattatatctagtcatggttgctatattctttctccttttccccttccttctcaaaaattattatgactaatcttggcttttaatttttttatataaaatttaggaacagtatgtcaagttccgtcttactgggagttatctggaattgcatagagtaatttaggaagaatcaacttttttgaggtattagtcttcccatgtgtcaaaatgccatagaccttctttaacttaggtcttcttttctgtcctccagttaagttgtttttgttcgtattttttcattttatttttttattgggtaaaaaataaacataaaatgtatcatctttaccatttttaagtatagagttcagtggtaataactacatttatatttcttttttcctcttcatccctccctccctgctacccttcctggcctctggtaaccattaatttactctctgtctttatgagatccacttttttgagctcccacatatgaatgaaaacatgaggtatttgtctttctgtgcatggcttttttcatttaacacaatggcctccagttctatccatgttgctgccagtgacaggatttcattctgtttatggctgaataatattccattgtgtatgtctaccacattttctttaccaattcatccattgatgagcacttagcttgattccatagtttggctattgtgaatagtgatgcaataaagatgggggtgcatgtatctcttttatatactgatttcctttcctttggatatatacccagtagtggaatagctggatcatatggtagttctacttttagttttttgaggaacctccatactggtctccatagtggctgtactaatttgcattcccaccaacagggtatcagggttctcttttcttcacatcctcacctacatctgttattgcctttttttttttccatgtaagctattttaactgagatgaggtgatatatcattgtggttttgatttgcatttccctgttgattactgatgttgagcatgttttcatatgcttcttggccatttgtatgtcttattttgagaagtgtctcttcatatgttttctccatttttaaattgtagtatttggttttttgctattgatttgtttgagctccttatatattctggttattaattctttttcagatgaatagtttacaaatattttctcctattatgtgggttgtttcttcaatttcctttgatttgcagaagatttttagcttgatataatcccatttgtttatttttgctttggttgcctgtgcttatgatgtcttacataaaaaaaaactttgcccagattaatgtcctagagcaattttcccaatgttttcttctagtagtttcattgtttcaagtctcagatttaattattcaatccattttgatttgacttttgtgtatggagagagactggggtctagtttcattcttctacatatagttatcctgttttccctgcaccatttgaaaagaccgtcctttccccattgtatgttcttggtacctttgtcaaagatgagctgattgtaaatacattgatttatatttgggttctctattctgttccatttgtctatgtgtccatttttatgccagtaccgtactgttttggttgctatagatttgtagtaaattttgaagtcagagagtgtggtgcctccagcttcgctctttttgctcaggactgatttgtctttttggggtcttttgtggtttcacataaattttaggttttttttttttctatttctgtgaagaatgtcattggtattctaatagggacttcattgaatctgtaaattgctttgagtagtgttgtcattttgacaatattaattattccaatccatgagcagggagtatctttccatgtttttggtatcctcttcgatttctttcatccaagttttatagttttcattgtatagatctttcacttctttagttagattgattcctaggtatttcatattttttgcagctattataaatgggattgctttcttgatttttttgtttgctcttggcatatataaatgctgctgatttttgtgtgttgattttgtatcctgcaactttactgaatttgtttattagatataacagtttttttggtggaatctttaggtttttctagatatgaaatcatgtggtctacaaacaaagctaatttgacttcttcctttctgctttagatgccctttttttcgttctttcctaattgctctggcagggacttccagtgttgtattgaataagagaagtgaaagtgggcatccttgtcttgttccattccttagaggaaaagctgaaagctttttagtacaatgttaattgtgggtttgtcatacatagcctttatcatgttgaggtatgttccttccatactcattttgatgagggtttttatataaagcaatgttgaattttatcaaatgtttttcagcatctattgaaacaatcagttggtttttgttctcaattctgttcgtgtgttgtattacatttattaatttgactatgttgaaccatctttgcatttctggggtgaatcccacttgatcatagtgagtgacctttttaatgtgttgttgagtttggtttgctagtgttctgttgagcatttttgtacatatgttcatcagtgatatcagcctgtcatttttgttgtttgttgtgtccttgtctgtttttggtatcaaggtgatgctgtccttgtagaatagttgggaagtactcccttgtcttcaatttttttgaagacaaagaatttgagtaagattgttactggttattctttaaatgtttggtagaatttatcagtgaaaccatcaggtgctggacttttctttgatgggaaactttattacagccttcttctcattaacaattattggttttgtgaggttttctatttcttcatggttcaattttgataggttctatgattccgggagtttatccattcttccaggttttccaattcgttggcatttagttgttcataaccatctctgatgactctgtatttatgaggtctcagttttaatgtcttttttttcatttctgactttatttatttgggtattctctcttttttcttagtctagctaaaggtttgtcaatttttttatcttttcaaaaacaaacttttcatttccttgacgttttgtggttttttagtctcaatttcatttatttttgctctgatctttattatttctttccttttactaatttggggtttggttcattctttctagttccttgaggggtgtcattaggttgtttatttgaagtctttctactccttttgattataggcatttactgctatacatttccctcttagtgttgctgttaccgtatcccatagatttgggtatgatgtatttccatttttgtgtgtttcaagaaattttaaaatttccttcttaatttcattgacccattggtcattcaggaacacattgtttaatttgtatgtgtttgtgtgttttccaaagttcctcctgttactgatttctagttgtattccattgtgatccattgtgatcagaaaatatacctgatgtaatttatattttttgaatttgttcagagttgttttttggcctaagctgtgattcattctggaaaatgtcctgtgtgctgataaaaagaatatgtattttgcagcagttgggcctattagatttagtgtggagtttaactctactttttctttgttgattttctctctgggtgatctttacattactgagaatggggtgctaaagttccctaccattattgtactgcaatctatctctccctttagatctgttaatttttcctttatatacttgagagctccactgttgggtgcatatatacttacaattgttatattctcttgctgaattgacccttttatcattatatagttaccttctttgtttctttttacaaccttagatttgtagtctattttatctgaaataagtatagctatttctgctttctttttagcttccagctgcataggatacatttttctaccccttcattttcagtctatgtgtatctttatatgtgaagtaggtttcttcaaggcagcatataattggatcttgtttctgtcccttcagccactctctaacttttagttggagaattcagactttttacgttcagtgttattattgataagtaaagacttattattgccattttgttgcctgttttatggttgttttgagactcctctcttcctttcttcctgtcttcctttgtggttattttcactgatagtatgttttactcttttgctttttattcttagtgaatctattataggcattcatgctgtggttaccatgaggcttacaaaaaaaaaaaagaacttgtagatataacaggttactttaaagagaagaaaagttattttggatcacaaataaaataatagaaacaaacaaaggtggccaggtatagtggctcatgcctgtaatcccagcactttgggaggctgaggtgggtggatcacctgagtcaggagttcgagaccagcctggccaacatggtgaaaccccgtctctactaaaaatacaaaaattagccaggcatggtgatgggcacctgtaatctcagctactcgggaggctgaggcaggagaattgctggaacctgggaggcagaagctgcagtgagccgagatcacaccattgcactccagcctgggccaacaacagtgagactccatttgaaaaaaagaaacaaacaaacaaaaaaccaaagttaaaggaccacaagacaatctacgctttaactgcatcccccccaaattttgacttttagttgtctcagtttacatagttttatattacttgtctctcaacaggttgctgtaactattattgtttttgatagatttgtctttttggcttcatactagagttatgagtggattgcacaccaaaatttacggtaatagaatattctgggtttgtccatgcaattacttttaccagtggtttttataccctgaagatttttctttttgcatggtagtgtttttcttcttttagatagaataactccctttataatttcttgtaaaatatgtgtggtggtgaattctctcagcttttatttgcctgggaaagattttatctctatttcatattcaaaggataattttgctgggcatagtattcttggatgacaggttttttttattttcttaaagcactttgaaaatgccattttttcccttcctggcctgtatggtttccgttgaaaagcctgttgccagacaaattggagatcctttatatcttatttccttcttatctcttgctgcatttaggatcttcactttgtccttgacctttaagattttgattattatatgctttggattagtcttttttgggttgaatctgtttggtgttctttgaccttcctgtacctggatatttatacctttctcacattttggaaaattttctgttacttctttgaataagctttctaccccttgctcctactcacttccctcttgtacatcaataattcttagatttggtcttttgagataattttctgcatcttgtagttggttttctttccttttcactcttcttttttctctgactgtgtattttcaaataatcttcaagctcactgattttttttctctgtttggtccattctgctattgagagtctctaatgagttcatttcagcaaatgtatttctcagttccaaggtttctatttgatttctaaaattattttaatatctttgttaaatttctctgataaatttctgaattacttttctgtgttaccttggagatcactgcatttccttaaaactgcaattttgaattcctggtcagagagcttacaaatggctgtctcattaggtcagtcactggatttttgctttgtctttttggggaggtaatgggtctgtttgctgttgtttcttatgggtaaatgtctatgtctttgaaggactagctatttattccagttttctctgtccagcttgttttggtttttattagatatatttgcttagtatatctttatcacaaggttgcggtttcctttttgcctctaggtggtaccttaagcccaggtccgcgttagctctagtaaatgatctgagccctgcctgtttcaaatgtggagatcccaaagggattatccaaccagtgtgggaaggctgggtaggggttcatgttcaaaagacctctgaattgtaccttctacaatgtgatgctgctgaacagccactctgatttggcatcttctttagccaagttacagtacagtttccaggaatgagtatggtagtcctgcctcccacctttgtctttgcaggcagtatgatgcttccagtgggtagaggcaagtacagaactcctgccagggaatccaagctggtgggaaagctgatttaccacctcaatctcacatttttccagtgtagaaattgtgagttggggaaagattttccacacacttgttgcagggcaccatgagggggagaggcctcaaggatttggaagtccaactctttcactgttgacttggagttttttcacctctctgtggccccaggatgcatctcatcctcatatttgacttctgggttgttgctggtgaaaatcttggcactgtatatttggttttggttttctgtggggggaaatgaagctagattgtttctgcactgccatttgaaaactggaactcttccagttaagttttatactttttccataaaagtttggcacattagaaaagatttatttttggatacttactttttgttactatataagtgatatttttgcttgttctaatgtttattctaattagttctactgcttatttcttatattatgttgaataaagtggtgacaatgggcatctgtctcacttcccactttaagagaatgcttccaatgttttcacagatattttttggtggtaatactctgtcagattataaatttttatggaattgctttctcaacctcttctctgtctgcaatctccgtggtactgtctggcttcctgcaattccccttttcagtcttccagccaaaaatctaagatttatttggtctgctttgctacacactttttatgactgcaattgtgtctgagaccaagtggctggaggatagagaaagagaagcagtagggattcacctcaccttttgagaccacagctcccctgattgaaaggaaatttccctttctttagagttttagctgacagttgctactgtaccaaagaagccttttttttttatacttctagagcccaaactagaggtattctgcatgagcttttctctgcccatgtcaatatccacttcttggtttcaggatgccttgagaccaggctaagggatatggagggaaaaaaatgataaattcaccactggttgggtgattcttagaatttcgttcttttttttccctgttcacctgctcctatttacttctcagaatcctcaaataactgctccatgcattctgttcaaattttgtagcttcattcaataggagagacaaggcagagtttatctgtttcgtcttacctagaacagaacctactgatctttttaaacaaacagtttttggctcaatcaactttattctttctttgtttcttttctatttaatttctgttcttaaaaacaaaattctccatatactgttctctttgggcttatcttgctgtttctctaccaccaatcttgagttgcagacagcccaatttttggtttttcccctcataatatatagataaaataatatattataaaatttattctaaaaactaatttggatatatttattttcattttaagttagttctaattagttcctagtttctatttttgtagttttctttgactcaaaaatataagtttcaaacaaatagcttgctatatttttgaagattgatttctaattttattttactgtggttatatactgtgatttgtgtgaattcaattttatattatttattaaaaatttgtgatccagttcatgttcaatttttgaattaatgtatgcttggaaggaatgtgtaccctttaattgtgagtggcaaggttcaacatatcaccatcaaattaaacttattaaaaattctcatactcattgaaactaccctgtatgatactatagtggtaaatatatgtcattataaatttgtctaaacccatagaatgtacaacaccaagattgaactttaagataaactatggactttgagtgatagtgatgtgtcaatgtaggttcagttgtaccactctggtggaagatattgagaatgggggaaggctatgcacatataaagtaggggatatatgagaaattgctgtaccttctgctcaatttttctgaaaaactaaaattactctaaaaaataaagtgtattaaacataattctcaccatgctgattgttaattaattcatttctccttgtaattctttcaatttttaaaagtacagaactattattactgatgaatggttacctttgtcattatacagtcttattttagttttactataactaaatttttgttagtatttgtcttatatcttattaaatctccctcctttcaatgttgatgagccattatgcttcaagtgtatcttgtaaatgacatgtatttggatttaaaaaaaaattatcctgagactttctaatgggctagtttattctgtttatactcattatttctgatatttttggattcatttataccatttaattttattttctatttatgatccttttctttttgtgtatattctattgtattgattttctttattgtttctcttttcccccatctatcattttgaaactatataattgatttatattattttagtggattcccttaaatttttaatatactatattgatttaacgaggtaaaaagaatctctatctttacctatttgctaaagaatatatgggacttaaaaagctttaactctagaaatctctcaattcatccatgtattctatttatatcttatttttaacatcccctgctcccaaattagtcattactattatcatttaaaatagatgtatccatgttgagccaactgtctttgttccatatagttttttgtataatattgtttcatttaggatcaaagtacaaccttaaatagttctttcagagtctttgagtaatcaactctctaagtctttgcctttgtaaaaatatctttatttcttctttattataagacatatttactgttggaaaataacttagctgggtatagaattccatgttgagaattattttctcttggtatgttgaatatgttattccataaagtgctggctatcttctccaagtcttctctacctgaagcccactctggacctgctaagccagtagagtgcacctttttcaggggtcctaaacctgtagcagcctactgaaaatcatataactttctccctagaaaaatggataaaataatgcctactaatttgagagttacagatgctcttacgctcatcttagccttcagtttaagaacacttgtaatagggctttcaaaggtggaagatctttcccagtgagagacaggccctacatctttccatgtacaactttggccctaaagttcccaccctgatgagcagagtgatggatcatgcgctgagagagctgcttttgtctttccaacctaaggcttagctgaaagagacagtaatggagacaagaagcttatccaatgtgaaataaattgctaaacagctatctgtgtagaagctggaggtgaaatacaagttgctattctgtccgtataaccattggtggttagtggtacagctacactcacatggtacaccacaagaggggtattcaaacagacttatcaacaggaattatttagacgtctccatgtcaattcagtcaatagaaggttcttgttaaccaggcattggagactacaaaataacattgtgtgagattaggaagaggctacagaactgagcagaatcttgcaatggggaggtatgggggtcttcatgggtcataagcccactctttattgcccaaaggagagcaaaacctttttaccagctgacctctgtattagtctgttctcacattgctgtaaaaaaatacctgaatctaggcaatttataaagaagagaggtttaattagcttgcagttccacaggctgtaaaggaagcatagcagcttctgcttctgaggaggcttcaaaaaacttacaatcatggtggaaggtgaacagaaaggagacatgtcttatatagccagagtggggacaaaagagagagtggggaggtctacacacttttaaacaaccacatgtcattagaacttactcttgcgatgacagcatcaaaggaggttggtgttaagccatgacaaaccgcacccatgatccaatcgcctcccaccaggccccacctccaacattggggattacatttcagcatgagatttgggtgggtacacagatccgaaccatattaatctccttcacatattgaataaggttatgaataggtaagaaccatgtgagaaattcacaagaagatgtacaattttttgatcttcaataaacttttatttaacatctgttgtgactgaggtatgccactaggtgctgggatgtaagagctcaccttagaaaaagattttttccccccaataccccttccatattttataggcctgaaaaacaaaacatacccgctcccaatggccaccccctcccccaatgacatgcacccacagacagttaaggatgtgtgggtatttgtataccttgtaaaaagagttgagctaaattatagctccccatttaaaaaacagtggtagtctaaagctgcagagtgcaaaattcagagattgccatagtaactctgcttttcccaggaagtaattgaaaaaaggcacattttataaaaatagaatattgatgttcatatctataaaggaattaatttactgactgatagaggggaaagaagaaagatgagccattgagctgcattttaatgtgattgcgattatccccagggtggcaagcagcttaaactcgttcttttatttttgcagcaaagagcacttttcttttcagcttggtttgtgtatagaaatagtttccagaaatatatagagtaataaggaattagagagcacatttagtaaaacactgaaaggctccaatttgtttcttgccattatcagtctgatgaatgttaaaattgcttggagtatatttaatcactgttcatgattagtacagcagcgatactataggaatagctgcaaatgtaccattagcaattagggaattctggtctatcacaggtgccatcatgagaccaaagacaaacacatgaatgaaaaatgattaggctaggaaataataatgatgataatcatattctagaaatactatttagagggttgacaggattttgatgaagacttatatatgtgtatatttttatatatgtggtgtaaatatatgacataaatattccagggcctgttctctggaaattttcttctagagaattagaattattctcaaggtaatttttttaaatttcccaatcacatcccagctggctaaaaaatgatccagttgaaagcatctcagatggtgaactcttaggccttatggcaggaatggggaggagagtttgaggagagagccctccctagagaccagtgagatcacacccctggtaagattggttctagctggcaggaagtgagaataatgtggtttttctctcagaacaattcttaaactaaaggactagaactttaaaagttgaatttcaggctgggtgcagtggctcatgcctgtaatcccaacactttgggaggccgaggtgggtggatcatgaggtcaggagttcacaaccagcctggccaagatggtgaaaccttgtctctactaaaaatacaaaaattagcctggtgtgctggcggggacctgtaatcccagctactcaggaggctgagacagagaattgcttgaacctgggaggcagagcttgcagtgagccgagatcacgccactgctctgcactccagcctcggtgacagagcaagactctgtctcaaaaaaaaaaaaaaaaaaagaatttcaagcatagataccctggcatgggagttttggatggatggagttttggagaggctgcactgggctctatttaggatttatatctgtaatcatacaccatataatgatgttttggttaatgacagaccacatatatgacagtggtcccttaagcttataataccatatttctactgtaccttttctatgtttagatacataaatactattgtgttaaaattgcctataatattcagtagagtaacatgctttacaggtccatgggctaggaggaataggctatatgatatagcctaggtgtgtggtaggctaggtttgtgtaagtatattctatgatgttcacacaaggacagaattgcctaatcatgcatttctcagaatgtatgcctatctttaagtgatgcatgactgtattatgatatttcttatgctttggaacaacactactatttttcatttatctattgcttcccctactaggatatgagctcacagaaggagggaaggatagtgtcttaataatctctgaggtcataggcctggcacagttcctggaatagagagacagagtggtaaataaatgcctgattgattgattaaatgaatgaattcagtgaggcagacttacatcctcttttttagggccatccttgctccctggacattgccactggcttgtctgatatcacagtcaccttcactgctgccatgatccttgatagaattttacaataaatttcttttctaaaaatgaaatttcttttttttttagaagaaatgaaaagagccaatatttattgaatacttgctataagccaggcactggcctgagtactttatatgtcactatgtacctttaatcttttccaaaagcctggtagagtattattaatatccccacttttcagaaagggaaactgaggtccagaaagaataagtaacttggctgagattttgtaactggcaaatggcagggccagaattagaaatcgagcagtctagctttcattattttcccctttgttctcaggacactgagtataaatggaaataaacccaattcttagatgtcagaaattagggtaaagatattttcatcgtgggcaagggcagtaagaaacaaagatgcattgctagatcacaggaataattatgtggggtctttgataaaatctgaaaacctagaaagcattttccaagtattagaaagcattcatgtttacattgttggaatgagattgtagcatcgcagtgtaagaaaggccttggataattctcgatggtgtgccacttaatgataactcactattgttttgagcttgcagcttttaaaaatactttcatgtcttgctttgtttgatcctcacacccgctctgagatattcagtgccgatagggcagacattagagatgctcagtattctggctttcttctttgggcacagggtagattgtacttacctgtacctttgaaattgggtctgactatatgagctgctttggccaaagaaatgtgagtggaaataacacatgacatttctaggtgaaagcctttgaaaagtgactcaccatgttctctttttccctgctacaatgatgagctatgttctggatagtgcaagttcatatgcttgtgtgtttagaggactgatatggaggaaggcctatatgcaaattatgactccattattttaatatcaatacctcttatatttctgattttctaaatccttattatagtgcatatattatctgaatctctgaccccaaacacgtgtccctctggggagtaatgtggatagcactggtctccctaggaggctggtaatgaggcacgagggcatttggtgcctggataaaggtggcagaataaggagcttagtattatagatacaaggatacctatttctccttttctcttcatttttgggctttgaaaattagacaatcaagcattataggaaacaacaacagtatccaactcagaattcctgctggctattttcaccttggcacatccagtctgcaaccagcttcaagtgctcatgaaacagacatcagagtatttttctactttttgaaacctaccacattacatcttaagtgacttacttgataagacttatatttagggtttttttgtctgtttgtttttattttcccccatctcaaaattagctaagcatgaagatgaaacagatttctgtatgaagactaaaatctcaggaagaggtgctgaattacaaagggagtttagttagttagttgatgaaccatggtgggtgccagcatgtaggcacatcagattttacaggctacatctttgtgtcttgcctgttgagaaggcatcccagcccaggatatatcctccaaaaggaaagggaattggactctaactgggcagcaatgagaataatttctttgaatgttacaccatttacttgtcagtgtgtggtgagcactcagcttgactgtaatgaccacaggatcctgagttatctgcaccagctgctcaaccatgttttattttggtgatcgaaatcctagttaaaagtatcctagttgactaatgaaggtattctaaacttacataagtaactgagtcctagcaatatattcaaatgtcaaatttagggatgttgacattttagattactttatacatcaaatgatttatctgaaatcaggaaacaaccacttataatacctcagattgtatcgataatagttttagatcactctatttttatacatttctgggcacaaaacatgatcaaaataatgtgggatgtaactaaaacatttctctccattcacactcttctactacattaaatttatgtttaaaatggctggaaggtgaaagaggcagaatcctttaaggagaatgcccttagccagaatcccagcttccatcaagcaaaacaaaacaatggctgggagtagatgggtgtttaatgactaaaatcttcaataatatatgggcaataacaaataatagtgatcatgagaaattgtttcctgattgtgtgatacacagtcatgtgcagggtggcagtgacgacacgtggtccagtatttcatggcctttttttgtgtaacagtatgtgcaaggtgagaaagcctacaggaaacgagcgacatagagcggccacataggcaaagtggaggctttttttttttttttttttttttttaggaggctggattttccttctcagtcactggcttgataattagagccagcagcaggaggcaaattaaagccttattggaaaattctaaataggtaggtgtttgtgggttttggatatttctccaaagccctgaagcaagactgaaatgtgggagcaggcataagcacgtcttcccaccaagccagatacatcctttagcagctctcaaagttcttaaaaaccataatgctgccatagagaatgaggtctgcatgacttctgattttaaaaaagagcagacgtaatgagtaataacaattgaagtcgaaattctgtgactaagattcttgtatgtggtcttgtatttctttaactcttactccacaaggcattttcttttagaattaaaacataaatgtacacaatatctacttaatgtgattattaagagtttctaaatagaaaaaaccccagcaatattgcatggaagtacttgccttaaatggatgagttctctgttttctgtaattgaaatgaccagctggggctgggactgtaaaatctaaacaagcattactgtccacctagtgacaatggccccaatctcagcatgagattttgaaggaactaacttgctaactttagagcagtggttcccaaacttcttcctgactccaaactcttaaagctgtaacatctgttaggagggactttctatattcattaaagtttattccagttcgttccagtaaaagtcttgctataccatggcaggggtgggggaaaagatatctggagggaatgaggaaagtgtggtttaaaatatttcttcttcttgcactgagatcactggattaaagaatgagtcctgcaaaaaacaattttatatgtgttaattcctcaggtgttaagcatatattaggagaaagagctaaaacatagaggtattgcctatgaggcaaggatgcaggcagttttggtgatatgatgcagctacaaagagaagatggtgcttgatctattattatcctttttatgtcactgatttttgtttttgttttctacttgaacatttattgagcagttatcttttcattcttgagtctactgaaacaaacatgccgcattttgttttacataaaaggcacataccatatataatgtttaggattttttttctagtcacttaacaatatattttagagctacaacaaaactacttcattcttcctttatggctttatagtttactactgttgtaaatgttccaactatgttgtctatgaatggaaaactgtttttttaagttttctcctactaaaaaaagtattataataaatgtctatgtatctacatctttgctgtccaaagagatgggcatttagaagtttggcagattttacccaattcttgctcaaagaagttttactaaattgtgttcacacccacagtgtatgaaagtgaatctctgcctccttggctgtggtatattgtcatttaaaaaatctccatccatcttatgggtgtaaaaaatggtatttcacattctcatttacattttttaaattatgcatgagactgattatatttataatttttcttaacttttgtttgaagttcaggggtacatgggcaggtttgttatataggtaaatgtgtgtcatgaggatttactgtacagatgatttcatcacttagatattaagcctagtacccattagttatgtcactttattctttgattgctttcctattattaaaaaaaaactaatagatctttgttataaaaaggttgttcaatataaaatactgtgaatctctccattacatggagctactgattacagttcattttatatttgcccagacatctcttttctggaatatgtatctattcgtgtgtttatgcatacatgtttttcttacacatgtactaatatatattaatatgcaattactcatttgtaactttgatttttttaccaaaatatgatcatacatttgtgttttgcttttattcacttagcaattttattaaagatgtctttccttattagtacttacatagacccaccttattcttttaaaatggctgtgttgttttcaataatatagaagtttcataatatatttaactatgcccttatagatgggcattttggttctttccctttttcgttgctgttataaacaaagatttggtgcatatcattctgtgtatatttgtatatctatgtatttggtgtgagaaattctgtaggatagtgaaaaacagaacctatgattcaaaagagtacttatttttaatattgacacatattgccaagttattctaacaaaatggccatagtgatttatattttccttcaacagtgtatgaaaacaccattttcttacatttttatcaacagttggtattactaatcttcaaaaatttttccaatatgatggataaaattatatcttgttttcattattttgattattggtggagttgaatataattctatatatttcaggccatgtacacttcatctaagtgaattgttgctcattttttcactttatttttttttcttttttctttttcttttttttttttttgagacagagtctcgctctgtcacccaggctggagtgcagtggcgtgacctcagctcactgcaaccttcatctcccaggttcaagtgattctcctgcctcagcctcccgagtagctgggattatataggcatacaccaccacactcagctaacttttgtatttttagtagagatggggtttcaccatgttggccagactggtctcaaactcctgacctcaagtgatccacccgcctcagccacccaaagtactgggattacggacatgagccatcgcatccggcccttttcatccatttttctactggggcttttatattttcttagtaatgtattatggctcttaaccctttgactgttatgtcacaggtatttttttcccccagttttcttttggccttctaattttgtttaaggtttattttttttttctgtaagaatctgacattttaatacatttaaatctgtcaatttttccctttatggcttttgaattctatttcatgcttatgaatctcttttctgtctcaagattttaaaagtatgccttattttatcattgaagttttatatttagataatataaatattttgatttttagaaatttagatttctagttacactggaactttttctgattgattcaagtaggaatgtaattagacttcttaaatatgaataacctgttgtttcaacaccaggggacacatcctctattctctgtcacggtgtaggatagttcatcctttcctagtgatttggagtatctatcctacactaaaacgttacatacacatagatatgcttctctactttttattctgttctgtgattaaaatagtactatactgttttagttattttaaggtatattttcttaactgagaaggtaagtcctcattttccccccaaaatgtttctgcctatttttccacacttattcctccagaggcttttcattttaaaatatggtagtgataatctcagaggcagttttcttggtccaacccttgtagttctagttttctagcctttctttcaagcattatcatgtcttgaataataatggggagaaagagatacagccttccttctgtctgctaattaatgccttcccaggacacttttccctgtgcccatcattcaagtagtcttagccctgagatcctgtaaatttttgtcccaagtacttattgctgcatgatagactaccccaaacctttttgttaatgggccagttgggaccattaacaaataaataataaataaatttttatctattacttttcgaaacagggtcttactatattacctagggtgatctcaaactcctgggctcaagtgacttcctccctcagcctcctgtgtagctgggattacaggtatgcattaccactcttggctctatcccaaaccttagtgggttaaagcgataaacattttattgcatgttataactttggggtcaggaatcagggcagagcttagctgggtaattcttttattttacatgatatgaactggggtcagccaatgctaatctgctggtaaccagtccagtctactgggtccatggtggtttcactcatatgcctgggtgcctttggtgggaatggctggtagcctgggttaagctggatcccgcttcctatgcttgtggtctcttcagcgggatagttggacttacatatctgttcaaggctccaagagtaggcattcaaagacataggaagtggaggctgccattctttgaagatctaaatttccaaactggcaccacatatccgcaagatactgttagtcacagcagttacagagcctgcccagattcaaggagtgagggcatagacccccacctcttaatgggaaaagtgtcaaagaatttgcatatggcagtttctaatgattactttgtgcatgcttccatggcatttagaacctaaagtcagaccatgcgatgactttattgttttatgaactccagaaatgtacatatacaatttatatgagtgtgtgtgggtgatgatatggggaaattagaattcagacaacctgatccttgaaaacaattggttatcacacagtgactgttgactgaccgttagtctgacttgtgtttttcaaaatgtccttgtcaagtagagctcagttgtctggagcactgagcctgtgagcccaaagccagcgtgtccatccccacgtcagactagaaaactgctgtcgttctggccctgagtttacctatctgccattgcatgtgtgggtgtgaagtgacaacatgacagatgattattgtagggaaaaacaagcccaagttcttctgcacttgggtctgaggtgtcatcttagtgcataaaaatcataggttcacattgcatgtattttgcatatttggagactctagtagaaaactacgttttaattaatttctttttacaagtagctttgtatgttctcaggcatatggaaatggggaaaacatttttttaacactttttattctcattcacccaaaagtgatataattttccttttatttcaaaatctctgtgttttccagcctgggcaacatagcaaaaccttgtctctacagaggtaaaaaatgaaaaaattagctgagtgtgatcgtgcacaccagcagtcctaactactttggaggctaaggcaggaaggtcacttgagcccaggagtttgaggttacagtaaactatgatcatgtcactgtactccagcctaggtgacagagtgaggccttatctcaaaaaaaaaaaaaaaaaaaaaaaaaagtctgtgattcatcatttactttaggttgctcataatattatttgcttttctcttgactattggcttaaaaaatcatatgtactttcaccaaagaacaggttctcaaacagataacgaattgtgtctttaacctgagaaaattaaaatgctctgttcagtgagtcaaaagttttattctcaatgctacctttcttgctgttatcaatataatagagaatgtattgcatatcagtggtacatgtgatcctcttaaactgtgaaattctattttagtgtagattccctatccttccatatggccttgaagtgttgcaggacaggggggccccaaaattgaggctctgcccaggaagtttctttattttgcccaggaagaaattcaaaggcaagctggtggtgaaagaaaacagctttattgaggcagcagtattacagcttcatgattgctcttgcagagcagggtcaccccataggtagtgcagcaagaatagcagctcaagggcagtcaggcagtcacatttatatctgcttttaattacatgcaaattcagaggcaagttattcagaaatttctagaaaagggttgtaacttctgggttgttgtcagggaatgggtgaactgtcatggctttggtgggcatgtcagccagtcttcagtctggtccagagtcgatccctgcctcctacttcagaaataggaaggcaagaccctttgtgcaacagatgtaaagaatgatttatctcaactgagaatgggaagtcccattcttgtgtccccacatctagcctgctctggctcatagtaaatactcaataaatatttattgagtcaatggccagggcaatgatttgaatgtactgatctatttccagccttttgtttgccctattgaaccccattgtctcagaacatgctgtgataatagactactctcaggttctgagaaaaacgtgaatgttctgttctagcaacattgcaaaaggatgttgtaattgctgtaggcagcgccctttggaggcctctctggcatacagaagcccgaaagcaaaaatcaaagaaatgattgcttcctgtaattatttttgtagccatgttgctgagtgcgacacatgcatctctctctttctctacagaaaggcacctccctgggcctggtgggtattgatcacaatatccctgcccaggatttatgtcaatggatgtgtgaaaatcactgatcccataacaattttgacatttatgtagggataattgctgcctcctttttgatcttagataatctttactatctgaggcatactctgggtgcatccaggtctctgtgcctttaagtccaatggggctggcttcatatactcatgttgatttaatttctcatctttctccccaggatccttttctttcttgatatattggaaataccacttttattctgtattatagttactcattccttctcacattcctacacacctttccctgttggactctcatgcccctttcctccccagccttcaagaaagacaacatcaaagccagtcactcatggaaaaatgcctgttcctttagaaggggggacacaaattcaaatgtagtcagaggccaagcagaaaatgaaaatgagggaaacatgtaggtgtaaaattaaacaataggaagtagaggggcctggggttagactgaagaggttatgccctctgtatcagaatcttatttttaaggccagggaggccaatcaaaatgtgtcttttgggtgaatctggccagttctccctgttgaatctatagagcactggatgatctcaaagggatcctcttgagacctttaaataacgtatgtcactatggcatataatttcccccataaaatgccacaaagtatgtgaaaattttaagtagacccttcagtactaacaaaaatatgatagtacaactaagttggctagggacactcagcctcacaatttgaattggtatctctaccaaatcataaattactgtgtgtaataaaccagtgggttgcttgcaaatagtcaaaactattactgataaatcattcaaatgctaaggaggtactagcttcctttttatcctgccactagatctttatacatgttgtttcccttgaaggaatgttctccccaccgctaccctgaaccttccctaacctcttattaactctaacttatcttttctaccttagctaatattttttgcatcttcagggatatcttccctgattctctcagcctagaaccttctcactttgatttgtggtatttacacttcatgagggtgattatttgatgaagtctgtcttggctgctagactggcatgcgtgtgctcactattttatccccagtccagtgcctgctccatggtgctagttctgcactgaacctttccctattgttgaataaatgaataaatgaattttctgtagacatcttttttttttaatttgaagtttttggattttcttttttgaggtgaaattgacatagtataaaattaaccattttaaagtaaacaatttagtgacgtttagtacattcaccatgttgtgcaaccaacacctctgtttagttccaaaacattttcatcaccccaaaaggaaacagtgtactcattaagcagttgctccccattccctatttctcccagaccctggtaactatcaatctgcattctgtctctatgcctctacctattctggatatcttatataagcggaattatacaatgtatggccgtttgtatttggattttttcacttagcataatgttttcaaggcttatgcacattgtagcatggatcagtacttatatcctgactgagctatgactgaataatattccattgatttataaacacaatttgtgtatccattcatccattgatgaacatttgagctctcgacgaaaagcgtcaaactctgtaaaatatttgaagagatttattctgagccaaacatgagtgatgattgcccgtgacagtgccctcaggaagtcctgagaatctgtgctcaaggtgactggggtgcagcttagttttatacattttagggaggcataagacatcaatcaaatacatttaagaaatacactgggctgtgcgcagtggctcatgcctgtgatcccagcactttgcgagaccgaggcgggcggatcacccgaggtcaggagtttgagaccagcctggccatcgtggcaaaacctcatctctactaaaaatacaaaaaattagctgggcatgttggtgggcacctgtaatcccagctacttgggaggctgaggcaggagaatctcgcttgaacctggagatggaggttggagtgagccaagattgtgctactgcactccagcctgggcgacaagagcaagactccatctcaaaaaaaaaaaaaaaaaaaaaagaaatacattggtttggtccagaaaggcagtacaacttgaaggtgggggatggttccaggctataggtaaatttaaacattttctggttgaatatgtctaaagacctgggattaacagaaaggaatgtctgggttaagataaaggattgtggagacccaagttcttatttatcagacttaaagtctgtgttaatgttaacgccagagatgtataatgatgcatgttagaccccccacttcccatcatggcctgaaacagtctctcaggttaaattttaaaagagccctgactgaggaggaagtccattcagatggttgcggggccttagaattttatttttggtttacggggctgtttccaccttttgtctattgtgaatagtgttactgtgaacatgcatgtgtgtatgcttgtttgaatacctgttttcagttcttttcactatatatctgggagtggaaatgctgggcgattctgtgttttagccttttgaagaaccaccaccaaaccattttctacagtaactgcaccattttacatccctaccagcaatgtatgggagttcagatttctccacatttgctccaacactttttgttttccattttatagccatcctagtgggtgtaaagcgatactcctggtggttttgatttgcatttctctgatgactaatggtgttttaacatgttttcatgtgcttcttggctatttgtatacctactttgaagaatgtctattcatgttttttggccacttaaaaatttaactgtttgtgttgctgagttttaagattttttctaatatattctggatactagatccttatcagatatatgatttacaaatattttttcctgttttgtgggttgtctttttactttcttggtgatgtcctttgaaacataaaagctttaaattgtgatgacatccagtttttttttcttttgttgcttgtgcttttggtgtgtcatacctaagaatccattgccaagtccaaggtcatgaagatttacctctatgcgttcttctaagagttttatggttttatttcttatatttaggttgttgatccattttgagttaattttacatttgttgtaatgtgtgggtccaacttcgtcttttgtgtctgtatatgcagttttcccggcaccgtttgttaaagagactattctttctccattgaatggtcttggcaacattgtcgaaaatcaatcaaatatatgggtttatttctggaccctccattctatcccattgatctgtacgtcgcttcttatgccggtaatcacactactttgattgctgttgctttgtagtaggtgttgaaataagaaagtgtgagtgctcttttcttatttttcaatattgcttttcgcacggggtaactttttatttgctcctgactatgtcttatttctttgcacaacctcttctaccactcacagaaccaagtgtcctaagatgcacgtttcttcaaggtttcatcttttctcacagtcacaaatgtgtctagactacagttcaggtttgttgtgatttcatgatatgactactttaagactggtctgggacagggtaaattgatagaagggagctgaaatgtgacatgagcatccttctctgactcatccagacagcgtttacttaatggtccatttacttatctatgagcactgagtgtgagaatggctcccctaatatttagtacagctcctggcttttagtaggggatgactgtgcctatttagtgtattgctgaacaaagaaatccctgactaaatgtgagtagatgtcatgtcattgcctaggcaagggttctgaccccattgacaaaggacttgctggtggtgttaataaaccagttcttaaattgtgatctaagtttgatctgaaccaagaggcaaatgccatcaaagtgaatcctgcgtggaaggctggtgggaaggaatagaaatgtttattttgcaattagctaaggataagggacacttttctgattattttgcttggtagctctgcagaccactgttctaaccacattcactgagggttagaggccagttgaaatcacttccgtttggtatccagggaaatcacacctacgtacaattttgggggcatgtttccctacaattattgtttgaattctggttacacttaaagctgatgagtttcttggtgccttctatggagtgctgattttcacctacatacctgcaaatgtttctaagttacacatagaggaactatttatatttcatttgtgatataatcatggtgttttattttcttaaccattatggaattgaaggacctagacaactgggtatctgttttagacaaatgtaataaatgcattagcattgccccttcttctactcccagtaattggcattcctgctttctaaatttgtgatttttttgactgtaataagaaataaaatattgcactgtttggcactttgaagttggcctgcctgggttgttcaccttaatacttaacatccttgagatagttatttcacctttctcaacttcgttttccccctctgtaaaataagggttatgacctttcccttgaaggggagtaatatggattatgtgaggcatgtagataacatgtatggccaagtgccaaacatagtgctcagtaagtacatgaaagctccccatatacatactaaaaaaaataaataaataaaggttaggggttggggttaaccttagaaaaatgattccagatgaagagagggaaaaacctacagctgagcccatcttcagggccagccttggtctatgtctaatcttgctgctctctgatccagtgatagcatctctgcacttgaacactcaaaatgttcctgaaagggacctacattattcagatatgcagccagccacctggaccctagaatcagttttaatgtcagcaagcatgatctcttcaaaatgctcctttgagaatatcctgaattcatttagtattgtttccccctcttctgacagggcctctcttcctctttccacgcccacctcttggccaccctctcatcccagcagctgcaggcaagatttctctccagctgtccatcaagtcttcaaaagccagccggaatgtaattgtaatctattttccacccctcaatagtagcgggtgaaacacacacacagacacacacacacagctcaaaattgcaaggagaagggagccagagctacctcatgactcacacacagccctgcatggataattactgccattcattactggcccaggaaagaaaacaagggtccaattgggttttcgtgaaccacaaggctgacaagtaagagggggaaagaaggggactgtgctccctccctacagcccccctgccaatgccattttcagaaaagtaacatcctgctggccttctattcctggcgcacatcttttattatgtttatttagtgtgcagtttagaattgatactgtggccaaattctgccaagcacctctccccagaaggaccttgagccaggtccttctttgcctattttgcctattttcctgtatgagggcaaaataggctccgtttcattaattcatgtatatgttcaaccaacagtttgcatgaattcacagaaaagagctagattctgtaggaaatgtccaagctgcattcatctcaatgaagtgtgtgtgatttgctacccactgtaacccctgcctagtaacatctcttgcagccatactagggtgccatgtgctggctcatcccactgaaagcattctgtccctcctctgaattcccttggttgtgctctcatcttatcacctttcattagatctttaattgttgtggacagaaaacatcactaagaaaggggtagtatatacaaaaatacatctaatcagctttcagcagttttttatattattggtgggaaattcaattaaactgtattgaatgaatgaatgatcaaataaagaactatgtattttaaactaaatgttttgtgatggctatggggagaggcaagtcctaatgaaacaataagatttgggttagttggcagagatggaaagtccttctagaatgggaagtgttggaagaaaagcatcttgtgctggtgctgggagtgaatctctagaattagaatacatagaagactacgctacagctgtattactcaatgttgtatttcttactcagcattactcagttttgtgcccactatgctactcaagactggtccatcagtatccacgtatttcatttggcaacagtcattcttggcaggagctcattaagtgtatggactttgtactgggtgattacggacccaattgacatttttaggactatcaagttttgcttcaaattacaggcatcctgttgttcttaatgttttattctgttggtttatgattctcacaaatcagcacacaattccctatttctttcgcttctgaaaagactgaagctttaggaattagaagcagcatttaacttatgattcctgagagtctgcattattttgcagactgattgactgatttctcagaaatgtgtcataccatgtcagagataatctggagaattagtgacagtgaagagacatacaatttacttataattcttttttttttttttgaggcagtctcgctctgttgcccaggatggagtgcagtggcacgatctcacttgaacctccgcctccaggttcaagtgattctcctgcctcagcctcctgagtagctgggatcacaggcatgcaccaccacacctagctaatttttgtgtttttagtagaggtgggttttcaccaagttggccaggctggtcttgaacttctgacctcaggtgacccgcctgtctcagcctcccaaagtgctgggattacaggtgtgagccatcgtgcccggccttataattcttaataataggggtaattttaactattgcctattgaatgtttacttcatgtttgacagtgttaaatgttttacatgaatcattttatttaacactcatttgatttctgtaatatatgtaccattgctatcgcattttacatatgatacaactgaggcttagaggagttaggaaattgcccaggctgatgaagatagtaagcactagaactggaatatgaacccaggcaatctgacttcagagcccacactctgcaggctctcctagccttagcttatctctgtgactggaaccctgatcctgacagatatctggaaaaaatcacattctttgtctcctaggatctaggcagatcaatgcaaatgtgatctcaaaatgacacatgtctgggctatttcagagatgattccaaagctgatttagtggattattttttactggcatgattactattgattgttattgtgttcttagatgaaataattggcctagtattccatattcccatatctcacagtgttatgatcttcaaaacttcagccatacatgcatatgcatatagacacatataaatgtgtgtgtattaatgaagtatatgtacatatgtgtgtgtattaatgaagtatctgactttaaaagctaattaattattttagatataacaatttactgaattatttccaaattactctgaaaccaaggtatttctaggaaaatcagctgaagttcttaaaatggtctttaaatgaatcatttcctcttccaaagaatttgtttttgttcctaagagcaattttccctcactgcatcttctgaatactcataaaatcttcattttaaaatctgaaaaggtcatcttatctacccacttatgcctgggcaggaaatcttagaagatcatattactgtttttaatgacctatggaggatgccatgccacctattttggcagtttattgcctttcctaataatctagctagtcagcaggtacttcctgatgtgtgaacaaaatgtcttctgctgccttggcttattccatttgatggtcatgagactaatgttatcttattcatggtccttttcctaaggccagaaaatcacagtatctataactcagtcgatagttatggtcacattctaattccttaagtgcctccatcttgaacagtcctctgagtcccaattgttgtaatgtgggtgaggtgctgtgagcatgccatctgtttgcgagaatggtgccactgatggctacacatttgacactgaagatggcactgctcatctaaatcaaaatttgggacctatagaagctggctgcagacacctgcattgactctcactttgtaaagagatgtggccattggatggaaacatgagcctggagtgtcatttgtattgcatttttgtttattgaggataactgctatactcatctttgtataaagcatggaagtaataggatcaaattaagaaaaactacttagatggaatagcagggaagtttccctaatgaaaagatctgatagaccatggaatagccttccccaggaaggctggtctcattgagatgtggttattaccgagaaaccaaatagtcccccactggatgcatcttgggcgatttgcattttggtttgtgactttgatttaattggaaaagtatctcacatctgttgttgactacataagtctgtttcccaaattctagttatgtcacagttgcctagcgaacttgttaaaatgcagattcctgggccctgttcccagaggttctgtttcattaggtctgtgatagtctgggactctttgtgttcaccaaatttcctggatgattctatgcaaagggctgtaaactctgttttgaaaaacatggagttagggccattttgggaagatttcagatctgatagtaagtgtatctgtgtattttgatttgtcccttatcctcatcctaatactctagtttgccccatcaccagagtcctcttctgtttgcagataggaggaaatgtttggtgaaagaccggaggttgctaagaggagagtatttctccaaggagccctaaccttactcaagctggcattccctgtgcttcccatgaggcagcttactatagggtagtgtttttcaaaattctgtgggaatttattcttaaaaaggaggttccatgatcagagaagtgtgagaaacattgtggaaaacaaaggtaaccagatgctttactgcaggatttcctagagtttttatcgtgataaaatcttcaccattttctaaatttttggtcacaggatttctcatgggactactgattcatgggacgcattgaaaaactcagtgagttgaaagcaagaaaaattagtttataactgctacttttcacccaaataatagagtgaccttggatatgtcctttattttcctcaagtttgttttctcgtctgtgaaataagagtaatcatgccaccttacctaggtcatagggtcattttgaggattgaatgaaatacatttgtgacagtgctttgtaaaatataaagcatcattagttgtcattgggaaactaactagttgcatacaagtttggagagtagagagagagcactggacagtttatattcatctttgcttagactttccttagattgaccaaatgggactgaaaaatctggtctgtttacttcaccagggtttgtcttaataccatgttaatggttaactagagattctcttttactactttctaaattattccactgacacactgatttaactaaatattatagtccttaataccttgtagtcaatgcagatccaggactaggaattggtggcacatggtgaaggagatgttcagggctatgagccaataggatggggagggctaggactgggaagaactggaagctaggatgctgatgtggttattgggctgtaccccatgatgtgagtggtctcaagcgaaatttccttgtcttgaagattttggccaaacttggggtcaaataagtaagagtcatatataagagatccagtatagtgggtggcaagagcagagcaggaggtacctctatgcagagaagacgtatataaattcagtagctgtggtgctgtaattctgagttgttagtgtgggttggagcttgatgacaactaacacccaaaggtatgagaatcaaggtccagaccttctggagatgaggccaaaaaaatctgtgtcatgtgtcgaaatctcaccaagtgagcttagtattagccctagtggtgtgaccatagtgtaatttagcaaaacaatagggaaacccaaatatacctatggaacaagcatagtggaacttgagaagaaagaataggaaaggctgaagaggtcacatatgtggggctaatctttcttaccccagatctcaggtttagggtacaaaactaatttcagatcatgtctgctaggatgaccaaactcctacatcagcagtaataatagcaaaaggttattgggatgcttattttatgacaggctttactctaaacactttatgtagtagctcaattctcaaactgcactatgagttaggcacttgtagtatttgcattttctaggttataaatttgatgtagagagaagccaagtaaattgttttagttcactcagctaataaatggtggtgtgcagacttgaattcataaagcttgtctccagagctatgttctttttcaccattttaggctgcctccatcccaccccaatgatggtgaaaagtataattgttgaaatgaaaaaaattaattatggatctcatcagatttgagatggtaaaagaaagaattagtgaatctgaagagagatctatagaaattaaccaacctgaagaacacagagggaaaaaaagacattgaagaaaaattaacagagctacaaagacccatgagacaccataatgcattacaacatacatgtaaaggaacttccagaaggaggtgagataaatgttcaaaattttgtttaaaaaaataagaggtccaaacattccaaatttgatgaaaacattagtctacacaactgaaaatctcaacaaacccaaagtagcataaatacaaagagattgagacctttacacatcctagttaaactggtgaaagatgaagagaaaatcttgaaatcagcaagggaaaaatcaattgatcatgtgcaagggaaggtcagtatgattaatggctaacttttcatctgaaaagtagaagtcagaaggcagtgggatgacatattcaaagtgctgaaaaagttgtcaaccaggaattttttatgtagcaaaattatccttcaaaaaaaatgaagttaaaataaaggaaaccccagataaacagaggttgagagaacttgttgctagccaacccgccttacaagaaatactaaaggttgtccttcaggttgaatagaaatggtaactgaagtccacagtaagaaataaagagcacaggaaacggcatagatgtgggttaatatgaaagattctttaaatatatttttctcattttctcagccctcccccgccccaagtagctgggactacaagcatgcgccacaatgcccggataatttatttttagtttattttttgtggagacaagttctcactgtgttgcccaagctgatcttgaactcttgggctcaagcgatcttcccaccccagttcttccaaaatgttgggattacaggtgtgaaacactgtgtctggccagatgctattttataatgaaaatataagaagtatatttatttgtggcatcacgttcataaagcagaagctatgaaaaatacaaggagatgtacattggttgcaaaagttatttaatgaacctatctcattttgtgagaaatagatttaaaaattaagatagatataaaaataagcaacagtgtatgtttttgtgaatgtttcatgggcacttgaaaagagatgcatcctctaatttcaaggacagggcttgagatatcgattggtatacacttagttttaaatataattatatatttatgatatatgttatgtatgtcatatgtaaatattatttacatatatatatgtgcttatacctgctatgaagtctacagagacattctcaaatttcaaaaatgtaagtagtacagacaacattctctgaccacaatgcattacaactggaaataaacaaacaaacatagaaaacaaaaagtccttaccacctaggtatgaaaaaacaaaaccatctttaacaggtcaggtgaaaaaaatcaaaatggaaattgaagaatacatagaaaataacaattttcaaagtactgtataaccaagctgggtgcagtgtcatgcacctgtagtcccaactacttgggatgctgaggcggtaagatcacttgggtccagcatttcaaggctgtagtgccctatgatcatgcctttgaatagccactctagtccagcccgggcaacataatgataccccatctgctaaaaaaatcgagaaacaaacaagaaaactccatgtcagaattaatggaaaatagttaaagcagggattagaggcaaattcatagccctgaatacctatattaatgatccagaaagaatgaaagcaaatgaattaagctttccacccaagaaattacaattttaaaaaatctaaataaaacataagaaaggatttaataaaatagaagtagaaattactgaagcagaatgtagaaacatagtagaaccaatatataaatcatgagctttttcgggacaaaaataataaaatagatcgtttattaactaacctaatcaagaaaaaagagagaaagtttaaatatacaaaaaataaaaagagggaagtaactacagatacagaggaagttaaaagaactacttatcttagttccttgcgaatgaacttgaacaccttaatgaaagggtcctttttctaggaaaatataatttagtgaaaagaaggagaccagacagacaagaatgcagcattattcactagtcattcacaactagagtgaagtgagagagattacagtttcttctcaggcatgtctgggacatgcctgaatactcagtgtgtttctgatgacttaatgttgatgtatttatttttcatcttaattaagatgcagtatcagtgatacacttccccagtttctgaaaattcttgtgtaaatacacttgctggcactgtgtgttcctgctagaagagtaggccgggtgcagtggctcatacctgtaatcccagcactctgggaggccgaggcgggtggattttgaggtcaggagattgagaccatcctggccaacacggtgaaaccccgtatctactaaaaataccaaaattagctgggcgtggtggcacgtgcctgtaatcccaggtactcaggaggctgaggcaggagaattgcttgaacccgggaggtggaggttgcagtgagccaagatcacgccactgtgctccagcctggtgaaagagcgagactccgtctcgaaaaaaaaaaaaaaaaaaagagtagcagcactataatatagcacagttcctccaccttcaccccactcccaccccaggaagtgacaacagattgatttttgaaaaagaaatctacgaaataaacacttatctattagtctccagtatcctccttcctatttctgtcccctcaaaaggttgctaggcaaccgggtaggaaaaaatgtccaaagcccttttaaagagaagacatgcttacaatgtcagaaaaataaatgtgtgcttgctcagttaggcccccttacaaactgccaggacccgcagcataatccattcagtagcaattattgcaattgatcttgaggttggtgaaaacaattggccatattctggctcagtggagacatgacccaagccatccaggtgtgagagggggtgctgctgtggtgtcttttgcccttgaaagaggacgaatgttcggtagttactgctggggcctctctgcccatgtgtgtgattctattcttgcagttagtacgatctctataaagcctttgtagcgctcactgttgttgataaccagtcttcctcaggaactgctactacatctcctctggcatttcatatatccacctgactttaaatggagcctgtcagcctatgcttctgtgggcattggcatgcacatggtctctggtgatccaggctcagattgctctaaggaactgtacagccttcctacctggtgtgtgtgccagggtctgctcatggtgacaggtgttgatgttcagctgctaatttcccccattagagacaatgtggtaggatctgatggtacaatctgttcatctgaggtctgccctgattttttctgtctagaatataatgctaactttatggaaacaataaaagaagaaatagatgcacaatctgccctttaaatggttttgctttgttgaggaaaaaaaaatccatagtagtcaatttctttttgtctattacaaatttattaacagtgtgtcataattaggtgcatggctttgccttagaggacaaatggtgcttgttgaactgtgacgttggtcttattgtggtaaaatgacccatttggttttaccagctgtgactttggagggagctaaatgacagaaaacacgtaaaactcaacagatgaaaacattctcagctcatactctatcgctgatcattcagcatctcaaacaaaatgttctttggatttgcttgctagtgtcttataatctgaagaatgctaatgcttaagttgataggatgaactgaagaataatatgcttgagttgatgcttaagttgataggatgtcagaagggcaactggcttatcatatcaggcctggattccccattaatatgatataaaatgctctagcagaatctaaagaagtggtgtctcattaatcaagaataaatcccaaatgcagaaacaagatggttgtaattgtggactttggaattgggctgcctgcatttgaagctcggccgcaccattaccagcttctgaacttctctaagcctctgttttcttatctctaaaacagacttgtttatcttcctcatagggtttatgtgaggattaaatcagcacattattagcacagtgctttcacatagtaagtactcaagaagtgagttattattatctaataacttattattgttagctgttgttattattatcatgaatgactcaggcttcagaaatattagactgcagaaaaatggtccagcttataggaaagtcttgggttcctgactggacctaaaagagccagggggagacccatgaatcagctccctttggctgactccctatctttgacttagcactcatgactgagttggtgagaaattggggcccagaagaaaaaggagttccccttttatggccatgatcctggcaaaagagcttcgaatcacgtggactttcactggttcctttacctttctatgttgggcgaaatcctagaggcagagcgacaggaaagagtcagaaaggtgccatgccacctgactcttcactttttcagctcatacaacattggaatcataggaacggaaacccataaagagattaagtctgtatttgtggccctttcccctcactggcccctttgctggatccctttttctacatttttattcttgactgtcatttatcccaaggaagttttggtcaataaaggtttacaaaaggatgcctcacagaacattcccatttcaaataaggaacttctggattgaaaaactatgagtcttaatgaggaaatttcatgcccatcacaagacatgtctttttaagtaggggaagagggtttctataatctcttctttatctctcaaatatatgcaagtgctcctaatgtcggaggagactggactcagtcagttgacgatagcttgaagttgcctattgcaagccccaaattgaaattccttagaagctggttttttgtctttttttaaagagcgttgtaacattcctggcctctctctgttttctaattcacttcgttcctgcacttttcagcgctgaatctaccctttgctctgctttgtgatgctggagtggacttggtgaacatttcttctttgccatgtggcagatattaagctttgtcagcagagggcactagaaggccactgcaggaggaaagaacgctcttgcaggtttcagtgtgctttttcctaattgcttctgtggcctttggctctcagtggcatttgggacaccctgtggtgctcaccctccagcgaattcttctggcacctaatctggtggcttctcaatgaatttcaaaggcaccccagcaggtggtcttatgcttgccagccctggcttgtctcacctcagagaacttcaccacggaggcccatagtgatagcctttccactgaggcctgaatctcaggcttgggtttgggggcaggggctcttccaaatttgtttcttcttgggtactccatctcagtagaggtagcagctgcttccaatacctgctatatctgtattctttagaactctctttactccttagtatctaatccgctgttacaagttaaacattcttttttgttctgtttggtttggtttttttttgagatggagtctcgctttgttgcccaggctggagtgcactggtacaatcttggctcactgcaacctccgcctcccaggttcaagcaattctcctgcttcagcctcccaagtagctgggattacaggcacccaccaccatgtccggctaatttttgtatttttagtagagacggggtttcaccatgttgaccaggctggtcttgaactcctgacctcaggtgatccacccgcctcagcctcccaaagtgctgggattacaggcgtgagccactacgcctggcctaagttaaacattctttatattaaattttctttgttcaaatttctggtgtggtttccgtcttttgattggacccaaactgatagatgctagaggatgagaagtgatgtatgcagatggtgagtttggggaggaactggtcgtgcatggtcctgctctttcccttctgctttcttctggaagttagcctgcctgcttgattgctctcagcgtagttaagctcaggggcaaaggctgtgttcctgactgaggtacctgtggtggtccagcccagtcccaagactggccagataagtctatctctacctctgcctttcagtttgagaaagtccactccctgcagatgaaagctacattctccaagatcagttctatctataataaaggtattattttggaccttatctgctgactgtgttcatcgtgttcagaatccaggtagggagaagtcctgtttttattgccactcccctttccccaacaattttcatataaaacaactcttttaaaataacttgccaccagaaaaagtgattgataagcacggcatgtttaacctttggctttaactataccccggccctcccccataccactgtggtttttatcccaccacacatataaagcttttttttttttttcttaaaatactaatctaattgaggagtgattctacatctctcattagacacactgtaatgatcaccttcaaagagcacacttccaaagaacccatgtaaacagtccagaatttgatgatggaaaagcatttagagaacaacatgatctatttgaaacacatctctttaaaataataatttttttaaaaaaattatgcatttacaaatgtgtgtgaaaaagaacagggttgtggtttccactctatatgtgaaggaccacctaggaaaagggtcgttagccagtcctggggcaaggtctacttccctgacacactggacaataacagttggaactgatgatattgccgagttcttattgaaggaggaaattaaagaatggatgtcagtaaatgaccacattggctcagacaacgagccacacacccacttgtcccctccatcatctctattgacatggcaccttctattgtccttgactttctcctgcactcttcatgcatggctgaattgcttatgcgtcctgtgtttgcgtaaggagagtacagtagagggaaaggtaccccaatgtgctttagagataatgagaaaatgtgattcatgccttttgtgaacacttacattttgaggtagtggtcaaggattaatagagcttggtgacacccccaaacctctgcaagtcattcccacaggcctggggtaataatacctgatatgggaaacatgtaatcttcatattctgggatggcctttgaagcagattggtgctgggctggaaagccagaggacgtgaacacctgtcacttactgactatagtggttaggaatggtttattatgaactgggtgattcaatgtagtaactttacattttagtgattatagcctaacattgcaaatggcattatttaaggtataggaccaaacaggtcattaagaatcagaatcaaaagaatcaacaaggctgggtgtggtggctcacgcctgtaatcccagcactttgggaggccaaggcgggcagatcacaaggtcaggagatcgagaccatcctggcccacatggtaaaaccctgtctctactaaaaatacaaaaattagctgggtgtgatggcacatgcctgtattcccaactactcgggaggctgaggcaggagaatcgcttgaacccaggagatggagattgaagtgagctgagatcacgccactgcactccagcctgggtgacagagcaagactccttctcaacaacaacaaagaagaatcaacaagcttgaaatttaactacaagcttttgcttttctccttactacctttggtaattccttcagttactgtaaagtatcatagttattaatcatagaagcttccctttcttagacagtggtaatctaaggctgagatgtgatctaggagcattttgtctttgctttcttccagacatttccccatctaatgttctccttacacatctcttcttctcttccttttccctactttaagggattgaccctgattgggaggtgcctttgtggtggatttagcacttagcatggatatcttttctaacctggacgaatctttcacatttaatgacggtatagtatgtagcattgtgatactgatttctgtttcattttcatatcatctattttctaattataaatgcctccaactatttctgtaattttttcaaatgttttctctagtggaattattagcatatatatatatatacactatatatagtatatatatataatgtataaatatatatatttgaaagacagtctcactttgtcacccaggctggagtacagtggctccatctcggctcactgcagccccgacctcccaggttcagacgatcctcctgcctcagcctcccaagtagctgatactacaggcacctgccaccatgcctggctaagtgttgtatttttagtagagacagggttttgttgtattgcccaggctgatcttgaactcttgagctgaagtgatctgcccgcctcagcctctcaaagtgctaggattacaggcatgaaccaccacactggccacatatgcatattttgaatatatcttcgtctgtgtcacgtatgctgaggttattacccagggatacccaccactggaacgaggtagcagattcttgcaagtggaacccagcaataaggttcagtgtttgtagctgctggaatcgaaccactcaaggtcactatttacagtgtgttctatggagttttggcccacagagcattattcataatcctgtgggaccatttgctgattgcttcctccttggctgtagctctgttgcccccactgctctgaaattgctcactgagccacccccagaagatgcggcagtatattctctctttgcattcaagtttcttggaaggatactaagtgttcatttgtcagtgcttttgccacctaagagatattttaaaagtttgaaatcccatatgacatgtggcatatgtaagccatttcagccttctttctaatagtaacaaaaacagaaacaacctaaatgttcaccaatacatgaacggctaaataacctatagttacccactctgtggaatgccatttaggtatgaaagtgatatggatgaactttaagctgtattactgaatggaaaaaaataagtaccaggacatttttgtggtgtataatcccatttctattgggattatactctcaactatattataaaaattataaaaattaaggccgggtgcggtggctcatgcctgtaatcccagcactttgggaggccaaggcagatcacctgaggttaggatttcaagaccagcctggcccacatggtgaaacactgtctctacaaaatttagccgggcatgatggcaggtgtctgtaatcccagctacttgggaagctgagacaggagaatcacttgaacctgagaggcagaggttgcagtgagccaagatcgctccattgcactccatcctgggcgactgagtgagactctgtctccaaaaaaaaaaatactactactactaataatatattgtccaatttatattgtgacatttacttacaacacagaaaaacagtgtgtgtgtgtgtgtgtgtgtgtgtgtgtatatatataaaatatttatagcagatgctacaaattcatgtaataaaaggtctaaaagaatataacccatactgataatggggaggagactgtataatgaggaggaattttgctttttattctctacattccactattggggattttttttttctctgtcgccaggctggagtggagtgatgccatcttggctcactgcaatctccacctcacaggttccagtgattcttctgcctcagcttcccgagtagctgggattacaggtgcaggccaccacacctggctgatttttgtattttttttttttttttttagtatggatggggtttcaccatgttggccaggctggtctcgaactcctgacctcaagtgatctgcctgccttggcctcccaaagtgctgggattacaggggtgagccaccatgcccagccagggaatgtttcttacacttagatgaatcatgtattacaattaaatgtaaacttttaaaaataattaattttgaacaggtaagatgtgacttagggagaaaagcaaatttaggaacagctggggcaagacagagagacacagacacagacacacgactaactattcaactttattaatgggatttaccaattgtaatcagaatggcagctctgttgctgtagttaatactatcagaacagttaattacactcaaatgtcttgctttcttgcttttatgagtaaggaaatagaatgtttttttaacacattcctaagtgtttaactggatgttaacaattgtttcttagttattatacttcattctttctatcttcctctgttattccccttctcccctaacaccctcctcccctagttagctgatttatgtcccatctgtgaacagaggtcctgctttaaaattcacaactttcaggaagcccttcttaattaactgtgcctcactgagaaattttttactcagcatctccttggtgagtgtgctttaatgtttgagggcttcattttgcaccttcttgaggcattgcttgctaactggttttctgtcattttttttgcatgtatgttctcttaattcatcttccaaagtaatggactcttcacgagataaaatacagaagagtgaggtatatgggcattggagacagaaatacctgaatttaaaacctggttcttccaatttttgctgaaagttttttagaaaatttcttcttttaagttgcattttcttcacttgtgaaactggaataattcctatttaataggattattgcaatgtttggttgacctacatgtgaagcacttggcatgaagctttgtgatagtaagcactcaacatatgatggttattggtattcatctccttctgtctctgacccaccatgtatgtgtgtataatggttgtgacatcagctaatgtctacaatgaggtttaaatcatgatttatttgctcattttggttatatatattcagggacctggcgacatttgggcttcaaaagtagaggaatgaggcttatattttcaaatccaaatcaagtcaatactcctttattcttcaaacctgcttgctctgaataatttagttggaatttgctgatttccgaaagagctgttccatatttgtctaattttatgctactttgaagaccaagtcatattttgtcatatcaccatttcttggcctacctgcaacatgtatatgtttgtgtgaattcattcaaaaaatttaccgagtatttctgtgctgggcactatagatacacatgaaacatgagtaggagcctgccaggtggacaaattagggagagtattctaaactggaggtacatcatgtgcaaaggccctgaggcatgaaagaataggacctgttttggagctacaagtactgtgcagcacagtgctacagcatctggtgagcaggtgatttaagatgaaatcaagtagacaggtaggtggcaggcaagaccatttgtatatatcatgcaaaggagttaacattttatcattctggcagtgtgcatctgctgaagaattttgaggaagaaaaccatgaggtcatatttttatgttataaagaaattccagctaccaagtacaagagggattagaggggtataaggtagagggaaggagaaaaacaagaaggacattggagtagtatgggtatgagatgatgagtaactggactaggatgtgaaagaggggacaggttatgagtaggggatttaggaagtagaactgagaagacttgatacttgattggtgtattagttttctattaccgtcataacaaatcaccacaaacttagaggctgaaaacaacacaaatttgttatcttatggttctttaagttagagtctgccatgggtctcagtgggctaaaatcaaggtgtcagtagggctgtactcctttcttaaggctgaggggaaatttattttctgggtcattcaggttattagcagaattcatttccttgcatctgtagaattgaggatctcatttctttgctagatatcggctgaggcccgtttccatcttccagatgctgcctgcattccttggctcatggccacttcctccattttcaaaggcagcaatgacgggttaagtccctttcatacgttgaatctctcctgcctcttcttttttctttctgcctccctcttccactttaaaagactcatgtgattaagttgggtccatccaggtaatccaagacaacctccccgtctctaggacctttaccttaattacataaataaagtccctttgccatatgaagtagcatattaataggttctgaggattagaatgtggacatctttgagggagccattattctgcctgctttaattggatatggggttaagggagaatgtagaatccaggtttctgacttcaacaaccgggtgggatgcagccttaagaaaggaagatgtttggttttgaacatgttgaccttaagatgtctctgggaaatcaaaatgcaaccatctagtaagtagtcagatgcaccagctaaaaggcagacaagaaatcaaggcatgttaggaagctgtcaacatacagtaagccctcagtgaatgcatggaatgggaagagaatagggagaaaaacaggattctgggatcaataatgttttagctgcaacagagagaggagcactcacaaatgaaacaaaagaataacctacatggtttcccttcactggtgttctttctgggttgtgagagaattagaatttatattgccagtccaaacaaagtattgcgaagtcttcaaattcattgggttttcattatatcagataataatctttcacaagatcttgctttactgaaccaaagtaggatgaactccaggaaaggcaggacatttacaggatcaaatgaggttctcttaaccaacttgctatgatgctgggcttcaaagaagatgtttccttgtgtggtgtttatgtgaagccatagagggttggtggtgacctgggtgagtggtggtttgctgccattctcctcaggccaacaactaaacaatacccctttgcatatttcctgctgagaaagagactgaaaacaggagggtacattgttctctatactaaagtggatattcaccatccatttcatattggacccttgccaggtcactctctacttatagaagagagatgccctttccctgctgggctggccagtgttgagcctactagtgtcatttcagtcaaatctactcagtctctctacaaatgacttagtcatggtgaactgctttgggggtgaatgaagtctattagacagtagattgcttaagcagctcttctctgtgggactgaccttagaacagaatgatcaggaaacctgagaagatcaaggaaagtgcaaatcctggatacggctgtagagatgatctaggataacggactcactgaaagatatagcaccaaagctgcccacagaggtgagctggcagggcatgtaaaacctcagatagccacaggcagtaagaactgctcagtcaaactaggactgaagctgaacttatgtgatggtggtactagggaaagatgaaggcatatgttgttgaatggagtgaatgagataaagaggcagcctcctcctttgtctctgatccagcagaagggggaaaaaaatttaactgctattctttctgggtaatacacagataatttataggtttttgaattataagatatgaagggtaactaaattcgtatgcagaacagataaatcatctccttcctctaatcattcttccttctcatcttatccttcccccctgctctctcttcagatccaaaagatcatatatagtctagcctcaacaaattaggttttttggacatactatgcttttttacatccttgtgtcttggtacgtattgttttctgagcctaaaatggcttcactctccttctctatcttgaaaaatccaatctaattttcagaagccagctcaagtttatcttctataaagtcttttgagactccctagattgagtaagcagcatcttaattattctacccacatatggtgcttgtgcttctagtatatcacttaccatattatgttctaatcatatggtaggaaaatactcggaaaggttatctgactgaggattagactcagctgcatgtaccagtggcttgaagaagatggaagtttatttctctctcttagtaaggaagattagggggaagcagactagagctggtctggcagctttgcaatgtcataatgaatccagttttctatctgtttgctttgtcgtattcagctcatagttttcactttcaagttcatctgatgtccacaatggctgctcaagctctagccatcatacccatgctctaaaaagaaagaagggggaaggagaagaatggcatgtctcccctcttttaaggagactttctggaaataccatataatacttctatttatatatcattgactagaacttgatcacagaaccacatctagccgtaaggaactcaagaaattgtaatctttattacggcagcagtatgctgaaataaaaattgtactataagaaatgagaagataatggatatcgaggggcaaattgcgatcacattatctgatgtatatttatttctggtaattcttgctgcttcccattcctctgcctattgaatctgagcaatccatggctttaggaagcagttagaatcaaggtaaaatcaaggatcacatatgatggctttaaaatttacagccataattcatgtgtgcagaactgtcactttcttcattttctgaacttgagttgccgacaagcccttatttccatgtattgctagaaaaaagtctcatcaattaaaggtaatatagtcacttctgttttgaaatcagatctcttcgtggtattcaagcaaatcagggctcttaccccatccccacccctctttttttttgccctctcaccaagaggttgtctgcttacctaaagttctttctgccattctctcattctctcggacatccaattattaggtatggtatatgtctgtctccttctctacccaggaacttcacggagtctgggacattgttttgactgtctgactttctccagtgcttattgcagaagttgatacataggagatagttaaaaatgtgactatgaatttatgagtacactttaaatgcatcacataattaatccaaatggtaccataatgatctgaaaatcctgtacaattaaacgtctatttcactaaagcccctagcactatgtttagagctttcttatagcactaataatcctcagctctgttatagtagtttgtgtgcttgcctcacccctcattagggtgtctgcttcttgaagaatgttcctgatctttgtaactttcacaggtcctgagaaggccagggacatagtaggtcttcagtcaatgaaaatgaatgactacaggaataagggttggcactttataatctaccactaaaaaatgactctcatatgagaacaaacagattttattagagctatttagaatgatatcaataaaaacaagttgatattttgcctttaatgaaattcttctttcttaagaaaaaattgctgttattttttcagaaatcctccacctactttacttcatccagaaaaatggtgtgaagaattcaaccactttatttcacagtgagtatttcttccactaaaaattgcccatctagcaaggccttgagcagtgattggagaaatccaggctgtggaatttacttgacactagaggttgttatgcctgttagcacgttatgactcggggtttgttctagtaaatgatagaagatgcctttgcaagatgtgaaaagtaaggcgttccatttgactctcagttataataagtccttcttatcatatgggtcacatttatctgagaacctactttgtcttagggcaaatattgacaacttgtcatgtttaatggggagagatgaaacatctaaaaatctgatgcctacattaggaccaaagagaagacagaaggtagcagcctccaacagagtttttgcagtgtgaaagttgggcttcctctaggatctgtggcatgggaacaagggtccagtttccaagatgatagagggacaaagtagaatctcaggcttggggtaccaaggtaaggtatcccagccaaggctcaaggtatgaggaacaaaatgaaggccaagatgatggtgtgacatacctggtaggagctatgtcactaggcaagtattgctgggactcagacaggagcagaatcaacagtgaaaccaatagtggctcagtgctggggtcatgggcttttggaccacactggtcctaagtctgagaaagatactcagactactggaggaggttacagggccccaagctaggggcctggtgaattgaggggacaggaatctagaccaggcattaccaaccataccaaggcagaggagcttggaagaagtcctgtaggatctagtatatgaaacaaggtgttcagaggtcgtgggaggagaaaagaagtgaccaaattagctgataaataagaagtggggaagggtcaacacaaatttttctaatttatgcctctgtgcaaacttagctttcacaaagaagccaggcaataaagcaaagtgggtcttttgatcatcttccttaataaatcacaatacagatcaacaatctcttatccgtatttccaaaatccaaagagctccgaaagataaaagttcttttgtagttgagtcatttagcagcaaaacctaaccttatgtgaactgatttgatggtaacatatgaccttaactgtgaggctatttatagttgttattcatcttacttgatgtgaatattcatgtgtttggcagcagatatatttgtttgattatagtgtgctgccccatatcctgctggggctgttacataatatacagtaaatgtaccagtttacctttgtaaaatttgataaaattctgaattccaaaatacatttggccccagggggtttgtgtaaacagctatgaacctatatttcagtttcattttcatttcaaatgtagtatagttcagggtccctgaatttgtttgcttttcctatccctcctggacttttgccatgttcctcaggaaaggggagtggaaaagaactcaaagacccctgctaagaaagactgtgttggaacatgaccatgaagttgaaggtcaggggtggagggtatctcgttgcccctttagccccacgttgacatttttgtcctggctgcagaatgcactaggagcagccaccagtcaaaggtgatggtgtcaggccatgttgagaggaaaaacagatacttgtaggagggatgatgctcacataagagcagtggaagagccacttccagaggtttgggacccaaaagagtaggtggagggaactaaagggctgaagacatgctggtagcttgggaccacatttcagaccaccccaaggaaacaaatctgggagctaaggttccaatgattttgctggtaaaggctgaatccaaagatttttccttttcatttcattgccacacacagatacccttgattgaccttgtctaagctgttgtcctagaaaaatccattacatattcactaatatgccttcccataccaaactctcctgatgcctctaaaaatgtgatttgactcacaaaactttggcttctgtatactttttcaagagtatgttcgtaatcataaactaagctcggtgttccttggatggatttgagaataaaggtatataattgatgacagagattggactgtacacaacgcagttgactcttaaacaatgcagcggttggggtgctgactaccccccaccttatgaagtcaaaaattgcctataacttttgactctccaaaaccttaactactgatagcttactgttgactggaagccttgctgataacataaactgttgattaatacatattttatgtgttatatgtattatatactgtattcttacaataaagtaagctagagaaaagaaaatgttattaggaaagtcataaggaagagaaacgtgcttactgttcattacttggaagtggatcataataaaggtcttcatcctcatctttttcacgttgaataggctgagggggaggaagaagaggaggggttggttccgctgtctcagggttagcagaggtggaagaaaatccatgtataagtgcatccatgcagttaaaatccatgttgttcaagggtcaactatgcagaaattcctccctaagatagttccttatggcaaatcctattatatgccaattcaaatctgctatgtttttcccaattctgagaatttcagatgcactcattctgagttgcaaaaggtcttgaatactagaatggagggctaaacacagaaaacaatgcctttgagtatgcatactgtcaggagcaaagcaaaaagcatcctgttgtaattgcaagggagggagagtctggaaagtttataatgagtcaggaaggcaattagaaattaagtgattatgtggtttagtactagtttaagatggaaatatgtcatcagtcttcttttttgtttaatgagttgtctttacggttttttattagtgaaaaattttatataataggtgtttatagattccttcttgacctcagccctccaatcctgttttcccataacatcttaggtgcttcaaccataaattcttctgcaatatttttgggaatatttctcaaaattgggaactgattattatattatatatctttaaatagaagcctgcccaccattcccaaataatatactttcttttttttgtttgtttgttttgagacagagtctcactgtgttgcccaggctggagtacagtggcatgatcttggctcactgcaaccttggcctcccgggatcaaatgattcttgtgcctcagcctcccaagtagctggaattacaggtgtgtgccaccaggaccagctagtttttacatttttagcagagatggggtttcaccatgttggccaggttagtctcgaactcctgacctcaagtgatctgcccacctcagcctcccaaagtgctgggatttacaggtgtgagccactgagcccagccccaaataatatcctttcattctgtagaggagactgctgatactaggctgccattactcagcctatcaaatgcagtttgaccaaatgctgtgcattatatttattcaaatctctaattcagtataaacaatgatattcactgggtttgaaatgtctatttaaagagagagccttagtttgtttttatacttatcttgctcatattaggagtcaagggaaagaaagatggaggattaagaccttcagattataagcttttcattattggagggactgggctggagaagatgattatctggtaattttaggaaaagtttcttttaacctgaattatacagataattgcttcagttccctttgtaaaccaagacatagtaaatctaactgtttctctttaaagaataaataggacaaaaagttccttaacggctttaagacctttaatactttgtcctcatgtgactactgagccgtaacagagtcgattcaatactctaggtcttttttagtccatgctggtcactacccaccaaaagatttcgtattgactgctgcagggatctgaacaagttggtctggctgcagcctagtgattatagctatgtagacagggcacagtggggtgtgtgtgtgcacgtgcatacgcgtgtaggagggccaggaaggcaggaaatcaggagcactggggatgtggcttagtgtgtttcagatttatttccagcctccttaatttagagatagtaagagagattttttaaaacatctaaaagtctgaaatactattagtaaacctgtttgggggttttaaaagaagcatcagcctgtttggttctgaagctttggttgttagtgataattgattcatttatattcattagttatgcgtttgtcaaagcatgattcctgacagcttagttatgataaattaaatgcaatgctcacataaattctgcactgcttttcatccatatgctaggaccctgcttgatgtgttttgtcacctctataatgtgtggttggctttgtagagatttcattatcagccctttcccctacgactaaagctatttgcataacaagtttatctggttcaagtaccagccagacttctgctttgtcaggaggctccattcagaagtagccttttgataagataaaaataattttcattttgtcaacttcaccttggtcctaatggatgtcacttttctttttaagttcaagctaatttcaggtctttggaatcaactacaaaaatacttaccaagtcattggtcacaaggtatttgtgagctatgctttctcattttgcctctataactttagtggttttttaggaattaaatttaggacctcatcatcagtggtccttgagccgattattgagacaatcaagatggatttctcttggtcaagggcaattccaccaatagcatcacggctgctcagctttggatttaatgatgacttgaactacatggtcacctgcacatgaactgttctttcttgaggtggctggcttgggtagtataggggagaaaaagtaatatcttttcatcacctactgtgaggttaatggctgacattcctataacaaaagacagattaacaaaagaaaagtggaacaaatttatttaatgtaagttttatgtgacacaggagccttcactcaaaaaccgagtgaaaactacttttgtggttaggtttaatgaatgatggacagttgtatagaagtatgattgaacaaaaaaggcatatgatctaatggtaataaactggggaaaacttagcaagtcctcagattcttctcagcctctctgtgtaacatttcttccttctgattatatggcaggtcacctgtcacatgaggatcttcaagagagagagggtgggagaaggtcagagggacctttctgtttttgtggttttcttaattgccttctgcttaaaatactcagtatgctgaggggccatattttggggtagcatttcctgaactgcatcagcatctagcatactggtgtgtctatttctcatttctcggagtgagcattgtggctgagccctgccatttagtcatcaaatgttgaagcagtctttcctagccctctaaatgacattcaaatgggtataagcagttgccctgaatgttaacaagataagatcattctgagccctaaaactactaagactaatggtcatttgcatatgtttattctttaaaaattgaaactcagatctggaacatttgcgttcactgtaggcctgaatgctgataaagctaaccattttggggtggttgtttgcttgacattgattgtatttccctgaaggcaacaattctcagctcttagcctttctccattttgtgtttcaaggctgcttaattccacatggctttatagtgtcaatgaacaacacacttgcagtgataaatattgtaactcagtgatgaagtttcacagatattcttggctatttacgtcttgtcggattctcaggaggccatgcaaagggttaatacttcctagagtagaaggatacaataacctttatttacattacttcacaaattcataattttaattaaaatgagcagtggtatctctagtgacagactctctccattttagatttatttaggcagtgattagctattatgatttcttgaattaattagcatctcttgagctacagggaattagtgaattaataaaaactcatggagaagctcaaaattaacacaaaaaataagttaaccccccccaaattatccactcctcacttaacatacattgatcaatatacttataaatgcaactcaaatcctttcttattttgaaatattgggattttgttttcatgagaagaacaaataaagctatgtgtgaacttcaaggttatatctccctgaagagcgtctaatttagattacctaatagatcatctaaacacaccaagggcctgatttgatctcacttataccctacttataaagtcacctgataaaatctgattttctcatagtgtaaaccaggaagcagctgagtgtgacttgaagtttaaaacatggtacccacatatacctggaatatactaggaatatatcctgtcttctcaggaaccatggtaatgtgagagaaatgaaggtttagcgtcatatgaaataagaaaaaggcatagtaacgtgggtaatctagactgttgtcagcatatcctgtttatttcctgacagatgctgggtttaaatcttgtgagaaaccagatctgtggcatatgtcatagattttatgttagtgcttgtggcgcattatattagctgacttttgtagctgctgtggattcattaagttatgtctgtaccattttctccatactggcttttctttcttcttttaaaaaaaattacacttgattttcatactgtgaatcaaaaagactctgtaattgaaataatagaaagtgagggtgagtgctgcattgtctgtgtgtgcttgtgcctggaggtggtggctcacacattcgcctctccccagagtgccgcctggatcatcaccaggaagaggcagctgtggaagagctgtgctatagtgtgtgtatccagctgtgtcacttactggctgtgtaatcttggaaagatatttaacctgtctgaccgccagtcctcagttgtcaaattggggctagagtagtatcgctgtgaggattaaattacataatgtatatgtagcacttgacaaataataataataattaacatatataactcttatgctaggcactgttctctacatgttgtataatttacttaatcctcatgattctataaagtagttctaattttatagaaattgaggtaaaaagaggccaagagtcccaagaccacagctagtacatggtggagctgggatttgaaccccagaaaacttgttccagagttcacgctcaaccagcagtagaggttatttttattaccctttgcatttggtctgtgctgctattctgaaactgtgttttgaaagtggcaatgactttctcttctttgacaccaatgtgctgtttcaatctgttgtccactgtctctttatttagacttcagctcacttacttccacagttcgggcctctaacacacacacacacacacacacacacacacacacacacacacacacacccctctccaccccttctcaatggcaacagctccctccacctgaaagaattggctgcaacaggagtcaaggcagagtcaagccagatgtggtaggcttacgactgtaatcctagcactttgaggggctgaggtgggaggatcacttgagaccaggagtttgagcctgggcaacaaagtgagcctgtctctacaaaaaatttaaaaattagccaggcatggtggtgtgtgcctatatagtcccagctaccaaggaggctgaagcaggaggatcccctgagcacaggagtttgaggttatagtgagctaattgtgccattgcactctagcctgaatgatgaagagagaccttgttaaaaaaaaaaaaatcgactcaggctcaccttcacttctttgctctgcaaacaaaccttccccacctggcccaggtaacaccttctccaagttgagcatctctctctgctgtcagccagccacaggcttctccatggggaaggaacagtgggaaggaaaatgggtgtctggacactgagaggcagaatccacagtgcttggcacctaactatgggaggagacaggtactacagagagagaagagttaaacatgactccagtgttttcagcatggaaacagggctttttggaaaatatatattggagagattaagagcgtagggtctaaagtcaaattgtattctagcactgctaattagatttttggccttgaacaagtcacttaacttttctgagcctcaatttcctcatctgcaaaatgagaataacaatgcttctataataataactagttgggattaagatcaagtctgtatgtaatagaaaaccccaaaaacagtggctttaaagagttaggcttttatttttctctcacttgaaatcagctgggagttaagccacatatgtactgctggtgtggcagggccacatggcagccacctgggctcctgccctcaggctgccccactaaatacgatttccattccgtggaacctcatgggccaagatgactgctggagctctgacattcacatacttattttagttagagagaaagagaaaaaaatgcaagtctccttactttaagactctctgggccaggcacggtggctcatgcctgtaatcctagcacttttggaggccgaggcgggtggatcacaaggtccagggttcaagaccagcctggccaacatggtgaaaccccgtctctactaagaatacaaaaattagcctggtgtggtggtgggtacctgtaatcccagctacttgggagggtgaggcaggagaattgcttgaatccaggaggcaggggttgcagtgagccgagatcacatcactgcactccagcctgggtggcagagaaagaccccgtctcggttgggggggtggggggcggggcggggcgggaaggctttctggcagtttcacacaacgtatcattagctacaactttatcacatggccacacctagctgcaaaggaagctaagaaatacagtcctctgactgggcagcagtggactactggggctctatccctaagtaaaggggagagtgtctggacaggaagcagtctgcatcatgctactttatagtgtgactgagagaattaagtgagatacagaatgaaagctcagcaaatactagtgataagaatagtattatcaaataagtagtatcaaatgacagtgatgaatactataactcacaataatgatgccatccaaagaaatgtaagagtcaggaaggagaaactgtagggccccggggggatgaatcacaacagagaggatcttgaggagtagctgtcaggatccctctgaaccccagggctgatctgtggcctgtgggatgagatgaggaaagtaaggacaaggtgggagcagtagtgtggccatgttgacacctttccgggtctttgcctaagagctgtggtgacttcctggttcagtgcaaagctcccagcttcttgcctgctcttccagtctctgctgcttccactgtggcgcttccacaggctctggtgcagaaggaaatctggctctgggtcagttagaattttaattaaaaatggaaatgcaggctcatgtcaccagtactacattctttcagcccagtgatgatttctggcagggataaaaataacagacatagccctttggcactaatgaagaaaggggtatatgtgtgggtgtgttttaatgaattaaaaatttataacagaaaatttagatataataagtcatcatagattctgttggtcttatgtgcttttgggcatatgtgcggcttccactgccttcttagtattttaattcggaactttctagggtcatcaaatgcataatatttagctgtcataccaggttagtgaatggagggggaaatttcataatttatttttagtatgaagggctatttaatgattttttgaaataatagttttatttaaaagcccacattttagtgaataatgagaatttttgcctttaaaagaggcccaaagcttgaaccttcaggctcaagcagtgcttcacacacacatacagaaaccctggcttcaatcccccatgtcatgggtcgaattgtgtcccctcaaaattcatatgttgatgttctcatcctcaatatctcaaatggggccattacagatgtaattagttaagatgaggtcatactggagtaggatgggccccaatctagtatgactggtgtattttaaaatggggcaatgtgtacacagacaaacagataagatcatgtgaagactggagttatgctgtcttaggccaagaactaccagcagctaggagagggacctggaacagatccttccctagtacttccagagggagaatagccctgccgacatcttgatcttggaagtctgtccctcagactggagacaacaaatgtctgttgtttaagtcacttggtttgtgatactttattatagcagccctaggaaattaatacactccatgactgggtagttacaggaccttaaggcatttgatattccaagactttgtttcctaagctgtgggatagtaatattcacccatctaccagtgaggatcaagtgtacctgtgaatattgtagagcaagcttgtccaatcctcagcccatggttctcatgccacccaggacagctttgaatgtggtccaacacaaatttgtaaactttcttaaaacactatgagattttgttttgtgatttttttttaaagctcatcagctattgttagtgtattttatgtgtggtcgaagacaattcttccagttggtccagggaaggcagaagattggacacccctattgtaaagcatcactacaatgtcaagtattaatatgacaccataaaacaatcactacaatgtcaagtattaatatgacaccataaaacaatcactacaatgtcaagtattaatatgaaaccataaaaccatactgtattttcttccctccctaccttcctttttctctctttcattttattttttgtttaaatatgtgtcataagggtttatgttaaattcctcctcctcaaccaactgcacagtagtaaaagtggggaatttctgtaatcatcaatgatttgctggcctttatagaggacttcaggaactaaatatatactgtacattaagatttcttggtaacaagtatctctccatgaggaacaaattatagaatgagatggccaattagtgtcatcttgcatcccagcactgatcaactgatcacctccctgcaatgctgtgttaaggaggattctgacactgcatctaggatagagcatcatgatcgcttagtgacatttactatgggtctgaactggatcaattgtagctcatacttttgtggacctgcagtttacatttctttttaattatgaccaagttctttgttatgtgaaaatctttattcatggcaaaattcatttagccaatgaaagcaaattggcatatgttcaactaaatcagctgtagcctaaaaatacctgagagctaaaataaaagtagtagaataaatttggagttgtctgtgtgaggagtacagataataatattaacagtaagatttatttaaagcttactgtcagatgttgtgcatctgacatggtgaagtgtactttacttgcataatttcagtgaatcctcactgctgccatatgaagtaggtcactactcagatgggaagctgagtttcttataaatcaagtgatggggggccaggtgtggatcacatctgtaatcccagcactttggtaggctgaggcagacagatcacttgaggtcaggagttcaagaccagcctggccaacacagtgaaaccccatctctgctgaaaatacaaaacttagccaggtgtggtggcatgtgcctgcaattctagctacttgggaggctgaggcatgagaatcgcttgaacccgggaggttgaggttccagtgagccaagatccaccactgcattcctgcctgggtgatggagtgagactgtctcgaaaaaaaataaaaagaaaataaatcaagtgatggactttaggcctcacagctggcagagctatcatttaacaccaggtctgtgacatatttcaatgtctgctctgacgctcatgatgctagagtgtgcatgcgtgaatatgtgtgtttgaggtaaaattcacataaaatattaaccgtctaaaagtgaacaattcagtggtatttagtacattcagtgtgtgcaaccaccactttgatctacttccagaatgttttcatcatgccacaaacaaaccccacatctattaaacagctactcctcatttccttctcccctccagcccctgacaaacagcaatctgctagatttacctattttggatatttcatataaatggaatcatacaataggtgactcctttttcttagtaaaatatttttggccaggtgcagtggttcacacgtaacactttgggaggccaagatgggtggatcatttgagcctgagtttgagaccagcctgggcaacatagcaagacattatttctgtgaaaaaattaaagcaaaatataatgtttttaaagttcatccgtgtatcagtaccatgtatcagtatttcgttcctctttatggctacataatattgtggtgttgttgttgttgttgttgttgttttgagatggagtctcgctctgccacccaggctggagtacagtggcacaatctcggctcactgcaacctctgcctcgcgggttcaagcaattctcctgcctcagcctccagagtagctgggattacaggtgtctgctactatgcctggctattttttgtatttttagtagagatgagatttcatcatgttggccaggctggtctcgaactgctgacctcaggtgatcctcctacctcggcctcccaaagcgctgggattacaggtgacagccaccatgcccagcccatactgtgtatattttgaggcagaatatcaacatcctatgtacctttttcacctggatatatgaagaaaacccaagtctggctactcagacacctcctccatttccccatgtcattctccacatggtgacatggatgaccacactgctaaaatatcaggtgctctccctctccctggatatggagtgtttggacatggtcttctgccctcctgatgcatgaggccaaagcgcccacaggctctagatgtaggagagctggctatagcttagtatatgtgctttccctaatccacttctaatttggggtagtagttttgttatctggctttttctggctacccagaacattccatcttataggggccaagtgtttctgggtgatgattcagatctctgctccaactagagcagcagctttcataatactctccctggatctcatcacaaattatcctgcacaaaacagtcagtgtgatctttctgaatccctaaactgatcaagtcatgccctactcataattattctgtgtcttcccagtgcttacagggtgcactaaaactctgtaacacacaaggtcatgaaggatctgcccctttctatgtaataccattctctcctccaaactccctgcacattctagaaaaattgaacaagtgatgcttcccctgacttccccaggaggactcagaggccccttccttcatgcttttatgtcagcgttgtgccttttacagaactttataataatggggagagagggagcatgtcaagccatcctggaattatttgtttctacgtctgtctccccactcaaactgtaaattccttgagagcagagaatgtatctttactgcttcatatccccaatacctagcacagttcctagaacatggcaggaactcagtaaatatccattccttttgaagaaccacgaattctttagaggaagtgatactcttaaaattatgcacctcatggccgggtgtggtggctcatgcctataatctcagcactttgggaggccgaggtgggtggatcacttgaggtcaggagtttgagaccagcctggccaacatggtgaaaccctgtctttactaaaaatgcaaaaattagccgggcatggtagtgggcacctgtaatcccagctacttgggaggctgaggcaggagatcactggaatctgggaggtggatgttgcagtgagctgagattgcaccactgcactccagcctgagcgatggaatgagaccctgtctcaaaaaaaaaaaaaaaagaaagaaagaaaaaaattatgcacctcatataatggacctagatagaagttggatgttagaactcatgatctttggacagtctctccaaacgacaaacataatgataaggaagagaataaggggtggcaaaagtggtcagatacaccttcctctctcaatatacacacagtatcccagaacacaactgaacatttttttttcctttgagatagtgtcttgctctgttgcccaggctggattgcagtggcgcgatctcggctcattgcaatctcaacctcccagggtgaagcaatcctcttccctcagcctcccaagtagctgggattacaggcacgtgcacacccagctaattttctgtatgtttagtagagactgggttttgccatgttgcccaggctgatctccaacttgtgggctcaagtgatctgcccgcctcgacctcccaaaaaccgaaattttaactgtaagaagaaacatgataggattgttaaattgatagctacgtggttagctgtggattcttttttgattgccttaaatacatgaaaagaatgtcagaatgaatccttcatggcaatctcagtggttattcctctccaaaagcttctgcccattccttttcatctctgccttcccttatttctcaccaccagctcctttatcacgtggtttagaattccacagaaagattgaagagaagccacttctgaactctggattataagaaacatcaccatttgaaggctgccttagggaactatgcagagatgatgggtaaaaatcgagatgtggaaaagttcaaggcctgtgaatgcaactttacttcctcactgtaaaataaaattaggttaaaatcaaggtgttggcagggggaaaaaagattaggggcacgtctcacagatgttaattttggccacgtaccttaatgtcttaatacattaatatgatacatacattaatagcttaatagcttcacactaatagatcttactaaagaaaaatgatttaggatggtagtaagcagaagaaatgattggataaatttgaatttgaaggatttttgcctttagatgtttccgtggaagatattttctgtaaaggtgatgccttaggtttatacttttccaaacacaggatattgctaggccacatatataaagaaaaggccaaaaacatattaagaaggaaggaagggagaaaagaaaaaagggaggaaggaagaaggaaggcaggaaggaagggaaggcagggagggaggaaggcaggaaggaaggaagttagttatattcagaatgttcattgtgatggatgagaatggaatgctcatgaagtgctcagctgggctgaagtcacaggtccgcaggtatcaagagcagtggtgactcctgtgagtaaaaagactaacagggctccaaacaagataggattcagagttgagactcctacttgaagccagtaaatgaggtggttcatttaggctgataaaaagcgtctgggaaaaagaatggggtaggggagaggttatgtgatcctgtgctctaactgtagcaatttcttccacatattctccatcgtctggggtgatgctgaccatcacccaggactatgacttttagccaccttctggctgaggatggtagaaggatatataagcagccaggcctgtggctgccacagtcataggctcttccatatgcccaataagaccatgggacagcagcacaaaatgccattctacaacctggctctgggctagagacccagagagccaagcagacataaccataacattactagaataggagggtgggcaaaggggaagtgagagggagagagaaaacaaaatcctcttcctcctcaccctttcagtgagcctgccaactgaaatttcagaacacctgaataaacctaaagctgaggaagacaacccaccaaaacaacaaatgaagcataaattcgtttgaaatgaaactaaattcatggaatagtctgaaggattaatgtagataactactaactgtaagaaggaaaacaatttgggataaaatacgtaaaaactaactctaatcatacagttggggcagggacagcatccagtgtgtgatttaggcatgcacaagttgtttttctttgtttggttttttgttgttgtttttgagatggagtctcgctccgtcgcccaggctagagtgcagtggcatgatctcggctcactgcaacctccgcctcccaggttcaagcgatcctcttgcctcagcctcctgagtagctggggttgcaggtgcatgccacaacacctggctgatttttgtatttttagtagagacggggtttcaccgtgttggccagactggtctcgaactcctgacctcaggtgacccgccctccttggtctcccaaaatgctgagattacaggtgtgagccaccgtgcccggcctaggcacgcataggtttttgtactcagaaaggggatagaactacaggaaaattgacagttaagcaaacatgttaaactaatttgtagttaagcaaatatgttaaaactatagaaaaacaatgtctagtttctaaaccaaaagaagaaagggtctacagaaaatttaatcaatctaacagaagacaggaaatgaggaaaaaaagcattggaggaaaaggttggtaaaaagagatttctatctatatgaccatgcttttgaattatcaggcagtcagtttttcccaagatttccagtacataagcagtggtgtactggtaaatgtttaaactggctggttgcggataggggtgggagtggggctgattttcagtgtttactcgttttcatggtgtaaatattcccaccatagccaatttcaagctatcaatctgatatcaaccagctcacagaattcctgaaaatgttaacagtaatgtctagtaagcttatgcatgctggttctaggatactattgtttactcgtttgggatagacaggatttcctcatagtcttcctactgcatataacttttgacaataaaataaaaagattcaacaatgagataccactacatacctattggaatgaccaaaatctggaacactgacaataccaaatgctgccaaggatgtggagcaaaaggaactctccttcatttttggtgggaatgcaaatggtatagccactttggaagacagtttgctaatttcttacaaaagtaaacatatgcttaccgtagggtctagcaatcgccctttttaatatttacctaaaggaattgaaaacttatatacacataaaaatctgcacatgaatgtttatcacagttttatttacaagtgccaaaacttggaaatcaccaagatgtccttcagtaggtgaatggatgagtaaactctggtatatccagacaatggaacattattcactgctaaaaagaaatcagctatcaagccatgaaaagacatggaggaatcttaaattcatgttaccatgtgaaagaaaccaatctgaagagtctatatactgtaggattccaattacgtgacattctggaaaaggcaaaaccatggagacagtatggagatcagtagttgtcaggagttgtgggcagggagggaggggaagaacaggtggaacccacaggatttttcgggcagtgaaaatactctgtataatactctacgaatggattacatgtcattataaatttgcccaaacctatagaatgtacaacactgagagtgaactttaatgtaaaccatggactctgggtaattacgatgtgtcagtatgagttcctcaattgtaacaaatgtacaggtgggggatgttgacagtggagaggctgtgcgtgtaggggggccggggtatatgggaaatctctgtacctttctctcaattttgctgtgaacttaaaactgttgtaaaaataaagtctttaataaaataaaacaaattctctgcatgctacttttctaactgaaatcataagggaatttattatgaaaacaggacttggtggcattctcttattagagtattcatcatatggttatggaaggctagtaatttatgatccttgctagcaaagccagatcaataaagagataaatgtcctcagcacaatagaatttatatcatccacatgataattgaccactgtgtcacacattcaatcattcatcgcattatctgatataactagcaggaagggtaatatgtctatgatttattattaatgcatactagtatgaaattcgtgatccatctaacctgttacctgtccttggcaacatagtatgtacagttgtctacttccagtaataggatcccgcagaaagaatcagacaaccctgtttaatgctaggcattgcctgttgaattggaagagatccaagaagtgcctgagctagtgttactccctctcttcttttctcttctcttccctttctccttgtcatcagttctggttccttttttttgttctgttttgtttttctttccccagagcacagtggcctgtctagagcagagatgggtgggtaagtggtcctaaaagatcctttgatgtcactgatttgctgctatgagtatattttgtgacagtcattctgtatcacctatctatgcatgtcagtgaattaacagtggcttcaagctcaggacacaccataataccagggcggggaaacagcaggtcccctggggaaacagaatggagaaaattagaaaggaaaacagaaagataaccattcagaaacccatgcatagagttagttccctaacaataggagtcaaaagtattccaaactgtctccccctcccccttctttcccaacctcttgggaacatgtgttggttgcctgcaacgtctgtgctttactttgcaagggttaattagatggcctattattcagcaaattaaaggcttggttgcctgagttcctttcagaaaggattagggtctctgatgaggctttgatgtaatagatggagctgttctgctccatcttgttaatggaggagttttaaggactccccagactctatttggccgtcagtgtctttattcattccctttcctaaagaagaaaaatattttatcttgcaaaaattcagtgcttgaacaaggcactggattgacatcctgggggtggggtggggggtggagggtgaagtgttcatttcttgtctaaaatcacacagaagcagcacttcctggcttccttgggtggccacttcctctgcaaaaaccatctctccaaaaaagcagcaggagcagtaatttaggccttgtggttcattgtcctttgaagcttttttgctaagaagttgggcaggagagatgacaggtgacaggcatggtagtggtttgtgtcctcaggaacatgaaccaagacagccaataactgcaaaatcctaccttgcataaaatgtgtgcacctacatattatctgacaagatttttttccagactttttagtgtggttaagttgttatgaaaatctggcttagttcattttctccaatttgatgttcacataattggcagtcagccagagaagtgtttagtcaattttagtctttaccaaaagaacaaacattaagggaagggtacaaaatgtgggtagacacaatgccagtacgactattgcagctctaggtcattatcctgcctctttatctaatctcctagccccactgtgtattatggcctgacattttagctggagtaattattgtcatcatttagggagcaagtcagctgtccttttgttgccaactcccacttgtgtgatgctccagtcttattcctgcccttccccaactcacattgttgggattgaatcgctccctcctttgagttacttttgattcatgggctcaacattttcagcaatcttcttttcattctttgcaatgaatagcacatggtagcttggcatccaccttttctttccttaatcaatgccagcatccagacattcaacgtgtcaggaatcaaggggcctgaccctataaaaattcaccaagttgctgatagatttagcaatggattaagacagatggctcttgtctctttgtgttggccacccagggagaattttttttactagatgatgtaaggcatcagtttatttatttatttattatttatttatttttattttattttattttttgagatggagtctcgctgtgtcgcccaggtggagtgcagtggcgtgatctcggctcactgcaagctctgcctcctgggttcacgccattctcctgcctcagcctcccaagtagctgggactacaggtgcccgccaccatgcccggctgacttttttgtatttttactggagacggggtttcaccgtgttggccaggatggtctcaatctcctgacctcgtgatccgcccacctcggcctcccaaagtgctgggattacaggcatgagccaccgcgcctggccaacaggcttcggtttacattgaagagtgtcataagaaacagccctattaaacccatagctgcatttactagagagtgataatattcattacatagcatggaggcatttcttttctttttgagacagattttccctctttttgcccagcctggagtacaacggcatgatctcggctccctgtaacctctgcttcctgggttcaagcagttctcctgcctcagcctcctgagtagctgggattacaggcatccatcaccacacctggctaattttgtatttttagtagagatggggtttcaccatgttggccaggctggtctcgaactcctgacctcaggtgatccacccacctcagcctcccaaagtgctgggattacaagtgtgagccaccgcacctggctgcatggagccatttctatgaaaaccctggaaagctatatctttagtcttgttacctgtcattacatcacagttctccaaattgctggtctgttttatttatttatttttatttttatctttaaaaaaatgttttaagacaaggtctcaccctgtggcccaggctggagtgcagtggtacaatcatggctcactgcagcctcaacctcctgggctcaagcagtcctcccacctcagcctcccaagtggctgggaccataggtatgcaccaccacggccccctgatttaaaaacaatatttttggtagagacagggtctccctgtgtggctcaggcttgtctctaactcctgggctcaagcaatattcctggctcagcctcccaaagtgctgggatcacagacaggtgtgagacactgggcctggcctagtctgtttttatatcatggattttaagaaatatagaacagaattcctgtctctactaaaaatacaaaaattagctgggcattgtggcagtcacctataatctcagctactcaggaagctgaggcaggagaatcccttgaacctgggaggcggaggttgcagtgagccaagatcacgccttgcactccagcctgggcaacagagagagactccatctcaaaaaaaataaaaataaaaataaataatatatattatatatatatattttatatattatatatttatatgtgtattatatattatattttatatatatgtatataactgactacattttatctttcacattgtctgacagaaagcccagagccccatttgtggacaccgctaacaaagtcttttatttggtattctaattcctattagattccagggtatctttcttcccttatttcccctttgcttcatttttctgtttggtttataattgttttttatctttccttatcacatatacctttatttatttaagcacctattgttttaaggtgtcttaagttatttctggaacaagatggaatattttaaaatttgcatacgttggtaggaatataaaatgatgctatgattttggaaaacagtctggtagttcctcaagaagacaaacataaagttaccataaccagcaatccaggggaaatgaaaacatgtgtccacataaaagcttgtacagaaatgttcgtagtagcaataattcataatagcttaaaagtagaaacaaccagctgggcgcagtggctcacgcctgtaatcccagcactttgggaggccaaggtgggtggatcacctgaggtcgggagttcgagaccaggctgaccaacatggagaaactccgtctctactaaaaatacaaaagtagccaggtgcggtggggagcgcctgtaatcccagctactccggaggctgaggcaggagaatcacttgaacctgggaggcagaggttgcggtgagccgagatcgcaccattgcactccagcctgggcaacgagagtgaaactccttctcaaaaaaaaaaacaaaaaaacaaaagtagaaacaacctaagtgtctatcaactgatagacggatcaacaaaatgtggtatgtccatataatgaaacattatttaacaataaaaatgaatgaaatattaatatatgctgtgatatgaatgaaccttgaaaacatgcaaaatgaaagaagctagtcacaaaagaccatacatattatatgaaatgtccagattagacaaatctacagggacagaaagtagattagtggttgcctgggactgaggaggttgagggagtatagggtgtgaatgctaatggatacggggtttctttttggggtgatgaaaatgttctgaaattgattgtggtaatggttgcacaactgtgtgaatatattaaaaataattgaattgtacatttttaatggatgaactgtatagtatgtgaactatatctcattaaacctattataagaattattagcaataatcagttgaaaattttattgagtagtttttgctgattttcttgcatttaaaatttttacttaatgccagctatgcacattatagttgcaaccactcattttgagcagaatctacagacttgtttgggattgtgggtctccaagaatagggacggccttctccgtagtaggcaaattccctctatattacttaatttataaatttgagctactaggcaaaggcagtagttgttcaggagcaagttctaagcctgtgcacataaaagctatcagttctattttcgcttctccttgtctttgcataccctatctcctctgcccttgtcatcttattccacctggtaatgaaaataaatgagcgagagtagtcagaaaagtaaaagaataactaagagatgtagcatcactacaggcaatgaaacagaatgtttcaagaaaccagggtaatgatggtcattagtgacctcttgaacagagaggttgaatacaatgagaactaaaaagggaacacagaatcggcaacttaaaggcctttagggtcctttgagagagattttagttgggtagtgaagataaaagatttttatgttcacaaacatttagctacaggcccatctattaaatttaagtttgcctaagattccattggtgacctcttctcttttctttcaacactcttgacttgtcttcaagttccagggctacaatcatcatctttccctttctatttcattaattcagactgtattcttcctaaatgaattcactccttccctctaatctactctctaatgtggtgccactttattttctaaagcaaatatctaattgtgttatatccttgttcatgaacctcagtttaatgtggctaagaaagcccaaacttaccagcaagaccttctgggttctgaaaagatgttccagccagactctcaccccatctctattataactgcattgttctgttctactcatatccctagatgagccttgcattttataccaatgaacttcctcaaaaggctactgtaccctccgcttggaatgcctcttgcctgcattttctgtcaataccccttttgttctttaagacccaaggatcatctctcatgtgaaactcttgctcctagttagaattatttacttcgtctgcgctattctagtgcttatacttttcagccttaaattattattatttatgtccatgtctattctaatacttctttctaaatcccatgaaagcaaatgtctcattccaggcattgttttccctaggcatttgctgtggcaccattcacagtaaatacctagtaagtttttgaatgaatcaatgaaatcaatctcatctgattctctaaatctttcatatgtgtaagtttggtattaccccagaagctgataagtttcttgtggatgaatataatgtcttctgtttgatttgcactctcttagccccaaccccagttctggtatagtcctgagcatgtaatgatcatgcactgtggaacagattgttcatttctgttagaggatggctgggtactctctattccttctccttgtagggagaagaatgcatacaaatgagaattgtggatttaattcagggaagggtggcaagtaggatcatgggaagaaatacaattcatgtgtccctgggcatttaagcctggactaagaagcagaccatgactgtttgtcaaaatggaaattgattttcgaatcaaagaaatgagccagacattaaaaaaattacccaaaggcatgaacttgaaaatgccaaagctctttgcttttgctgaattgccagaccccagaaattcccttcccctcagaactttgaaagttctgatcagggcatctactatcaaacagaaatttgtcctcagtggtaggaatcaactgagagaaagtagctaactaatgagcacagtattattaaaatctaactgagggagccattgcacattaacatttccttgttgctgtggtttgaatgtgtctcctccaaaattcaggtgctggctttgtgatagtattaagaggtgggttctttaagaggtcgttaggtcatgagagcctctccgtggtgaatgggattaaggattaagtactggataaacaggcttgaaggagaggcagttagtctcttcttgccttttggccttccactgtgtgaagacacagcattcctctcctctgaaggagccatcttggaagtagagagcagccctcaccagacaactgaacctgctggaggcttgatcttggaattctcagccgtcagaactgtgagaaagtacatttctgttctttataaattacccagtcttaggtcatctgatagagcagtgcaaaatggagtaagacacttatgtagcactcatactgctaattatcaataggtgtaccacagctatcttcctccaatggactgactgactgtatacccagcaactagtacagtgtctggcccagggagctgacatttatcaattgttcgctatataccaaatactagacatgaattaactcatttattccccacaataacctttctaaccatttaaggtgtgatctcccagggaccacaccttctccagccctttgaactaaagggtggcatttgaacatagactaacaatctgataagctagttgctggggctgtgtttatctgtgccctgactgtgtcacatgggtggagttgcctggagaaatatctggttaattgcaaggtgctttttataaaaactcaaccaaagaaaaaagaaagccaggaggagggagaaggtgatgacttggggccaccagttaacaatccttaagactgccttaattctcggacacaaaattgacatcttcttggctgccactgtgtccagcagagggcaaccttatccccattctttgtcaaatgccgtaggacagtttgaaagcgtagcttaaacataagaaggaggtgccaagaacaagaataaaacagccaactcggtcagtatgccttcagtgactttttcttggagatacctctctttaccttgaatctgtgccccatcttgacctgctacttggctctggcctggttcacttggcccttctaacttcatgtcatttgtttagcacttttacatctctctctctttttcctcctcccagactgattctgccttttgtctatagtatagtctcctttcctctgttcctcctcactgtggctctccacttgtccccagacaagcagggcttgaggatctagaatttttgttaccacatctccttccctaagaacatagtcagttagtctgggcttttcaaactatttcatattgaccaagggcttagagatagagggtaaagaggttcctggttgacaggtttcactgaggctgcaaccctggggcattacagggttacatattgcagctctctgccttactgggggtctctgatcctgggccttgtttttgcatagggactttctccagccacactggtgcacacgtcttaactctagaggtagattctgtcccatttgctcagagatgtgatattttggcttcaaaccaccaccctatatgttttcttttgtcaccttctttactttctttgagtcttctctgggtgagaaaagtagatgttctttatccccaagtttcctgcccagtgtcaggcttcaggaaatgcaatgttcttccctttccatttccgtcctaccttcacttgagcttactgtggacctttggtgctgacagctttgtctaaagatcaggctcacttgtttatctttccaaccttgccccaggatctctggcaagatggcagctgccctgtcgtccagtagccatgtggtctcttgctttttacacagactctattcccgttactcatttcaaagggagactcagcttcctgttcaaaagctctccatcctaccttcttggggatttttgtcttttagcaaatactgactattctcctctgattgataaccatagacctgcctaactgagtaatgcactcccagttctcatttacctgtttcaggggaggaccccacttccccaccccaaatgtgaagttagcatgcaatttcagttctcaccagtgagactttgcaacagcatcaaatgtgatattcagacttcaggaaaactgaaatgcagttaaatattccaccaaacaggggggtgatgtttcacagaaataccatacacagcatcaagtttctcattctgccttcttttgaggcattagtcattttgagaaaatgcctgtttgtcatagtcttgtcttgcagaatggaaattttcttccaaggcagaatactgtgtgctctgatatttaacctataattagtgtatcctctggaggattttctccccttgatttagaggcctctttgtcagtcagccttctgtttgacgatgatagcaaccacagggcagcacagtgaatcacacggcagggaaatgcttgctcagatccaaaatgtttagatcttctgtagcaatgggaacacataacaattcaagtagcaggcctgcaagaaaatagcaggaagtataaaagacagaatatttataaagaaatgagaagagtcataaatcctgagttttgatctagttttgccccaatgtatggaatacattgctcaccctcatgcttttcttacccagtttactagtatttttagtttttgccttttcagctgctctatatcaagtgttttattcattggtaaacaacagtcagaggctcttgacaaatagctcccccttgcaggcatccggttttttggttatgaaatggcagtttacaggcacagagtagctgtgtcacgacagcattattgtcttggagcagagagtgcacagacaccaccagcttgagagcccgaccttgtttcttgctaagaaatgtcccgtttttgcctgtttttggcagaagccagactgggagattgctgcaaatggctgcaacaacctgtgtttaatgtggtgacactaatagattctgagaattaatcttcagccaagaaagcatgatggaaggtactagaatttcaaattagatagtggattgatttccttcaaggctgaaatttgcttcctttatcttctggtggacttttctatcatattcaaaaccacccatcatggccttatttccagagtctcttgcatatatctcatggtataaataaattgttattctgttgttttgtctgttagcacagagaaagcatatctaaatcctaattttttaaaaaagattaaaaaatccaggaatgaatgaaagaaagaattacttatgatttggggaaaagtagtgtatctaaatctagtccttgctacttgttttctagaataaaggactctggaaagaactgagctcaggaaaatatctccccaggttgaaacactgtcttttgcagaaacaatagccctccagagtgtctgagatgtggcaattattaagagttcttacagtgtcccctcagtccactgagttgaggactctggtgtccattctaaaatcatgcgactaattgcttacaacagaacttccaaggatatcatttgtggggcccaaacaaacaaacaaaaaggtctctgtggctaagtaagcttggaaacgtgggctcaaatagaattaaacttttttttaaccctagctcttgtaagaacctttaataggcttgtgtgcattacaaaactccaaacttacttggtttagagaatcaccaatgttttccaaactcttttgactaggaaactagcttctttttttgatggaatgctttatgtgtctagtgcttcccctaattcacctcatgttggctggcccccaatcccatacagagtttaacattttatgcatccttttgtaaaaactgctcagtccctggctgggggaagatagtcttcttttggaatttgcaattcctggtttaataagcaatacctgaaatgaatacgtttcttagaactcctttagttctacttgtttgttctccaaatcaggttaaaggattctatcttgctttataaaaggacatggaggctatcaggagttttaggaatcccagctgtcagtttcatcttcatccactaaatctctgctgaccagggatagaaatgacaagccgacaaacttaaacagtaagaattctgggcaccaaactacaaagtcttaagcaacaacaattataccttagttaaagttggtaaagggactaaaggcagtaactgttgttaggcattcaaaagaagcagcttaggaggtgaaggtcagtgttctggtggcctcctgacttactggctttgcagcttgtctagtctgcttcttgcattgccggtctggctccccagtatgacttctgcctttactcccccagtttagttcaatttagttccaaaacttcccccaagacttacctagctcaattcttaccagctccaggaagtcttccctgactacagttcttccctctggccgcgaagtattgtttcgtacgttgtacctttgtcatttttaacaacacggaacaaagcaggaagggtcctcctgtgggagttgaggaattgacctcatcattgccaggacttgatcccatttcctcacctcttaaaagaggggctagaatcgaaaatctcagtccctgtggctctgaaaccctatgcttttgtgctattatttcttatcctaaagatagaagcaaacatatggcttttgctgtttcttgtgcttctcttgtccttctgtctttccaattagattgtagatccttgaggaaaagggtcatagcttttaattaatttatgtattgtggctagttctagtgctgagtaataaatgtttgctgagtaaacgatatgatgctatgccctcatatccagtaacgcaggactttctatctgctcttaaggcataactttcctctatttatctgtaaaataatagttccatttcagactggctctttgctccccatgagaaaaaaatatagagaggagtattttagaataaagctataccttcaagttcttcatgccctttccctaaaaatcctccaatgcagttggagagtcacaactctgcttagccttcttcctctttacactcaggttcagttgtgctgatcctgtggtatgatggtatatggtagacacacccgacagcaataatttaacttgagcataccctgaggatgatcctgtatggcagttgcacctgaatatgtgtttggagttcagagcgtgcccaacccagagataaattccttgtctgtgaggaacatctgagctctgggcccttcctgtggaacatcagcatacaggggagtgaggctctttgttttgcgttaaatgaaggttgccaggtggaggttgttaggaggagggagtgaagtgaaaatgctatataaactgcatgctttttgcatgcagtggtggttcttctgtccagcacatggctactgcatcatccctgtatgtaagtttctcctaataaaaccctatatctcatttgttggctctgggtctctccttcagcctcttgaacttggtgccatccctactgaagttaataggggtttatcacgcagacattcaacccacttcagtctttctttcttacttggagaactaagaaagcacttttttttgtttgttttttgtttttgtttttttgagacagggtctcactctgttgccagactggagtgtagtggtgggatcatagctcactgcaatctcaaactcctgggctcaagtgatcctcctgcctcagcctcccaagtagctgggactacaggtgtgctctgctaatttttaaattatttttagtagagatgaggtctcactatgttgctcaggcttctcttgaactcctgggctcaagaaatcctcctatctgggctcccaaagtgttgggattatgggcatgagccaccacgcctggccaacagatcttcttgatcattgcttccagaaagtagaatgcctactatcttcattttttggatcttcaagaaataacagatttactcgttagtttcttctttgtctaattctctgacttcattattcattcatttcttttattcctccataatctagagagggaccctctctaacatatcaaatgatcttgcgaccgtgttggaagccttgcttctccagtggatgctaacattgtgaaacaagctataccacctttaattgtggtccctagactccagtggaggcatcttttcataaggctggatggagtatgggtttcctagtctttctcaatccctgttcaaggagctttacttactgaagtacccaaaggaccttgttttcaggcctcacctggaacactgccctgaggtacctatattaaggaggaaggtagagaggcagctccagctcactttccccttcacatgctatgaattttttgtgaattgcctccttccaccttcagtctctgcccctgtgtttactaatttgaagtgttgccactagtcaacaggctattgagggacccctggtccttttgttcattctttcttttcaatgagcatttcctggtagtcagatgacgcttcaacaattaacacaggaagaaagccaaaacaaaaatgtggggagggtgacggatgggtgggatgaatattatgtgaggaaacaagaaatttctctccccatgtttgggaaatacttcaatactgatatgcctatttggtgatgagaaacagacataatgtgacttattaagaaatcagtaagcaggcttagcttcagatccagcagttcctggactcccatcctacccgttccctctgaggttcctgggggtgtgcacaactaccgggtgcatcttcagtaggaactctcagaggacataggggctatgtttatcttaggagtttttatacactattcctaatgctaggaggactgggccatacacctatgttactgacagtataactacctcttgggttccctcttttttcaggaaacatggttattagcatttttgcataatatctaagcatattaactttgatagttacatatagagatgaatatacaaggaatcaagggaagattgctgatgtaaagacatgaacacagtcttcttaaagcatatgcactgattttttatttttcacagaaaaataatagattatacaaaaagccctgaacctataaaagtcaaatgatgtatttcttcccatggcaaggcagaggtggtatttatagtcctgcaagcagctgaatggagataatttaggttccgttggcttttctggctgaaagctccagttccaatagatagggaatcccctgaatcaattataaaatggagtaactgggagatttaccgaatatcttttcaggactagaaggtaagggatatgaaagtgttttgaactgaaaactgcagaaaccaaagcttttttgtaaatttaacttttgaggattgtttcaagaactctgcttaagtgttttgaaaagatgttcaaggtgaggctgaagttttttaacatttgtcagtgaatttcattaaaaatacgttgtatgttagatgctgctggcattccactgttgagaaaactaaagacgtttatttcatggattgggcagaatggcatccatttatcctaagcctccaatgtgggcttaaggacaagtggcttaaaagggtagatgttaaaatttcttcctctcgccaagggcaggtacgcagaatagaaatgtgatggcagttggagggatattcgtcagattcaatttcactagaaatttccctgtatccaaatcatcttgaataacacagaaggtgcagcaaaatgtactgaatcattgctttgaaaaggattttgaatctaaaacagaaagtagttatgccggtatgattttaaccaattaaccacagaagagtttaaatgcaacccaatttttatcatttcgaatggactttttgttccctgtttgtataattctattccaattcatctgaattatattgtactcacttcctgttctgtggtttttctggttcttcagaagacattagaaatcaagcgccagcgtttctgtgaaggtttctttatgattagtttttttccttttaacacctagatgccttttccctgccggtaaacaaggggcatttcatatattaggatttaattgaggtgatagtatttaattctacgtatttctaaaagaaagtatacatacaaatcaacttgactccactgaaaatatttttctctaatgaaaatgcggatagaaaattgagcagtctatatttttagtgttttgagtacttcaagttgatggtacaaattgtgttttcaactttgcttaaaacaaacgaagacagatttctgatgttttaattaattcaactaatagagaattactatttttctgttttctggtacatattaattaaagagagagctgtgtatcattaaccaatgatcaggttttataaatgagcttttaccttctctccatctcccatattcataggggaacagggtgtctaagattgtactttggattgtttgttggtttttgcaaacaggtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggtactgtactctctttcttctttctccctgtggttgtttataaaaatgtcatgtcatgtgttttgatttgcccagcattattactggtagttattacattcctgcatttttaagagttttatttacatgacattaagtactccatgcccagtggatgagagcaggagaacttcagaaacaaactgcccatttgtgctcttatggccaatttctctcaagtggctgaaatcttactctgccctggtgttcagttagctttagttaaaaaatcaacaaatatatatatttacatttaacagaaatttggattttttttttttttttttaccaatagaggtaaccgtatgaaagcaaccatggctgacattgtgtgaaacacctttacttggccattgtagactgaagagcagtaatgcaggctgtaaagtgattttggaaagattatgagctaaacaccgaaggctgtttctctaatgtgctctgagaccattttctctttagtttcaaactctttagagtcgatttggtatttttaagtaacatttttcaggtatttcttatgctatctaaagcaactgtgattcctaccctacctcatcctctttttttttagaaggtagatttttatacaaatgtttattttcaggggcaagtgctttaaacagtattccctggtaaatctctaagaaatagatcttcaatttctgtccagagggtggcagaatttctctttaaaaaaaattaaatgcaaataaacctgcttcctatgctcagcaattatttggttttatgaaaccatccaggatgtagataagctccagtccattattattaaaagaacattggaagtactggaggtgaagaaaataaaatatcataagttacaagttctggaaatattcatgtattctgcagaaaactgtttactaatcaaaaagccaaacattggcatccaaactcttggagctggaggcgtagtatcaaggtgactatattttgctgatttttctccaccaggttcccttttggatagctcagaggggattttttttcctacttgtttcctttttccactgccttttctgtttctatggcctccctacagagtagagaaatgcagagaaattcttgtgacttggggtctttttgaagcagcaggaacttgtgtttaagccccagggagctgaaatctcttttcttccttgttttggttcctatacaccagccaccacccctaccacccacctacacacacacacacacacacacacacacacacacacacacacacacacacagcaccaccaccaccaaaaatgaagacgaagtaaaagaaaatacaaaccaagcaaaaaacaaacccaacatctaaagggtatgagtcaaatccagcatctcctccttgtctccctgttctaggatttgccatggaatgatttctaagacttcatttgccaagctatctggattttcatatttgcctgactttgcctgtccagatctatgctctctctctctctctctttttttttctttttttttcaaaaagaaaaagaacaggccaggtgcggtggctcacgcctgtaatcccagcactttgggaggccgaggtggatgaatcacaaggtcaggagtttgagaacagcctggccaacatggtgacaccctgtctctactaaaaatacagaaaattagctgggcatagtggcaggcacctgtaatcccagctgctcgggaggctgaggcaggagaattgcttaaacctgggaggcggaagttgcagtgagctgagatcgcgccactgcactccagcctgggcgacagagcaagacagtgtctaaaaaaaaaaaaaaaaaaaaaaaaccaaaacctttcttcttttaccatagaaaattgtaacaccagcctctctcatcccctttctctaatttctctttatctttgttaactcctttgatgtcagaagcctcatgtggtggcaaaggcttctcacagggtctttgtaatcttgagtttcactcagtggtttgtgtttctttgaactatcattaaaaaaaaatacaacctcacaaataggtatcaacactttaaacagacacttccttaggatgtgggaaaattaattccaaaggaaacacagtgcacgtaattgacacttaacctgccacctctcttgtactattacttcctcttagcaactggcaaggagctggctacatagatgtttttcagcccaccaggaaaaactctcaaatatcattccatgctgataaatcaatatatttaaagctgtggtttttcaagttaaagcagaaaaaaaaaaaaacagaaaaattgaggtgagtatatagatgattgaggcctaattacccgctcatcatttttctgcacagttatggccacccggcaggcagtgcaatgtggtgattaaaaccactggcttggcagggtgtggtggctcacacgtgtaatcccagcacgttgggaggctgagataggaggatcacttgagcccaggagtttgagaccaggctggtcactatagcaagacctcatctctactaaaaaaattaaataaataataaaaaataaaagaaaaattagccgtgcatggtggcacatgcctgtagtccccggaggctgacatggcaggatcacttgagcccaggagtttgaggctgcagcaaactgtgattgcaccactgcattccagcctgggcaacagagtgagaccctgtctcaaaaaaaaaaaaaaaaaaaaaaaaaaacaacaacaacaaagaaaaaaatctattgctctgccaggtttggatctcaggccagccactaactggataagtttttaatctttctcttccaaagtttcttctataaaacgggggttattttgagggttaagtgagtcaatacatgtaaaatgcttagaataatgcaacctccataaatgttagtagtagaagtagtgtacaaggtctatttaattctgagtctttcatttctttttaacactaactacctcttgcccataatctgtgcaaattcatctttttacttactgtacaagatcatgaaaataaacactactgaggtactgaatgtttaaaatatcccattttatctcttattcaatatctaatttattcattcaagaggcatttatacatgtgtatgtgtcaggccctatgctgaacagagggactacaaaggcaaatcagatgcagttcctgataaagagctaatagtctggtgtgtgatagagacaagaatcaggtgagaacagttcaaaatgaaaagtacctagataaaggaatgcctgggatacctctcagagcacctggtaaagacacctaagtcagtctggggttgggatggtaggggaagatgccctggagctgctgggtagatgatccttgaactgccctgaagaacaaatcaaagatagtcaaggaaagggggttattcggggtagaggggaaagaaagagcaatgagcaaagggcaaggcacaagggctagagagagcttggggaatctggtgaacaattagttgacatggctggagcttggcatggggtaggtgggagggagagacaaggtagacaggagccacgtcaccatgggcctaaggagcttgaatttgtttcttaggtgctagggagccattgaagagttccagaaagttgttctgattgcagtatggagaatgaagcagggtaaggctgcagccagggaactagtgagcagatcatagtaattacaaatggcagaagatattaaaataatgatattgtcaggacttagtgatggattgattgagggagattagggaaacagagaagtgtgttggggcctacccaaactgggctgcctccctggcctggttcacaatgcaatcatgtagaaattgcaagacacgtcttcatagtctatcaaatgcaatgccaagtacttccagatattacacaaagcttccagctttctgcccaaaagagagttcttcaatggtctaggcagtcctgggccctccagctgtagcaactctttttggatttgagagctgatacagagtaatgaaacctataatctacagggaaaactttcttaccattcctgcaaaggtaaggaacgttcagtccactttagtacttttcccaggggagagagaagttggtagtttgagcaggatgcagggaagaatgcaagttcttaaaggatgggggaacacttggacaggtaaaggggaaggatatatatagagagggagacaacgaagacagaagagagaggaagcaatggaggaagcaagagggagtgggtcaggggcctaaaagggaggttgactttagaaagagagaaactctaagttgggaaagacacagaaaggttagataaaagtactcagaaaacttaggagaggaggcattgtgaggaaattcatgttgaatggcctttaaaaaaaaaaaaaaaacttagcaaggtttcagagttgggagtggattgtggactccagggaatcgttaaatctttgagatattcactatgaggaatatgataaagggtcagttaaagatcgacatcatgattgcttaatagcatagaaaacccaggtagaatgcaactgaatagcatcctattgtagtgaagttaatcagtgtctaagataatgcatgtagagcattcaggacacttggcactagaaactctcagaaaatgcaccatcaccactgccgcctttctcatctgtcatctcaattaactcttagcagcaaggagttaggagtagagaaagcagacattatggtcttcttcaggctagagactgacttcagtggacatgatgagtgggcaaggaagcaagggaatcgaggttagtagaagagtggccttgggatctttgtgggtagggaagaaagtgacaccagactggcttattgactttgaggctgatctagtcctgggactggctattacaacaaagatgaagagcagattcagtgaggggatgatgagaaaagggattgtagaactgagatcctaggaacttttgatagataattaggaactaaggatagctgagcttgtgggcaacttcggtggaatagaaagaaatgttttttaagtgttgacaggttgaggaactcttagatcagatccatctcagttatggcacatattcaagagtattcaaaaacaaggctaagaatcatggagggcttgttcacatagagcagaagctgtactgtgcttggagggcttgaatttgtaagtcccctgtctcacctctcctgggtctaaccattcaggcttttctgagtgctttttggaaagccaggatgtgattcatccctatttcactctctctatatatatatatgcatacatacacacacacacacacacacacacacacacacacacacacactacagatatagatacaggacagcagaggcacctgtggagaagtgatattgtactatttgagatttgatagataccattacctgatgctgattatagtgtatgtatgacatcattggaatttaagtttttccagtaaattataattgtgccaatgcatgtatttgattcaggtacaatagagcagttattaatccaagtcttactcttttaaaggagtaagccctaaagggctaaagaagccctaaaactatgtgaacaatgggctgaaagtacattgttacttcatctgttggaggtgtttttaaactatttggtcatttcctttatatcagcacctatttccttgatctgcaaaaagacgacttcttccccaaaccagttttgcaaatccctgaattcattagtatcatctggtatgtcatctcactgttaaagttcagagaagtagattgaaaacatgctttgtatcattttacaagggttattgggagaagagtgaaaccactctctggaatgtgagtggaggcagggaaaggactcgattgtctctgccacgaccatgaactcaaccgtgaacctcagtaaaattacaagatccagcatgccgtgcccctgcaggtggcttggtactagctgaaaccacagatgttaaaccctaaatgccaagggtctgttctaagtattacttggtagaagaattaagttgctgggttttttttttttctgctctgtttaatgggttgtcatgtcgcccttgcaatttgcctgaggctgattaaaacaatgacttcagcttttgatttcttttcaacctgcagcaatgacctttaaaaacagatttctcactatttaactgctagttttccccagtaatccttgctcactctctccctcttctaccttcaaatatgtgcatgcatgcacacacacacacacacacacacagagcaccccatattatatacactaatgggttattgggttcttatgtaaataagtaactccagaaagattacttcataaagtgctgaagaagcttaacacacaggaggttaaatatccttttatcttcctaacagaagaaataaatctataccttgctataattagtatctgctatctatctatacctatatctgtctatctacaaatgagtaagttagttaatattaattttatgctggtgttactgattcttgccgcttagagaagttgggtatatcaaatactgtttaatatgattaatgataagatgctgatttattgggattctggccaaaacggtgcttagatgaaaaatgggcagatactataataatttccacccaaacaattctcctattttaaaatttatgcattgtattgtttgaaagacatagccttaagttcagggtcaagatacagctcatgtagttaaaggtatccagctgctatctctgtccatatttgactctcagtagaataatgtcattcctcaaaggtctgctattgtttttctcgtttgaggtccattattatatagttacggtaaaataaaagtccctctttcattggctctgttatcaaagggtatattgaatggaaattaagatttagaagaaatattcaacatcactgaccttggtgtagtaacagtactctattctcagttttgagtaatgttttctttcttgtatggaatccattgaatgtagtgataagggagtgatccctgagttctctctatggccatggaggcttttgtcctagattcttgaggactgacatctttgagcctgcacctttttccttattccctctctctatttttttttttgcctctatccgcaacaaattttacttccttttccatctggaatctggtaacagtgatagtcattctccactttttgcagttccactcttggacggaggagagggttcttatcctgggtgtggaggagcagaggcagaggtgaccttcacaatggtgctgacacagggtgactctctaagaagccagcaggcatttctcagtgcagagattaacttcttaggagtatattgcttgttgttattattattaggctgaattgataagctagaagaatttgtttccttctcatgtttgagttatgatttagagcacctttttctattacttgttcttcatcatagttggggagtgaaaggaagagcgtatcctgtctcacctacgtgaagttcttgcagctctgtttgtacctacctacatggaagcctccacttccataggcataactggcagacagaaagaggctaattgattaatgagtcacttttgggcaaaatatgtttgtcaatatagttcataggactagcagctcaaacaaagaagctagcaggcccagtgatgagatattagagaacaatgacacagaaatggttttaaccataatgcagatacagagattaaactagagtgaaagctgcaacactttaggagtttatttcatgagaataattcttctagtgtttaaaccagtttggtgtcctctaaagctcctttcccactcattggctgggccaaagatttgaacaaagacccccatcctctacctcatctatgcccactgttgtcttaggggaactcccagcctctacctctggctctgtctttcccgttcttcagattctattcttacgctgcactcatttccttggacttgatggtacagacttgccctcattcccaccctacttgatccatggattcaggcaccagtttcccctttacctgatccctgaaacctaaggcccgtcctgctctccacagtctcccgctccactgccacaccaaaagcaaactccaggaaccagtccaagccaagactttccctctaagctccaactcgcaaactctgtttgtctgagaagccagccttggcagccaacatacttacaaactcataaaaacaagtaggaaatctaagaaaagcaatataaactttactggaatttgaaaacgtcttctgagccattaaaactacagtgccttaccacatacttttgatttagtagaatgttttttgctgtttatccattcatttatctatgtctccattcctctgagctttggaatactcgatccaagtagcttttagttggagatctgtaattttcacattaaacgaggaattcttcagcaaaaattgataataggtcctattctcaagtagggcactagatggagcatgtgaatttaaaggaaattaagatctatagttactaatgacacaaatcacttaactcaataaaattaaaaaaataaaccaagtttatttttattaatttcaactaaaaatagagaaatataaaacaacgtaacgctttttataagcttatgcaaagtctaggaaaatgtttttaaaggagataaaaattgaaataaataatgctttttctctacgatagaccctccaaaccccatagccagaggaggaaagttaagcgggcagcagtttccaaagaacactagttgtggaaggcagaaatagtgctacacatatatatattttttctggttgagaaaacgaagtggtctttatcagagtagagaagtcttgcatctacatccacttctagattgcctacttcacttttaggagcaaatatttctaaagaatttgatcacctgtaagcatggaaagaggccacacattgctactaatagcagttaaaatttttaaaaagttattttttgttaatacaatattattggggaagattttttacaagaatcaagctcagatttgcagacaacatctgcatgattcttggaagttatatctgtgagacagattggcatagcacacaatctccttcaggctcagaagataccaatgttgatcctagtgatattgcattgtgtatattcacactgaaaattaaaactttctactagactgcatctatttgtgagattgcaagtaaggtttggtccatgcttccatttttagttggctataaaaatgtcatccaatgtgaagcttggcatttctgtatgcagctcaggctgccattaaatccaggtcaggagttactgaaggaaaaaaaagcctggaaaactcaccattggttcagtggtattttgagttctgacttccttccccagtctgcctgttacaatttacttctcagagtcttaagatagctgctccatgcattctgacaagggtatttagttgtcttcagtgaggagtggagagggcttactccatcttgaccagaaccagatctgaggtaattttttaattattgattttctttgtcaaatgatgtgcagaatatgcaattataagatataaatgtaggaaggagacaaactagctgaatttaatatggtaatttaattatttcatgaaaatgtggtacaatttttttttttttttttttgagacggaatcttgctctgttgccaggttggcatgcagtggcttgatctcggctcactgcaacctctgcctcccgggttcaagcaattctcctgcctcagcctcctgagtagctggggctacaggcgtgcaccaccacgcctagctaatttttgtatttttggtagagacgggatttcaccatgttggccaggatggtcttaatctcttgaccttgtgatccacccgccttggccgcccaaagtgctgggattacaggcgtgaaccactgtacccagccagtattttgttttttgattaacttcaagcaaaattattcttaggttttatgtgaaggggattttgatcggaaatatgtatcctcctgctgttttatttaacaaaatggctagctagaggcaggcagcagctctgagttttagtaaaaatctgtattacaaaccaatttgatttttctttgccatcaccaatatgtaaagtcacagataaataattctgtttaataattttaaactgcttaggttataaatttgatttgattaaataaaaattaagcttcattctactttggacctttatatgaattagcagcaaaactggttctaggactggagatgactaatagcatgcttcaaatatctcttttcaaatttatcagtgatggagattgaaaggtaagatttaacttaataggctagaaagagagaaatccattttatttggccattaatattgcattataaactcaagactcaatatgcagagctgataagtttgcttcttcctttttacctacttttgtgaaatgcataccaaagggtggggtgtacatcaagattccatgacttctagctggtacttaccataaaactttcagtcaacaccagcttctaggatctagctagatagaattgtattggtgggtgatatcctcataagctgtgatgttgatgggcacaaaagtgacagagaagaatcaagaagttatgcttctgggctagtgaatttacagtatgtaggacagtttatgtatgattttgtttagtcaatgatattcagagtaatgtgtgtagttatgcaaattgttgattccaaatgttaacaaggatgtaagaataataattagtacatgttttcaactttattgcatttttatatccatgactatatgtgctttcacagctacctgggagatagacagatcagttatgagtaattctatttatagatgaagaaaaccgatatactggctgttaagggatttgctgagtgtctcataccacattgctcgcaactctgaaactagggtccagagctcttctagccaatgctttcctcctaaaccgcattgaggagtgatgagtttatgaaaggaattacgggaaggcctactttgaccttgaattaattttaaaccttaaagagctatattttagtataccagaggggattattactgattatcaaacaagatttttaaatccttagtgaacagtgccctccaggagaaaaactcacatatatacacaaaaagatgtgtataaagttttaagtgttgcattattactagtagcaaaaaaattggaatcagcctaaatgttgatcaacataggactgagtaggccgggtgcagtggcatatgcctgtaatcccagcactttgagaggccaaggtggcaggatcacttgaagccagaagtttgagattagcctggacaacaaagcaaaactccatctctacaaaaaataattttaaaaaattagccaggcacaatagtgcatacttctagtaccagctagttgagaggctgagtggggagggttgcttgagcccaagagtttgaggctgcagtgagctatgactatgccactgcatttcagcctggtgacagagcaagaccccatctctaaaaattactaaataaataaataaaattttaaaaacaacaaccccccccatcggactgagtaaataaataggtacatattcataaagtataatactacccagtgattaaagtgactgaactaggtaggtaggtaagtgggtaaggtagataggtagatagatagataaatagagtttaaaaatcataatgtttaatgaaaaaagtaagcttacagtataaaacctaagtatgatatcatttttataactaaacatacagaacctgtatattgctcatgggtatctataggcatatgaccaatatttaaaaatagactggaaggaaacccatcaaatagtggtcacctcaggagagaggagtgggatgggacaagggtcacaaagggatttcacatgaataagaaaaaacataaacagtgatcaattatttggtatttactatattaatctctgaaagtgttacgtaggttaaaaactatcacaaaagttgggggtggtgctggtagataaagcaaggggacctcaagggaagtaaggcacttatggctataccccagtgagaactatgtgcctgacactgagcagaagtcagaggtgtttattctggaagtgctgtctttggcatttaagaaaagcaagtatgtgtattaggtgggcccatttggtaacactcctcactctggcaggaagtagacttgaactatggagatcactttatcccaatagttctacagtggcaggaaaagcctggggacctggactggacttcctgtccctgtctctgaagtctctgaacatatcacgtgataagattgtgaatgagccatgcttgctgcccgctttctgctacattatttgctgtcttaatgcttaaactctcttgataaatttctaggcatgagaggatgcataccagaagaccttatcatgtggaagatgctgaaaaatactgccttgaggatgatttggtcaacctagaggttctggatgaggtactaaatatttagtagacaattctcattgaagacatttgtttcatgtgaatggtctgaactttctgttgtagaccatgtcctcctaaggtcatttgaaaatttaattgtttgtgtagctatgggatgaagttcagggagcattcagttgctgtgactatgatcctgtgctgtgtttatttagatagcccctagaatgatgaagagaaaaggatttggatttttgcaataaagctctttatattgtagccttaatgatggattatatcagctgaaaatattttgtttgataaaatttgataaaatatttcaattaacccttaagaagttgtttgttcttcataagaaagagcttcatttagggaaatagtgaagttaatatagcttgaattctaaatttgaagtctgtgataatccccatttaaaatatgcatgtttaatagagctgttaattgcactggacctgtttatgctgagtctaactctggggattgttaccttcaatgtctaaatcactaaagtgtaatacaaagtggttaattctgtatttatgccacctaggttttaagtgcagtgctttgagaaattaacttaccattctgtcggtgctctatcagtaggaacagcctattaaataaaattttaaatacaacattttgactggttgagatgagtttttttttcacaataacaagtaaaatctttgttggatatctcagtgtcttttagcaagtcctaagtgggcctaattctttcagtgtattcctattttttctttcaaggcaaatattggcattgttttaatgaattgggatcattagggtcattgtatgatttaaatggactactttcatcgtttagagaaagatgttcttggaagaataaatttgttgtcatttttagaatctatcccttgactgggaataatatttacctcaataccatttatcctcttcttaggatacaattatccatcagttgcagaaacgttatgcagacttgctaatttacacatatgttggagacatcttaattgccttaaaccccttccagaatctaagcatatactctccacaggtaagggatgttttaagagcatactgctccttaataggaaattaaaactcacaagggcaaatgaagagaaagaaaaagtaagaataaaattatgctaccctagatgtatatactccaaactgcagatagtaatgtaatacaaatggaatttttacatcttgagaatacctttttaaagcaaactatagcaataatagttaacatttattgcgtgcttactgcgtgttagacactgggttatctcactttttcacaccctgtgggacaggtactgttgttaaacctagttggcagacagggagacttagcatagagtgaactccctcttactagctcatgaagccagtaagtatagaagtgaaatttgaactcagtcctgcaggctccagaacctataccctacagtcttcctaatgcaacaagtaccctaataagtgacagattcttggtttcatgggcaataggtagtggagtattagatggtccaggggagagtttcctttaattatttttccttcagttttccagactttatcatggggtgaaacgcgcctccaatcccccccacatatttgcatcagcagatgctgcttaccagtgcatggttactctcagcaaagaccaggtaagaactcaccttcctttcctacggagtcacccagttaagacatgttgtgtcttcctcgtcaactcctaagtcttcctgaaacctttccattccggttgctggtgctgacccaaagagacaggagatgaagtggcagctctgtggaacttgagcataggtaaagccatagcatcgggagaatgtgaaaatgcttttcaagaaacataaaacagtcacatgaggtgcgctcattttctctgataagatataataaaaatgtctctaatatgaatatgatgagaacagtgcaaacgcaacctgattacatggcagtgattgtaataaaaatagcatatagaatggcataagtgaaattctttcctattaaggtcttagaattttcatgattcagtcttttttgtatgaaatattgcacagaggttgacagtgaccatgcaccacaccatttagctgctgaaaaattgtgatagattgggtagagaatgaacaaaccttaaactcaatactaaacacaggctcatccattttacctttctagccttctaattcacattgctcatatatctaatctttcatcccttctttactttcaataggtatatttttctttgtttctttattctgtttgaaatagaagtagtctaatttggcaagcaaattttctgagggtatcaatgtgtggatttcctaagatctggaaaagtcccagctttggggtttgttgagtaatagatgacattataacaacatagattataaaatggaatacatggattcactgtagcttagaaacttagctcttccaaattcttacctttcccagatacttgtaaaatgtccatagatttcatagggaggaagtaaatggagagaaatatatatcgtttttaagttaagaagttgcctcactgtgttgtcttttttgacaccacttctgacaccaaatgttgtattttttccagcatgaaccaattctccaacaccaactgggtgcccaacaattcagttcaattctgacactacctggagttagcacagactccacagattaagcgattagtgccacaagactgttcccactttagatgccagctgcaaatggagtacctaggcttctcacacatctgcccagccgaataccagtccaggggttcttgtgactctctttaggtttgataattcactaggaatgactcaaggaactgaggaaaacactttacttacatttaccagtttattatgaagggtataactcaggaacagccaaatagaagagacacatggggcagggtgtatggggggaggaagggggcatggcacacagagcttccatgccttttctggacacatccccctcccagcacctcaatgtgttcaccaactcagaagctctctgaatctccttgttcaagaatttgtataacttaatctttaaatcccctcttctttctagaagttgggaggtagggctgaaagttcccacactctaatcacatgtttggtctttctaatgaccagtctgaagctgtctagggggctcaccttgaaccaccttcttaggaataaactgaggtatggttgaaaggggctccttgtgaataacgaaagatactcctaccactcttggaaatcccaaaggttttaggagctcagtgccaggaaccagggacaaagacccaatatataatttttattataccacatccactaatttcctttatacctaaagagctcctagaaatgaatgataaaaatatcaacaatacaataaaaaatgggcaaacaatacggacaggtcatgtaaaagaaaagcctcttaagcatatggaaggaggcctcattcataatttttaaaatgcagaataaggctgcactgagataccatttttttaagctattagattgtcaacaatctaacattctgttgttgaggctacaggagagcaggcactttcacatattggtatagtccctaggaaagcaatttggtaacgtgtgtcaaatttacaaatgtatttaccttttgatccaacatccccatttctaggaatttctcctgcagatgaacctgcataaaaatataatgacttaagtataaggttattcattgcaatgttgtttataattacaaggaaaaaactcaaatatcccaatattggacagattaaacagattatggtacatatgtacaatggaacaacaagtagctatacaaaaggttgaagaaggtctctatgtactgaaataggaagatgcctaagatctatctctcagtgaaaaattaaggtgtacagtagtggatgttatatgaagcatgcaagttgcttctgtgctataaattcttcacttgacgctccattttctgtgccagtgcattgtcatcagcggagagagtggctctgggaagacagaaagcgcccacctgattgttcagcatttgactttcttgggaaaggtattgactaatctgctttacgtattgtggcgagaagttcctacagagtaactgcatatttgataaatgatggaagtgctgggttttttttattaaggcttacataaagacattccatctttgctacgtttgcctcctgatagcgaggcctcttaagatgtcagcatgctatccttccttcacgtagggaggagaataattccagcacaaatttactagattatcggcaattaattttcatgttttcaatgtaatagaaacattcagccattaagtagtaaaaatggttaagcactaggaacaggatcagggaaagccactatagtgattaaaaggatgtaaaatagaagcctttgagcaaaagttgagggaaatgaaaattttcagcttggtgaaatcaatattgaaagaatgaattcaaatagtctagtagttacttacactctgaattagtgtactaggtgactaagaaagaatgtatggaatttttatagataaggtttatagactattacgataaatgccagaaaagttacgggatctatttaaaaatctttctaaactggttaggtgttttatctgtcaaggattttaaatgaaatatggctggatttttaaaactgctgtcctaatctagccaaatccgattcatatgcagatctggggagttgctcatatgagaaaatgatgctggtggttgatgctaacgtcccccaaatggggctctttgtaaaaagaccatgtggattttggtgggcaagggatggtgcctggcaactttgctggtgtaatgtttctggagtctcttcttgaccgttctctgtttggcacaggccaataatcagaccttgagagagaaaattctacaagtcaactccctggtggaagcctttgggaactcatgcactgccatcaatgacaactcgagccgttttggaaaatatctggaaatgatgtttacaccaactggagttgtgatgggggcaagaatctctgaatatctcctggaaaaatccagagttataaaacaggcagcgtaggtgcactactttatcactgtgtttttgccctgcagtaaaaactgggagactttggaaattttaatggttcagttttcattcttgttcttaacattcccctaccctccccaagggcaaagaattatttaagcaaaggatcagtggtagtttttgacctaaaagaaattaatggaaagagtacaaagggctggggtgggcgtgctttagggatgggtatgcttgtttctcctgagttggttgtgtcaggtagaatttagcagcattgcagacattttttaaaaccctgaggccccttaaaattgaacttgttggttaaaaaagaaaaagacaccaagaatatttcacatgttaattttttccttagattgagacagatagagaaaacaattattctgtttttagggaaagcatttggtaatagaaatcaatagcacagactttgatctgggttcaaatgcaggttctgatactcactgtgtgacattgggcatttcactaaccttctctgtgcctcatctgtggaatggaaatgctactagtgctgacctcatgggtttgttgtgaggattaacatgttcatttatataaaattacttaaaagaatgcctagtgtggtacaccctatcagtgttagctactcttcctatgataataatataaccactggtgtggtacatactatcagagtgttagctactcttcctattataataataactcttcatataataataatagctattattataattgttaataataatagctattattattattgtaggacaccagagtttctcaggagcatggctccgcacttccatattaatgcattattgaatccctgctgtttgccagtgctgtgctttgtgttggcttgtaagagcaaactaaataaaaaagattcttgtattcacggggcttagagtatgcggtatatgaggaagcagtaggggaggatcacaggcattaaacaagtaaacttaaatgtagaacaattgtaataagcaccagaaagcaaagtaggtgctattaaggtgaaacgagagaagggaacgacacataacctagtctagggagaaagaggggctccctgtatatgagatcacaggatcaccaggagttaggcaacgaggtggggaccagagcaaggaggaaaagtggcaaagataagactgagaccaaatcatgcagggctttggaaccaggataaggatctcaaacttttttctaagggcaataggaagccactgaacgttttcaagcaggggagtcaccatacccaactttcattttgagatgatcacgctagcttcaatggggaatggattgggggagatgcaaggattgtgttgacatgattaggaggctgttgccagattcatgtgagagagaacgctggcctagactaaggcggtggcagtggagatggagagaagatgaggagtctgagagatactgtgcaagtagaatttacaggaattgttctgggttgaaaacccaagcatcttcctctatcatgtacttgcagtttcctcacgcagtagggactggcatgaacattaaacaaatgaaagacagagtcagagtcatttacgcttccctgtggctttttgattaatttttatgaggtcccctgcttttgtctccccaggttagggtggttttaaaatttagggagctacctctgacagaatggaaagcatagtgttctgtgttcaaatgtaaagtggtcttttacaaagataatgtgaggagagttctaggtcacttaatgtgatatgttgcttattaatgtaaatattcatataccttactttcctcatatgcaacatgggcataataatgtcaacctcacaaggctgttatgagaattaaatgagatgaagagaagatggggcctgtcccagtcctgttcatctaactgttgggattcacccccttctgggcacactgtagggttcctgtgtggctgggtgtggtcatataactggttctggcaagtgggcatgtaatggcaaccctccagagtctggcacagtgtaagatgggggctgctctgccagccacagcccatcagtgactgcagtgagcacagccccaccgctgacctgccatggacatgtactctgagcaagaactaaacctttattgagttaagctactaagatctgggggtgtttattatcataacaaagcctagccaatcttgacagataaagggatgaaaatgaaactgaagtgatgctagggatggatgtcggcaggaaaagcttggaagaattgagaactagatggatctgtagaaaaactaaaggaatgtaagactaagatgggccagccaaagcctgcacatgtaacagaggttaaagaacaagtgacattcatctcaggcctttcggttcctgtctcagtgaagggtgccaccatcactagatgctcaagctagaaatctaggaggcagactctaggtttctttccgtcaccatcctcattcagtctattaggatgttcttttggttgtttctccagaatatatataatatttaagcttaccgttattctccatcaccactaccattaccctatccaagctattatgctttctcacctggaccccctcactggtttccctgtagccatcttggcttcttataatgacactcagagaacatgaatccctttagtcctgtatccctggcacctggtatagtgcctaccgtgactggcaattaatatgtttattcattgaatagtcacatttttctatttatatatatcctataacatgttgtatatcttaaatatacacaataaaatttatttttaaaaaataaaaataagggctgggcacagtggctcacgcctgtaatcccagcactttgggaggccaaggcaggaagatagcttgtttgagaccagcctgtgcaacatagtgagactctgtctctacaaacacaaaaaccttagtgggggatggtgatgtgtgcctatagtcatggctactttggaggctgaggtgcaagaattgcttgaacccagaaatttgaggctgcagtgagctatgacctcaccactgcactccagcctggacaacagagtgagaccctgtctcttaactagatttattagttaagtgaacaagtgagtgagaaatggcaagtagaggcatctagaatacagggcagggataaagaatgtcacagaagggctttgacaggataaacaaccaaaggaagatgaggagacccaggagaggctgaacagaatgggggccatgccacaaaggcggataaggggagaagaaagacgatttcttttcatggagctaggttgaccaaagaaaagatttgccaaaatccaagggtatctacagaagagactgtcctcctccagaggaaagaaggggatgtggagcagtgcttttcaaactctgtgctaagggaccactttttaaaaaaaatctccaacccattttgaactaatacctttgtaaaatgcaatgcaaattaattatcagaaaaattatcatgctcttggatgtcatggcaatgtcacttgctataaaacgtctaggcatgtacttaccagttccttctcttgttagaaactgacagcagtccacaggctatgctcagagtagcacctatctgaaaggaccctggccagggtagcctaaaagaggtggatggcaggagaccagactaatgaatgacattttgagtagtacttttaagaataccagcttgggagagtgaaaaacctcagttctggaccaattctgctccctaacctgctgtgagacttgcaggccacttcctgtctagggctccagtaaagtagaggatttggctgatgtctctaagctggacctcactgtctctgaagcaacatgtggtacaagcagaaggtagtaggcgtttgggctgcaatagaaagagctcaacatatgtaacttgagctgtttcctgtaaatgtcccattctctgaaaccttttgcttgtcgtaaagtgtgtttaataatgcaacattatgacaattactatactaatcctatcactattctgtaagtgggatttataatatttaattgcctgaaaatacaaatttgccatggaataatcttttgtacagaaaggaaatggtgtaaaatacttgggatggggaagccagaatatattattactaaagtctctttttttttcaggagagagaaaaattttcatatattttactatatttatgctggtcttcatcaccaaaagaagctttctgatttcagacttcctgaggaaaaacctcctaggtaagtgtcaggggggttggttgttaatttttgatgaatgtacgattagcagttgacaaacttggaagtaaatggagctgttttcctaactggaaactcacagtctatttaactaaagtgcccagggtgaggtggcaggaagtatccaccattttcattgtctagaaagttcaaaaactcaactgcacatggtttattttttttcagccatttgcatcattattctaccacagtattagactataaaggaaatgggctgggtgtggcggctcatgcctgtaatcccagtgctttggcaagctgaagtgggaggattacttgaagcctggagtttgagaccagccagggcagcatagtgagactctgtctctacaattttttttttaattagctactcgggaggctgaggtgggagaactgcttgaacctgggaggtcgaggctgcagtgagccaagttcgtgccactgcgctccagcctgggtgacagagcaagaccctgtctcaaaaaaaaaaaaaaaaaaaaattagctgggtgtggtggcatacacctgtagtccaagctactcaggaggctgaggcaggaggatcactagagcccaggagttcaaggctgcagtgagctatgatcacaccactgcacttcaggctgggcaacagagtgaggtcccatctttaaacaaacaacaaacaaaaaatggaaatgcctgtactactttccaagtcagtgctcattctgtttggtcatgctccacttcatttaggtacatagctgatgaaactggaagggtgatgcacgacataacttccaaggagtcttacagaagacaattcgaagcaattcagcattgcttcaggattatagggttcacggacaaagtaagtgatgatcaagagaggaactcaagtgacaatattcttatatgaatgtgagtaaagatgtggtatttctcacttgggataagacacttgctttcaaatgccatgttggtcatgttataaggtcttgctactcaaagtgtggtcccaggaccagaaacattgttatcacctgagaacttattagaaatgcagaccctgaggtctatccaagaatgactgcatcagaatataatcattttaacgagaagtccagatgaacatcaaactaggggagcactgttttaaggaccatgtgctgataaattgttatcattgtcatcaattcattacacgtgtaataacaaataccaaaacaatactgtgggttttttttctgattgagcgttcttccaaccattaaagtgaacggggggtaggagtacaggaatatgtagatgacacccaagtcacagaaatatatttatgcaagtagctccttaggtaacaagacaaactaattaaaaccctttcaactttcttgcagttatttccttctccagggtacacagttgcacattattaactatagctctaagtactgtactactttttttttttttttttgagacagaatcttactctgtcacccaggctggagtgcagtggcgggatctcagctcactgcaacttctgtctcctggcttcaagcgattctcctgcttcagcctcccgagtagctggggttacaggtgtgtgccaccacacctgactaatttttgtatttttagtagagacggggtttcaccatgttggccaagctggtcttgaactcctgacctcaagtgatccacctgcctcagcctcccaaagtgctgggattacaggcataagccaccatgcctggccaatactgtactacccttatcatcctagatacaagctgtctgtattaaatatatgctaggggtgacagacaatatttataaccctaggctcaaatattactctgtgatacattatgtcatagtttctgggcttcatgccatcaattttgcaaaatatatagattcttttgcttttccaacaaagggggtgaattattaggaggtaggtgagagtgttaaatcttaagggattagattacaagacactccagttaccctgggatggccactccagataaaggattacttctgtgtaatgcagtatgattggctagcccttccctcccctgcatggttgattttaatcataatagtacctttcttttttttctgtctagccagctgttaattttctctgtcagcctcccgcagactttaaactgacagacaatggaaaatcccaaaggtcagataaaaatataaatatattttccttggcttcttagaggggggcaattaaacaggttctagcattgttaaaggacctttgtggttattaacttaaagaacaggttttttaaatcaaagatgcatccccagaagagttaaagcatggtaggaatggcagtggagcaatttaaagtcacttgtgtcatgccaaagtacgcaggggcacatgtccttaaaagggtacaggaaccatagagaagtcaaggttaataatcattaacagagttaatattttgttttctttgagtacaaatatagttatagaatactgtgaagagactgatcctagctgaacccatttatgcctagtgttccattattggaatgctaaacatgtgggagttatttataccctactgctcaaggtcatcaccaaggtctgattgcaaaaattcaaaacattgcaacctcaggcttaggtgggttaaaagaaagtatataatggtgccattctaataatagcaatgtactgctaataataataaaacagatgctatctgtttcaggataaacaacgttgaaaactgttaaaatctgttttagtacaacaacactaaagcattaaaaacagaagaattaagtatgttaagtatatgtccttgaagtaagccatccctagcccctctgggaaaaaaggtacaatagaaataaatgaatgactgtatgaataaacatgaaaagaaaaaaatgtaaaagatggtgaacatttttcatttgtgcctggtctgtactgttaaatgaataaccagaatgtaatggtgttatgtgtgtatattttcaccatgtcccacattaattcatacaggaaataaaccaatttatataagctgcaaccttagaaatgaaaggaagaagcaggatcttctctctccaactctgaattctgtggttctatctctgctgacaacctgttttgctgagttaactcagttcacttcatgtttataaactcaaaaagtagtgtgactaaattcagaaagatccagttgaaggtagtcaggaaacagatgccaaatgctgatgtaacagaactttctcttaagtttttctggcagacatttctagataaagcttaaatgaactgatcaagtcaatcaaaattatggttcttctcctttcttacaatgtcactagttccctgcaggaatccctttagtttttctcaaacccttacagcaaaattatgagtagcaaactttagtgtggagtcaggagcatgaattttaattctgggacaacagccaaagtatctgaaagaacacttgaccctgagtttattgtaaagaaatttccctggtggaggagtcttccactaataatgatgatgactccttgtggagggctgggggattatacctaagaccttattgtgaagattgtgcttttcaactcttatttctggagccaaaccatactatttttgtttaaaattatatttgtcttcctggtaggaattaacatattacataaattgggttttagatatgtttctatttaatgctacatgaaaactttttgggcagatgatctatgtgatggtcaagattggacgtacactatagatccctgttggagaggttagggagaagcctttgagatcggcgcaaaatttcttccctttcttcaaaatagattatgaattgagagagtactgctctgaagagagattgaaggattatatgtgaaaatatgactcgggagtcttgaggatttctaatgtcttgatgacagacaataggataccattgacttttaagatgacaaaagttgtgagcctctgcaaaggagaccgagaagtgttggaacagagcctgtggggaggtccttcagctggtcctaatgcagtgcttagggaagaactgatgaaaaactgacgagatttacaaaaaagaaagaaaggaaagagagactgggaacggaagtaaattcctagggatataccagagaaacaactaccggagatgcctgtgagccaggccaagggggattttcttagagtagcgccaggctaacagagaaaactaagttttctctctacttttcaattagcctcaactctatcaagagaatactacatcaaaagaagtgtcttatgagaaaagagaagaaaatatcagacatcctgcagtggggctttgatggagaaatgctctttcttccccactgttgttgattggtagtgaaacagtttatacccatcaacaataaattgagaaacccagttggaggacttggtcttcttgagtaaagctattccactttataatatagaaagctgaaaactggtagaaataaaaagagacagcagcgtagcaagattctgcagaaaaggcagagatgccaggaaaggctctgtagctggagatgaagcaagagaaaatggacaaggtaaagaaggtgaaaaaaccttccctggctgtctgttggggagacaataagaaaaatttgattgaaaagttttaaggcaggaagagtaatccctcaggtggacatataactaattgaattttgccatgagtgtaactgatgttttgacctgaaagcagaggctcctagatcagaaagggagaactaattaacccaaggttaggactgatggagtcaagtggatggaatagcccagaaatataaactccttaataaggtgagcattggttaccccgctgttagttctcactaaatcaaggaaggagacccaatcggtcattaatttcagtgattcacacagtgtttgaacctaaaagtttttctcagggtcatagatagtttttcactttaaatggttgtctaggcactatgctgaagagggtagtgccagagaagcaacggggcaagatgctggtttcaagggtatagtctttgacagtcattttctatggtgattatcccagtggtgaaatgctggaagtcttattttgggaggtttcagagcttgtactgtaatacatgaagaaagagagagagagagagtctttgtgtgatgtgtgttttaattacaggaaatacatttattttttctaagagtactgagagtttcagataacctcgatatagaaacagctgatgtagaactcactgcaagagtctctgttttaccccctgggatctgcctctgtgggagttgctcagtgtagtgagcaagcctcacactgtattgatcaaagtaacgaggtgctgtcatgttaaatccgagcaagtcccagaaaacctacttagtaggtgttctccttagccactcttaagttgggtgattaaacaatgattcttaaagtaaaaaaaaatgacatattgcctttgatttagaagttggaagaataacatttatccattgtagaagcctcgtttaaaatcttcatttgtctttgtagcattatcaggtatccagcagatgtcactattatagtctgtgttcctttttttggctttactgagtaatgtttataggaagttgtaatctgtgaggcaatgctttatcaatggtccagtgaccgttcctattcctttgctgctgtgtagagtaccaaatcaagttacctgcctgagtatttttgtgaaagtacttttctctgtctataagcataaaatgcaaaattttcctggctatatatttcgttgtttcacgtatagaaaatgtaagtttttaaataagtaaatacaccttaatttctttttaccattaatgatacatatgtattcaactttcaatataaaaatagagcttagataatcggaaccgtttttactcacatttctgacaccaaatatgtgggtttttctcccccatacctgcaaattatctggcaccagctgggtgtcctacaattcactcaattctgaccctctccacctggagttagcatcagatcccacaagctaagggctcagtcccacaagactactctgactccagatacctatacttctgtctcctatacttctgactgactggctataaattgagagtccccacaattccctcctcaggttggataatttgctagaatagtttctagaactcaggaaaacactttacttaccattactgttttattatataggatacaactctgctgggcgtggtggctcatggctgtaatcccagcactttgggagtccgaggcgggtggatcacctgaggtcaggagttcaagaccagcctgaccaacatggtgaaatgccatctctactaaaaatacaaaaatttagctgggcatggtggcaggtgcctgtaatcctagctactcaggaggctgaggcaggagaatcacttgaacctgggtggcggaggttttagtgatccatgatcacgccattgcactccagcctgggcaacaagagcaaaactctgtctcaaaagaaaaaaaaaaaaaaaaaaaaaaaggatacaactcaagaatagtcaaatggaaaaaatgcatatggcaaagtatgtgggaagtaacatagagcttccattccctctgagcacaccactctcccagcacccatgtgttcaccaacctgaaagctctccgaatctcatcatttaggggtttttacggaggttccattatattcacatgattggttaatcattgaccattagtgattaactcaatgtctaatccctctctgctccccagagattgggttgaggaggacccaaaagttcgaactctctaatcacatgattggttcctctggcaaccagctctccatcctaaagctatctagaggtccaccaagagtcacttgcttagtataaactcaggtatggttgaaaggggcttgttgtaaataacgaaagactcctagcattcctatcactcactttcaagggttttagatgcttttgtgccaggaactgggagcaaagaacaaatataatagtccctccgtatatgtgagggattagttccgggaacccccaattcatataccaaaatccaagcatactcgagtcctgcagtcaggacatgaaaagtcagccctctgtatatgtgggtttcacatcttgtgaatactgtatttttgatccgtgtttggttgaaaaatatctatgtataggaggacatgtgcagttccaacctgtgttgtttaaaagtcagttgttggtcaggagtggtggctcacgcctggaatcccagcactttgggaggctgaggtgggcagatcacctgaggtcaggagtttgagaccagcctcaacatggagaaaccccatctctactaaaaatacaaaattggccgggcgtggtagtgcatgtctgtaatctcagctaatcgggaggctgaggcaggagaattgcttgaacctgggaggcagaggttgcagtgagccgagatcgcgccattgcactccagcctgggcaacaagagcgaaattccgtctcaaaaaaaaaaaaaaaaaaaaaaaagagagagaccagtctggccaacagggcaaaactccgtctctactaaaaaataccaaaaagagctgagtgtggcagtgcatgtctgtaatcccagctacttggaaggctgaggcaggagaattgcttgaacccgggaggcagaggttgcagtgagccgagattgtgccactgtactccagccagggtgacagagcaagactctatctcaaaaaaaaaaaaaaaggttaattatatatatttcttgttatataaaaatataatttaatatacaattatcacagataatttctagtgagtctttcaaaatatttcctgacttcataactatatattccatcatttaactttaaaatgttctaggagccatgaatgaatgtcttcccaactacttcataaaagcgatattcaaaagaggttaaggaaacagctcctctcttgctttgaacaaaagatcatacctgaatttgggagctggtattagttagggtaaaaggctgaaagtggcttaaagaacaaagaagattagttatctcttaataaccatttccagataagaggttcaggttgcagagcaactccgtttatgcaattgttggtctaaggcatcctcatcagtggcatggtaaggctgtgctgggagttccagccggcaataatgagaaggaaagtgtggaggaggcatgctcatgccggtaaggcctgggcccagaagtgacccacgtcattctgcttgcttcattgttaaaatgtagttatatgacgacctctaactgcaaagaagtttgggaaattttgctgtgtgtccaggaaaagagggagaatggactttggtagacaactagtagtttccactacaggtctaatggttcattagtttgactggcaatgaccttcatatatggttcttgatgtccttttcaggaggtgcactcagtgtacagaattttggctgggattttgaatattgggaacattgagttcgcagctatttcctctcaacatcagactgataaaagtgaggtgcccaatgctgaagctttgcaaaatggtaattatttgatatttgtgggctgtgttgttgccaaagcacgtgcttctttaggctctgtaaaatataatgcagcatttgctggtccttttttttttttttttttatcgagatggagtctcactctgtcatccaggctggagtccagtggtgcaatctccgctcactgcaacctctgcctcccaggttcaagcagttctttgcctcagcctccagagtagcttggattacaggcgcctgccaccacgcctggctaatttttgtatttttagtagagacggggtttcaccatcttggccaggctggtcttgaactcctgacctcatgatccaccccccccccctcggcctcccaaagtgttgggattcacccagcctgctggtctttctaatggctctggatgttttcatgaactagtatttccccaaggatgtcctgtggaacaccagtgttccttccataagctgcaagtattctgcagaaaagaattctatggcaggtaattttgagcagtgtttttttcttttttttttcgaggcggagtctcgctctgtctcccagactggagtgcagtggcgctatctcggctcactgcgggcagtggtttttaaccttggctgttttaaaaaaatcatctacaaactgaaaaagatacaggaggttgggcccattctgaatccactaaatcagcatatacaggagagaaagcaggcgcctatttatttttaaagttccacgggtaattatggtggcacaaagagtgagaatcctcaaatatgaacaacaaacaaacaaactgatttaaatgaagtaaaaacctttttgtgttaaaactgtaggacattttagggcctttaatatatgaatgtattttgtgactaagggtagaatacagtctgcacctatttccccaatttatttggcaaaagaccacctcctcttccttttttttcatcaagcatctatgaagtaagagctttcagaacagtttgggagatactgtgtcagtctggaagcttcttggggttagggatctagcctgtttatctttgagtcaaaagtacccaaatggagtctggcacatagtagatgttgaataaatgctgaacagactgactgaatgaaggtctggctacattctgtgttatccttactctttgtttcagctgcctctgttctgtgcattagccctgaagagctccaggaggccctcacctcccactgtgtggtcacccggggcgagaccatcatccgtgccaacactgtagacagggctgcggacgttcgagacgccatgtccaaagccctgtatgggaggctcttcagctggattgtgaatcgcattaatacactcctgcagccagacgaaaacatatggcaagttcctcggagagcagagggtctcaggagagctgtcattgaccccgccgtctcttagagtttgcaaaaggaagcatttggtcctctctgggattttctttctttttctttttttttttttttgtggagtcagagtctcacgctgttgcccaggccggagtgcagtggcacgatctccgctcactgcaacctccaactccagggttcaagtgattcaactgcctccgcctcttgagtagctgggattacaggcgcgtgccaccacgcccggctaatttaggcattctcttttagaagacacagtgagatccaggacagttgaagcatttgtacccgagaggcaaaggactgaaggagccactaagtgtagtatttgagagaatagtcttggctgggagctggacaaactgggttcgcacccaaactctacagcttaacccatttatgcctgaggttgcaattttttgaattttttcatcagaccttggcgatgaccttgagcagtaggatgtgaataactaactcccatatgctttgtgttccaataatggaacaccaagcataaatgggttttaatcagctgcatgttctaagtcagttttctcacctgtaaaatgaggataataatatcctcttcatagttttgtttttagaatcaaagagacattttatgaaaaaatttaaagcacactatcttacattactattcctacttcttcaactacttttccttgctctttcctaggcgtagtggtttcctatattgtggaggaattcaccacatcaaattctgaagagtactcttccagttatccttgtgggtagataggtgggagaataaataagcaacagctgcaaccccttcaaacaaaaggactttaaaaattttattttatacatggagtttctgagtaagattttaaaggattctactgcttgaaaaaaaaaagaagttgaaaatactattgaaaggccaaaagaacaaatagtttgagacataaactgcttcttttcttaggggtggcaggatgctgctttccatgagtgggtgaattgggtacttgagctgataagcacttgggcacatatattctcatcctctttaggtgggtgtttcctcccctaaagagttttgttcttctctctcatgcagtagtgcaggaggtggaatgaatgtggggatcttggatatctttggattcgagaattttcagagaaattcatttgagcagctctgcataaacatcgccaatgagcaaatccagtactatttcaatcagcatgtttttgctcttgagcaggtaatagtgaactctgaggtaactaaacttgatggggaaaaggtgtctccaagctgcccacaatttgtagcagaaaccctgtagactaacaactaaaagaccctagagagaaaatagggtaaggcagtcctggctaaatagtctaaatttgtctggaaaaggtctcgatttctgtggaaaggtacatttcctcacttgagtggagctggtgacaagtcactcatttaaattttgtgtcaaaactctttcgtgcatattgctcaaaatactgtatctcttctactttatttaactaaaaatatttatgattgcgttcaaaatgacacagatgaccttgaattcgggacataggttcttaactgctacactagccctccctatcccctatctgctatataccagatcccacagtcactggagaggtatctccagggaagagtaagatgtgttcttggttttctagaaatggaaatcatccctctatgagtttaataataaataagacagagtaagaaactagtggacccaagggatggggctcttttcctgtggcagcagcctatatagcagtctgatcaaccccaacctttacttaaaccttaagactctcttctgtatgaagtagttgcaataatgaaacattctggctaagcctcttcgatgcagggataattgttttaatgcaggcatgaggacgcacaaactcaacttcgatgagatagacacaaagacatttagtgaaaataccagcattgcttttatctctggagctggataaatctgtatagcactcctctcccatccactcttgtttcagtccaggttccttccatttatttcccggtaatctggagtttttctagttttccaaccctagatgattcctttgtcgaactccttgcagaagagaagtctgttttcttggtttaaacaatatttctcaccaaaataaattttttttttcagcttcacttccttgtacattagtttctaaatgataagttaccaagtccacatttgagagagatgttttactggtttagctgctgccataggccacttgtaagtcagatttaagtgcacagctttaatggtgttatatgcagaagattcctttattatacacataaaacatatcctgctttccacatgcattcaatgttgctagacccagaaagtccatgtcaaagtatcctggtggtcccaaggctagttttgggctggagagaatcacaatccatttccctccagatggaatatcagaatgaaggcattgatgctgtacccgtggaatatgaggacaaccgcccgctcttggacatgttcctccagaaacccctgggactgcttgcacttttggatgaggaaagtcggtttccccaagcaactgaccagaccctggttggtaggtaacttctgagaaacaggcatatacatttagaacaaaacttggcttgtgtcatcaattgagtgtactttaatgaatttaccttacatattttgtttatatggtggtttgtaagaatataggccttctttttcattgaattgaagtgttgtggtagaatttgaatgttaaagcaaacccatcgctattcctaacaccttcccactttcctattcttgccaacatgattagcattacccccatgttgatttcatttttacaccttcctctctcttctttcctataggcaatgtttgcttctcctcctttgtgtgcccccatctcatgtcttcccctgtacccccatccacctctaatctgatttcatgcagaagccctttccagtctcctgacttccaggctcctacctgccccatctaccctggacatcccagctagtttagtctttctaaagccaccttctcattaggttactattatctacaggatgaatatagggcacctcgtcctgacatcaaaggccctctattctgtaccctattcttgaatcttcagtgtttttcacaacctttgttcctcacttagattgcgaggtgcttggggcaatgaagcctcagtctttatgtgcctttagtgcttagcagtttctcatacttagtaagctttcaaccacaatagcaaagatcgtgtgttaaaggaggaacaaaaagtttcaagccttttccccagctggaaaattgatttgtggcagagattcacttttatgagttgaaattataaccctcagtggttttcttttatatataacattgtcacaagttgtccagatgagtttaaaccaggttctaaaactaactggcagggcctctggtgtcatcagtgtccatgctaggagttcttagaaacagcaggagaatatacgatcttagagcacagcctgacattaagacaatgctacacaactaagcaaggatataatgataaatgcccatcatatcggtgatctttctccacccttgttaatatcaaggccttattctgaaagcccttattctgagtcattcatggcttgaggaacaagtttttgtttgaaagaggaaataattcacattgtaactctccaacataaaaatccacacagataaatttgaagataatctacgatgcaaatacttctggaggcccaaaggagtggaactgtgctttggcattcagcattatgctggaaaggtgaggccagtgtgacagttattagacctgaatttggcaaagggtaagtgtctgtattaccctgtctgtgctgctcatgaaattgcttacagatttctttcccattttaattcttcctgaatacctaatcataattcttaaagtttctcagtggtgccactcacagaaagttgcccctggcatagaagcaatttctcactggggtggcccacagtgttgccatctgcttctcacctgaggtttggcctagaactgacagctctccagagagaaaacacattacagctttttgcggtgtttagcagtaaatgttcacattctaaagtcatttggagacatgtaggtaatgcaggaaggttaatatcacagtgggactcaatttttagtactttaatcatatgtctaagggccccaaaatgtccagatgaaaagaaaaaaaaattcacattattatccagatgttaagcttttacaacttaactgaaatgtccacttttcatacattatgcctcagtctcaatttcaagttcctgaagcagattagtgactgattcaggaaattccctatcccataaccacaagttccttgcttatgttactcccaaaggagccatttgaattatggctgattggttcctctgggctctgctgaggctgtaggtccagaaaattggtaggagttcaataaaagacatttttgattattttattaatttcagatgtattgaaattgtcattcatattcacatcatggcattggaactgattttcctaactggatgttgggaaattctagtacaagggaaggggattatttttctctccacatagtactttatggtatctattttggatctttgttagacattgcaattcagtttttgcccttaaatattttatttaccttagcatattaaggtcctcctcagagtctgaaataccagcatctaccctgattcccctccccattcctcttttctgcctcccattcctgtcctcctcttctcacctctctgtccttttataactatgtcctacccacccgtcttcttgactcttactattttcctttcttgattttaggggaaaaactttttttatttttattttttctggcctctgtgtcctttgctgcatccatttgccattcaaagcttatttgtagagaaggaattctctgagggtgttccttaaaatttatctgaactggatcccctctgttctgagaaccaagaactactcagcatccttgagtgatcactcagatctcatgaggacctagggaggcagtgagagtacttaaagtggttgtgagcatagagtcaaactgcctgagttttgatacctacctaccacttgtgaaatgtgtgaccgtgggcacattactcagcctcttcctaagtctctgcctgcctaccagtaaaatggagataataatagtgtttacctcataggatggatgctttgcacatggtatctaatatattttaataattattctgatgtgatttatctttgatagtagtcttcaaaaagcaactagacaggccaggtgcggtggctaacacctgtaatcccagcactttgggaggccgaggcgggtggatcacgaggtcaggagatcaagaccatcctggctaacacagtgaaaccccatctctgctaaaaatacaaaaaattatctgggcgtggtgacatgtacctgtggtcccagctactcgggaggctgaggcaggagaatcacttgaacccgggaggcggaggttgcagtgagccaagatcatgccactgcactccggcctgggtgacagagtaagactccatctcaagaaagaaaaaaacaaaacaacaacaaaagaaaacccataaaaaacaaaaaccaaagcaactagacaataagttaagataaactggtctgtcaacatcataattattccctttatctggtgctctggatatgaaagctatgtaaagatgagttctatatagaggttgattaacaactggttaggcaagttgccagtgtcaccaatgacggacagttgacttggctaatttgccgtttgctattcatgttacaggtattatatgatgcttctggggttcttgagaaaaatagagacactctccctgccgatgtggttgtggtcctgagaacgtcagaaaacaagcttcttcagcagctcttctcaatccctctgaccaaaacaggtacttgggaaccctctgatagccctgctcttaaagcttttgcaagaccaggtgaaattttccagttagtgtctgaatactgccagggctgcaccgctaacattgaacttctttaagcaggagtaagggtctaaattcaagaaaaggaaaatgtttgtttcttttgtaattgaattgtgcagcatccgtgtgtacacagacacgtgtagctgcacacataaacatacatacactatccataacatcaactcttagactttcttgtccttcttttcattcttccctttataaagccatacgatatcattaattcatgctaagcaatctaggatagtctcagtttaccaaaacttatcaggaagattatttctacttgtgtgtcattccaagttaaaggagtgtgttgaatcagagttcaggggatcctcaaagatcaccttggtccaatttctacccagttatgaccccaccctacctctctcctaaccaatttggaacaggtccatcacctatgtatgtggcctttgcctacttacagttaccttctgtttaattgctgtcagtcctcatgccaaaaaagcaggaaactagggccaaagaacagaacttccaggtcttaactgtttttccaaatggattctaattgagtcaaccttttagaatgtacctgggattctgctgcttttagctgggcggccaactcagccttctcacagctctactctcaagggctttgtgttttttaggctaggtctggaaatagcagtgggcatgcttttaagaaaaagaggaagagaaacctttttatcactgttcattgttcactatttcctcttcttttcttcccacatccctcttaactggctgccaggtctgatttttagcagcttgcagaggaatgaaaagcctggctaagaaaaaaaaaaaagccacagtctacagcctttgcttcatcttaacttggaaggaaagttgaaatccggctcttttttcagacatgctcctgtaaacagaactagtagcagtgcccatcagaaggctgccctccagcttccattccagaccttccttggagcagccggggtttaattcaatatggaatcccaggagctcggggcaggtgtggaaagggctatctggtgtttccttaccagagacccagggatgtagactcctcatcaggcgacttcagcacagaggtgaagagacagccattattgataggggacatgctctctgggaaaaaaatctatccaaataactcttcagctggcatttacatcctcccacaaatattaataacgacttgtcaaatctgttcacaacttcggaatttccgatttttcaacctttggcaaaataaaaaccatttaacagcctggaccactagggggcgctatgcagaaagtaaggccctgcagccggtctctgttctcccttgattcacccaactgcgggaggaacaggaacaaagagataacctccgccgctgcgtcttttttacccctcccaaagagctttcctcttgtttctgaatcttgttttgaaactacactccacaccacttgatagaaacaaaagtgaaaaataagactagacacaaacgtgatgtaccaataggcttcccagtattcctgagctatatattatgcatagtaatttcctttgagatcctaagcttgagtatagcttaggattctccacattttgagtatagttaagaagccacaaacatcaaaacttataagcatgattgtgttttctttttctggaattatttatgtaggaatgaattcaatcaacaaacatttaaagaacagcttctagtaataaggtactttttaggcaacgagggaaatataggagtaaaggtaatacggctttgccgtacaccaactagaactttcttttaacttcattttctatatggaattttctatacagaattgggcactaatttatctccttatgacaatagttgccctcaaacctcgattctaacatgattgtgcatcctgtgttgaatgtcagaatattacttttctaaattttaaaacgttcatagtctatatttttgggggttattatgttacagcctttgaagatgggaaacctcactggacagaaataagttatgctgttctttgccaatgcttgtttcaggcatgtccctctcgtgaaggggaaggtgcctatacatcttgatgttcccactagaagcaagatcccacactatcctggcactttggaaaagaatatgctaatattttcaatgcataagaaaccattttcttgtcacttttatttttccttgctttaattgttttatcgaaattaaatggagcactagttcagtaagcatatatattatggtcaattactttacaaacctcttttgaggaatgaactacagggaggaaggaaaaagatcaaagttgaggccaggcgcggtggctcacgcctgtaatcccagcactttgggaggccgaggcaggcggatcacaaggtgggtggatcacgaggtcaggagttcgagaccagcctggccaacatagtgaaaccccgtctctactaaaaatacaaaaaattagccgggtgtggtggcgggcacctgtaatcccagctactagggagtctggagcaggagaattgcttgaacccaggaggtggaggttgcggtgagccaagaccatgccattgcactccagcctgggaacagtgcaagactccgtctcaacaaaaaaaaagaaaaaaaaaaaaaaaaaaacttgggaaaccttagaggcaattagctcaaagcataaaaggaggtccagtgctggactcctcaattttgaaagaggagaagacgtttgttaggaagacccctaagagatgttggcagtggtctggctcctgatcttggtggtggttacatgtatgcttgcattatatttattatgctgtacatttatgttttgcatacttttttgtgtgtgcattctgtgtcatagtaatgttgggtttttttctccaaaagatagagaagaccccttaaaatacaaagagaaaaaaaaagcttgatgtggtagcgcatggctagagtcccagctactcaggaggctgaggcaggagaatcacttgagcccaggagttcaaggccggtctgggcaacacagtgacaccccccatctctgaaaaaaaattagaattaaaattgtttaaatgcaaagaaaaactttaatttctttatcgaaggattcctgacagttaacttgaggttttctggtagctagattgccactgtcctttgctttcaaaacagccccaggatcactttcctgttctttcaagttacctcctctctgggttgctgggcaggtaacattcccttcattagtatatatcaaaaaaagtatagtcatgcatagcttaatgatggggatgcattctgagaaatgcatcgttagttgatttcatcgttgtacaaacatcatagagttcttacacaaacctaaatgatataatctactatacatctaggctatatgttgtagtctactgttctcgggctgtaaacctgtacagtatgttactatactgaatgttgtagttaattgtaagacaatgccaagtatttgtgtatctaaacatatctaaacatagaaaaggtacagtacaactatggtatgataatgttacaggaccaccagtttatatgcagtccattgttgaccaaaatgtacatggcgcatgacactactggggcttgatttaatttcttatcaaggttgagaggatcaacctcggtgtgtatatgtgcaatcataatataaaatcatagagagtaatccagttggtattttcttgtttccagctcccactttccagactattgaagagattaaaaagcatgaggagtagaataaggaggcccaaggtcaccaggagacagggctcctcccaggtttctgcagcccccttctgcttacacctggctgcatctggctgtggagctgcctgtgcctgagaggcacactctcactgcaaggttctcagtgaccttgtggtaaaaggaggcagccacagtcaatatgaattctctctgttctcttctcatgcttatgcagccagccttttgcctgcagatgggccacttcagacatgatgaaatgttctttgtaatacttcctattgataggaaatcctctgaagattttaggtgtgaaaatttgaagtagcagcaacactgctttctaacccttcggctgagacttttcaaactgaatgatctagatagaaaaacattaaaaggaaggatgttataacatggtttcaaggcatattttcctgtttgggtaatgttccacttgcaactagtaaactgagagaaaagcttaaaaggctcaggggaagaaagaaacagagtttcaaaaagaacttgaaaattcatttttgtctttgaatcatgaattctgacttccaaatagtagtttggggtgttaaagaagttatgaacttgggagaaactaggaaaaataagaatagcaccagagggaacattctctgaacctcaaagtttgatttttgcttcagaacctagaactgagttttaccctcattgccttcttctgtctgaagactcaggtctcttccatgggatttgatttgcagtgaaaatcaacaataaagtatctgtttattgacttctatttgctcctctttttttggatgggggagacaagatgagcccctacattgtcatatctgtaaagcactataacaccttcactgctgaaatccttgcagtcagttttccgagtcctgattctgtaatgcccaaaatgaattaagctcttaagagagcgccttttggtatccatctctcagtttccattttccacttatggctgttggtctatcctgatagtttagcaaaagggtctagcagatgagctgaatctaattgacaaaatttcagggccacagacatggatagtgctggctcttcctgaaatggaggctctgatgagccagccccatcagggaggcctggggagtgagttcctccttacaaagagacccacttctttctatttaatttgggaagtgtatctcagtcaatagataattatgtattgagaatctgtctagatatggtgctatgtataggttatttctagaagtaacacaacaaagtcccagctagaatggccagagatcaatagtgccaaatcccaaaatgtataaaagatgaacaaaaaatctacattctgaacaggcatgcaaatccataagtgaagcaatataacaactatatccatacaaataaaaatagaaggaaatgtcagggaaatgtcatgggtaaacatgaggaaagacttcttttaactaagaaaggcttattggagtggtgtctgtttgtttgtttttagtagagactagagaaaattggacagtctgggagtaatgaggcattctaagccagggcctacagcactggaaaggagaagggagtggaagttagatgattaaatgaataggacaaggaggaaagacctctttgggcagagggaggttgtgaggaggaagaaatgatggcaggctgctgagcagaggatggctcgtgatgctgatctgaactgccgtgagtggtggggctgtgctcttgaagagcacagctttagggtgagaaaggaaaacttgaacaagggtgttagagactgactagtgagagccagggtgcacccacggtgttgtgtgtatatctgtgtatgaataggtgctcagttaatactttcacattctagatttagatttaggatccagtttgagtaaatttctgtataaaatgtaaggttaagatgttttggtttttttcttcataactatgcctagttgttccaaaaccatttgttgaaataactatccttaggccgggtgcggtggctcatgcctgtaatcccagcactttgggaggccgaggcgggtggatcacgaggtcaggagatcaagaccatcctagctaacatagtgaaaccctgactctactaaaaatacaaaaaaattagccaggtgtggtggtgggcgcctgtagtcccagctacttgggaggctgaggcaggagaatcgcatgaacctgggaggcggaggttgcagtgagccgagatcacgccactacactcaagcctgggtgacagagcgagactccatctcaaaaaaataaataaataaaataactatcctttctccattgaattgcttttgcaccattgtcaaaaatcaattggttattatttatgtggttctgtttcattgatcaaactatctccctcttcaccaataccacactattgcagattcatagtaagtctttttcttgagatggagtttcactcttgtcacccaggctggagtgcaatggcgcgatctcagctcactgaaacatccatctcccaggttcaagcaattctcctgcctcagcctcttgagtagctggaattacaggcccccactaccacgcctggctaattttttgcatttttagtagagatgggatttcactgtgttggccaggctggtctcgaactcctgacctcatgatccacccacctcagcctcccaaagtgtggggattataggcatgagccacaacgcctggctgtaggaaatcttaaaatcaggtagtatgattccttcaactttattcttctttttcaaaatggttttggctgttctagctcctttgtctttccatataaattttaaatgcagcttgtctatatctataaaaagtcctgctgggattttgactagaatggcattaaatctacagatgaatttaggaagaattagcaaccttgctatgttgaatattccattccatgaacatgatatgtctatttatttggatcttctttgatttatttaatcaatattttgttgttttcagcatgcagatcctgtacatgttttattagatgtataatgaagtatttcagtttatagaactagtataaatgggttttttattttgattttagttattcattgctaatatgtagaaatacagatgacttttgtgtactgactttgtcactcacaaccttgctaaacttactagtcctagaagtcttcttgtttttgtttttgtagattccttgggattttctgtatagataatcatgttgtctgtgaatgagaactcttttgtttcttcctttccaatcttaatgctttttatttctttttcttgccttattatactggctaggacttccagtatgatattggataaaagtggtgagaggagacatattgctttgttcccgatcctgaggtgaaaaccttctgtctttaaacattaagtatgatgttagctgtgggttttatgtaggtgcctttgcacttactgttccctatatctggaacttttttttctttcctaagacatacccatggctaacttctcttcattcagatcttttctctaaacctaccttttctggctatcctatctaaaatttcaacctattcaacattttatatccacattcctgttttatttttcttcttagcacttactatcaccttacatactacatacattttacttatgtatcatgtttattgtctgtctttcttcactataatgtaagctccaagaaggtagggaatttttatctcatttgtccattactgtgtcctcaaagccttaaaatatatctggcatatagtaagcattcaatatattgttgctcaataaatgaatagatagatgagccaaatcgacgcatccacccgcattgttcctgtttgctctatcttccttctatatatttttttcacaaagataccacatgaccaatgtatctgtcttccttctggtctaagggcttctgaaccatccctgctcttcttacaggtaagatgctctctacttgtacgcagcatcccttcctctcttacctccacaaagattttgatcctgtaggtatttctcatgtcttctgcatatctgtttattcctcttgatgtggttgttcttatcaacatagtctctttcatcttttcaattatttcttatgggttgaattgtgttccctccaaaaaaagatacattgaaatcctaagccccagtacctcagaatgtgaccttatttggaattagggtatttgcagagatagtccacttaaaatcatgtccttagggtgagcccctaatccaatataaatgatgttcttataaaaaggggaaatctgaacacagagacacgcaccaggagaacaccctgtgaagatgaaagcagagttcatggtgatgcatctgcagcatcgctcacctgaacctgctaactcaactctgcttctccacctgcctcatacagcccaacagccatcttaaaagatacaaactagaccggatgcagtggcttacacctgtaatcccagcactttgggaggccgaggcaggtggatcacttgaggtcaggagttcaagaccagcctggccaacatggtgaaaccccgtctctactaaaaatacaaaaaattagccaggcgtggtggtgcacgcctgcaatcccagctacttgggaggctgaggtaggagaatcacttgaacctcagagtggaggttgcagtgagctaagattgtgccgttgcactccagcctgggcaacagagcgagactccgtctcaaaaaaaaaaaaaaaaaaaaagataccaactagatcatgtcattcctctgtttaaagtttccactggatcctcatcacacctagaataaaatccaaactccttttttttttttttttttgtacacacaaaatcctatgtgatctgtccctgcctgtatctctgtcctcacttccttgaagtctttcatttactctgtttttgttttgttccttaggtattccaagccttttcctgactctgctccagctgctcactctgcctggaacactctttccccagatctttttttctgttgtttttttttttttttttttttttgagacggagtctcgctctgttgcccgggctggagagtgcagtgccgcgatctcggctcactgcaacctctgcctcccgggttcaagcaattctcctgcctcagcctcccgagtagctgggtctgcagacatgggccaccacacccgactaattttttttgtatttttagtagagacggggtttcactgcgttagccagcatctcaatctcctgacctcgtgatctgcctgcctcggcctcccaaagtgttgggattataggcttttccagatctttatgggtccatctctttcttctgacccagaatttaagctcaaatgtcacctccaaagagaggtcttctctgtctacccaatggaaagtagcccctctcttccccactcattctatcacatcatctgtttaactgtctccttcaagagccaacatacatctatctctatccctgcccccactccatgctagcctgtaaacaacttgaagatagagcccttattggtcctgtttgctactgtatatccttgacccagagcagtgcccagtgcatagaaagtattcaataaatatttgttaaataactcagttaactactgcaagatagaaactaaagttgaaggccaagtctggactcccaatctaaggctctgtattagtataatagggctaccatgtcagaacaccacaaacaacagaaatgtattgtccttgttctggaggctacaagttcaagattcaggtgaagtcagggttggttccttctggaggctctgagggagcgtttgttccaggcctctctcctggctcccagtggttttctggcaatcgttggtgttccttgtttctgcaccaaccctctgtctgccttcaccttcacaaggtgttctccctccatgtctgtgtttaagtttcccctttttataaggacatcatcaaaatggattaaggatccaccctactccagtatgacctcatctaaacttattaaatctacgaaggccctatatccaaataaggtcacattctgaggtacttaagggctaggactccaacatatgaattttttagggacacaattacacaattcaatgtataataggatctttctgagtgggagggaatgggggattgggagagcttaaggtactgaggcatcaccaaggaggagggagtggggctgccaagccctaggcctgggtaaggatgggaccagattcctgagtttaaatcacccagtccagtgggtgtgcaggaggcttcagtgaggtcacgtcctagtttgaccttcatgtcattgccagcatattgtccctagtgagttgagattgctctcatttgggccaaaagagctagggagccctggtttccatggctgaggggcctgtgtgtctggcttgcagggcagaggcgggcccatgctctccatactccccttgccttcctgtgttatttctgagtctgacaataaagcattgttggtttgtcttctacataactaagctgagttaaaatgcatctttttattagcagaggcattattgtattaatatcatcgctactaaattttctctttgcaaaactagaattttaagctggaatctggagaagtgtgatttccctggaaaagagtttgtagacctctttgtttgtgaaaagtgcatccctaggtcttcataaaagctctagcacctaactgaaaaatacaggagctcttaataacagccaatgtttacaacagggtggagtgtggtgctcggtccagacctgttttcctggaaataaggcccatgatgagaacagaagtccctgcacctcacattctaagttcaggaaaggtctaagagttgttacctccatcccctggccctgggccacctgggggcaaagggagagtatgcttttcctcccccaaactgggggaaggaggcagttctcaaaagaatcactcatgaaatttggaggcaattactttaaaaaaaaaaaaaagatgcttacaatctcatcccctaattggatacttgcttagctagcaaaatatataacctttccctttgtaggggaaaaggtaactagagagcaagagatgtcatagtggggaactgtcccattttgagttttcagttcttcacaaaaatggagggatcctttgtgagcctacagccccaccattgtctgaggacatagaagaaatcaagtgctactgtctcactgggaatcagcacaaggcaaaaagatgcacacattagatgaatgtactgtgagagttgagctcaaggtcagttaaaagatgtagccagtctggcaagggatcatatattagtttgatatggtgctggagcaaatccccagctagtgctagaacctgtcagcctccgaggatcaggacgtacttttcacaaataaagaggtctaggaaactctttattttatctagggctgccagaacaaattaacacagactgagcggtttaaacaataggcatttgcttctcacagttctggaggatagaagttggagatcaagttgtcagcaggtttggtttcttgtgaggcctctctccatggcttactaataaggacaccagtcataatggattaggacccactcttacagccacatcttaatttactgtcacctctttaaaaaccctatctccaaatacagtcacattctgaagtagtgggggttattagggctccaacatgggaattatggagaagaaacaactcagctggtaacagatcactaagagcttgggtagctgttaagtgtgagctccttaattgtggggcatgtggggactaccacctttctttataaagcccaaggactactgtggccacctagagcggctctgcagcatccccagtcagagaaggagagctctgcccctctcatccccactccctccgccacacctagggagctagcctagagaaggtgagcggagagaagaaccctccaagcccgtgaaagccatacatccagcctgggggcagaaggaaagtggggaaaaagctgcgaattgatgtaacattaaaggttaaaaacaaacaagaatgaagccgggtgtggtggctcacgcctgtcatcccagcactttgggaggccgagacaggtggatcacgaggtcaggagttcaagaccatcctggccaacatggtgaaaccccatctctactaaaaatacaaaaattaactgggtgtggtgatgcatgcctgtagtcccagctactcgcgaggctgaggtaggagaattgtttgaacaggacccgggatgcggaggtggcagtgagccaagatcgcaccactgcattccagcctgggctacaagagggagacagtctcaaaaaacaaacaaacaaacaaacaaaacaaaaaacagaaacaaacaaaacaagaatgaattatcaaaaccataataatatttaataactgaaaaatctatgaaatgggactatgctacggttaaggagctgccatcttcatagaaagctgagtccacatgggtgagggaagttagagggaaaagtgaaattgtttctggattacccacagagaactgagatgtctcagtatgctgatttcatgcctaaggcacaagcagagaaccacagagcttttgcagacctgatcctggtaggctggcaggttctgtcactagctggggatttcttccagcaccagcctggagtgggtgacagattcttgtctcagggaaagggcaatgatacagagagtcccttatgaataatggaactagcaaatgttaattacatgggctcctcatcttcatcagtctgcagctggagctgtgcaattcagcacattggtctagccagctgcacagtcctgtctcatgtgaccatcttgtctgactgaaaagatcataagtgccatgagaccagaaactgggtctcctgtttcatttatataccaaacatgtagtcagtactggtcacattacttcacagccccatgctaattctgctttttagaattacttctgctccccaccgacacccctcatcaccacacctcccaaccctgcccttcctctgcctccccaacatttttgtgttcaaaactcagtcctagcatcacctcttccagggagtttctagtctgggttgggtaaaattcctggtaccactagaatgtaaattccattaggacagggatttttgtccatttggttggcacctctttccatcgtctagagaggagtgtgacaggaggtgctcagagagtctttctgtccagatagagagtgcgatttgtggacggtttcctggtagtgctgggaacactttgaaagcacatcataaatgtgggtcatcctgtgatttatggtgctggcaggaagcccaccagaatcagatctattttaataagttgtgaaattcagaaggcgctccattcagaacttcatattctgaatgtagagagatgagtatgaagcccttattaggactcttgcaccagaggagtgcagatgtaattgcagttacttctggcatctgaaatcaattgctggcccccttcttggattgggcggagtggggctttcccagaagcaaacagtacacttgtggctaaagtacagatctttaagcacgagaaccacgtactcccttcacattacaacttccctcttggaacgtggctgccccggggtgccacccagccctctccagccaccctgactggaccgcatgtgagggtgagtcccaccttactgccacagcctgctgggaggaccagaagctttatctgtgagatgttgtgagggccgtgccctcttctgcccttgtcttggcctcatctggacagccccaggaggaacttcacaccttcctggctcttcccctgttaatggttttcagcccttgtttagaagaatctgattttctttgtaaagcttattgaggggaaaatacgtgtatgatgtggctgtggggtgaaaagagcatcccttgaaactcttgttgcctttttcccccatccctgaatgtttttaggttttaatttgtactctgcaagtgctgtcttgttttttgtttaagtataggtggcttaagtgtttctttcatttttaaaattctccatgcagtttctcctaccctctcagctatggtggaatgaagaactctgaactgtaagtcaggagataagctaagagctacctgaactggtactttgcatctggcagatttgatttaaagttctgagcagcttccacatctgcaaattgaggggtgtgcattaagaagagcctccagattagatgggaccttaaaattgaacagaccaacccctaatatctctagaccagatgttcagtcttgagttgctttgttgttgttgttgttgttgtttaaggaaatggggtctcactctgttgccaaggctggagtacagtggtatcatcatagctcactgcagcctggaactcctgggctcaagcagtccccctgcctcagccccccaagtagttgagatcacaggcatgagccactgcacctgcctgatttactctggtttggaagtgtttacttggctctctttagaaaaccttatgggacagtgctatacaatgaaatgtaaaatgttctattagccacttttttttttttttgagatggagtctctctctgttgcccaggctggagtgcagtggctcgatctcggctcactgcagcctctgcctcacaggttcaagcgattctcctgcctctgcctcccaagtggccaggattacaggcttgcaccaccttgcccagctgatttttgtattattagtagaggtggggtttcaccatgttggccaggctggtctcaaactgacctcaggtgatccacccgccttggccccccaaagtgctgggattacaggtatgagccaccatacccagcagccacatttttttaattagccacattttaaaagtaataaataacaagtcattgaaattaatttcaataatagatcttcatatatcaaaagtattattcaacatgtaaccaatataaaagttattgaaatagtttactttttttgtactaagtcttcaaaatctgatgtgcattttatatctatggcacatttctatttagaccaaccatatttctttctttctttttttttttttttttttttgagacagagtttcactcctgttgccaaggctggaatgcaatggcatgatctcagctcactgcaacctccgccccccaggttcaagtgattctcctgcctcagcctcccaagtagctgagattacaggtgcccaccaccacacccagctaattttttgtatttttagtagagatggggtttcaccatgttggccagtctggtcttgaactccagacctcaggtgatccacccaccttggcctcctaaagtgctgggattacaggtgtgagccaccgtgcccagcctaatccagccacatttcatatgtgcagtagccaccatatcgagtagcatgactgcagaggatcgctgcatcggccacagaagtgcctcattcctgctctcaaagagaaatgcagaaatgccaaggagcccttcttgttgatcctcccaaagaaaataaagtgaggtggggtagcacagaataattctgcagattggcttcttcataaaatatttattttcttgtgtacagacttgacttcagattatctcccagtgtgtaagagacattattgttcccggatttgcagagtttcagcaaaagctttttttttttttttttgagacagaattcactctcaccaggccagagtgcagtggtgcgatctcagctcactgcaacctccgcctcctgggttcaagtgattctcctgcctcagcctcctgagtagctgggactacaggcgtgcaccaccacacccagctaatttttgtatttttagtaaagacggggtttcaccatgttggcgaggatggtcttggtctctttacttcgtgatccgcctgccttggcctcccaaattactgggatcataggcatgagccaccgtgcccagcccatagcaaaagctttttagcagtttcctttgttctttttggagagatagaagtgttccatattatcagtactgagcaatgttttccaaagtgtttttcttgaaacaccaaatttgtgtggtgttaagaggtgtgagctgaataagatttccatgaccaaaaagcgtggggaaggaacattgtttatgaatatccaataggtatctttactgcagaaataccaagagatggctcccgtgtaccagacatccaaaatcagtgagatcctttttgtgagaagcaccttgagggtcaagaatcatgtgggacctgctaaggtaatgctgatcagatgatcttcctgagttccttttccaggacatccttccagtgtggatcttaaatccatttccaaaagttcctcttgccttcctggctctaaggccctgttgctactgtgtctttgaaaaagaaaaactaggccaggcacggtggctcacgcctataatcccagcactttgggaggccgaggtgcatggatcacaaggtcaagagtttgagaccagcttggccaacatggtgaaaccccgtctctaccaagaatataaaaattagctgggcatgttggtgcgtgcctgtggtcctggctactcgggaggctgaggcaggagaatcgcttgaaccagggaggtggaggttgcagtgaaccaagattgcactccagcctgggcaaaagaggaagactccgcctcaaaaaaaaagagaaaaagaaaaactaaaacaaactttaataatgagttatgataatgactctaaccttgggaaaattagtgtctattgtgaatcagattcaccatcttcccctaacacattttaatagttctcttataggtcctgaataagacagtgaatgtatattttaagtggaagttcaatttagagccatttggttttatttctttaatgatcctgctaagtatagaaaacatagcagctttgatttttcgaatggtcagaatacaagaaaaagaaattctgcttctctctgccagcatccttctcattcatagaaaagaaaaatgttcccatttgagatgaaagattctttactttttccatatttatttcatatttcaatagctcatattggagaaaaggtctcaaagccatttatactttattaagtcatcccactctaaaatctttttataatgaggctttcaggtcatttccctcccttagtaacagatacctcctggcactttaaatgaaatacattagaaacaaagccattctaattatcatctctctacttaaagatggaataaaacttaacatttttccccaggaatttaggtcatgttaatagaaactgtatttttctttttagaacacaagactgccttctaacagtctggtccatatgttagaagcatataaagttaatcattttgctttggtgccaacgtgttgtgtgcaaagagaagctgtaaaccacagctgtgtggagtaacaattgtgaactttactggcttgcacatgtgagtcatcagtaaactaaattaaatgttgcttaactgaacttgagagctggaggttgtaagggaagactgctaagattttattaaagtttgaatttagtagagtggttccatctttgcatttcgcaagggacttcaagttatacaaaaatcaaatcaactgttgtccagatgattaggttttttggcttctccataacaatagtgattgccaggtaatcaatgggaatcactgttcagttgacctagtttggtgtgtaaacagccaaaaaaaatccagacatcctctaaaatcaactgggcccaattagtttggccaggcagcaatcccatcagctactcagtagtcttccttgcataagatcaaaatccctgaaatgattacagtgtaattggagcatcttgataggttctctgagcgttactacttagtgctatgaccttgagcaagagtcttgaatactcggcctcagttttatgtctttgtggactggtgacatggctcacagggttgttgtattaagtaattcattttaaaacatttagcatggtatgtacaacattgtaaaccctcaaaaaatgttagtatttaagtattgttaaatattttttgatctggagcagagtgataaatatgagacaaaagtaagtagatttccacatttattttcttaatctctgatttttttttttttacaataaagcagtagataacatttgtttattctctttttccttttgctctgtcttttgttgagagtttgagatttctgtgtttaccttaagaagataaacagggggtgctggggctcatgcctgtaatcacagctactcaggaggctgaggcgagaggattgcttgagcccaggagttcgagactgcagtgagccacgattgtgccactgcactctagcctgggtgacagagcaagacctcatcgctttttttttttttttgagatggagtctctctctgtcacccaggctcgagtgcagtggcgcgatctcagctcactgcaagctctgcctcctgggttcacgccattctactacctcagcctcctgagtagctgggactacaggcacccaccaccatgcccggatgatttttttgtatttttagtagaggcggggtttcaccatgttagccaggatgtaaatataatctgtctctaggtggcaagggtagaaacattctaaaatgttcttctagttcattgtaactttttcttttctttattgtctatgtgaaggataagcaaagggcacttggcaagtcttacgcagtagctgaagaaatattttttgaattaatgaatgggagtagaaatagatacttagggccaggcgtggcagctcacacctgtaatcccagcactttgggaagccaaggcaggcggatcatgaggtcaggagttcgagaccagcctggccaatatagtgaaaccccgtctctactaaaaatacaaaaaattagccaggcgtggtggcatgcgcctgtaatcccagctacttgggagactgaagcaggagaattgcttgaactgggaggcggaggatgcagtcagccgagattgcgccattgcactctagcctgggtgatagtgcgagactcagtctcaaaaaaaaaaagaaaagaaatagatacttagtacctggcttcaaagaggttgtaacatctataaggagccaaatcatttctaaagattaatactaatataagatagcatatttgcattgagtttaaaggactcagacacaattgtactgactacctgcaacctctagaattagtgtagagttgtgatgcttgtagagttccttcatcagataaataatctttgttggcctttattctcaataggtttcactctttcaaaaaaaaatcagtaattgcatcgcaagtctgtcagataatactttaatttagaaagtctttttgaaatcagttagtttggataatacagcattacagttccataaagccaaggtctccaaaaatcaatgcctgtgcttaagaatgtaagttacattaacttcattctttaacaccatgaaacatataaatttcaatggaagaagtgtttctgggcactggcgttttatgaacgggttatacatatatctataagaaatgtgtgtgcatgggtgttcagaaacattataacaatgtagtttagatatgagtaatgctggccaattgggcacatgcaagtttggtttcctgtggaatactacctatttcagtatgcctctccttattttctggattcttaagttgctatagtttttcccaaggatatatacatatacatggatgtttatactaggttcttttataaaagagctagtgacatggaatagtcattctttaaaatataacaaaaataactggtaaatgtgaaaattagacttggatacctatatatcaaaagctacccttgagtactttcagagacccaataggaaaaaaaagctcgtataagtgattattgccttcacattagcacccagtttttcaaaatggctggtacttgccaatatgcaaacagaagcataatgttttactaggagaatagatgttataaagatgttgaaaaatgaacaccttgaattcattaatcttaaaaacattgcagaaagggagcaaaaaactatgcctctgtctcctctcacgtgctaagaaacaagaatgatattaaaaaattagagaactgaataagcttaccttagccacaatagcaaagtaaaggaggaggaataactgaagagatcatagcaacagagccattgctggttgcctgtgttagctgtgaagagaacattggcaaattaaatatccaggcctctgtaaaaccactatctaagcttcctccatttatctaagcgaggctatcatcaccacccacttcttctgttgcctactgaactgctaagaaataatacattttgcagattttagttttattgtctttattttgttctttcttatttcccccacttcaggggtcttttaggagatatttcacaactatagataaaatttcagagctggatggaagcctaacaatacttaactttttttactccaacttgcatctagttattgcacttacgtgtttccttgttgttcagcgtgttgttgatttttgaacaatactgtttacttccttgattagctctctgatttatagcttaggtaaagctcacacatgtcctggccacagatatcacacaatattttattttggcaccaggttgacattacacactgttcgttgtagttccatttcagagaacagtccacccccatctacaccacatgcctggcattgatctaggtgaagctacatagccacaaagggtgttcattatggacaccatgacggaatgccatgacacacaagtgcagaaccactgatcttctcaaactcctcatttgacatataatacaaatgagtcataaagagtagacatgatctccttaagtcagtggcaggtgtgggataggaatccaagtttctcactttccagtgtccttttcattgcttccatgctaaagagggaaactcaaaaaagcagttatagttccaagcactgaatcataatcctgcacaatgggaagctaacagcgtcttgtttgctgaagccctgtgtaactttctcaggcttaaaaacacaaggaagcataggtgttgcgggaaattatatgactgacctaccaccaatagataaggtatgttgtgcaaatcttctagggagggattttttaatttgcagtgatcagttgatttgctcctgcctgagcattttatttaggattctattcttagactgtggaatgtaacttctctgtatgaaactacctgacccatatgagattttacttaagactttggccatatcagcactattttaactggaatgagtctcctagtagctcgtatccaaaccatccacctttggccacacagatgaatgggcattctacctgaaggccacctgaagagcagaacaagcttttgttcccagtcccaccagtgacttatgataccttagcaaagccttcttccccatattttcttccccctaaaactgtccccacaggtggtattttcactggaagggagtggtgagtaacttgtttttatgtttgcaagggtaaaataataaatgttttaatgctattattaaatgtctaattttaaaataagaagcctcctagaaatttgtcttacaagctctctggaactctctggaaccctcaggtttacattctgtatctgtcttgcgcatgtctttcagatagaataccttccatttcctgtcaaactcatgttaagctttcacaatctagctcattcattgactactcttcagtttttgttttcctcatcctctcatgaaaacttagtattctgtccccttgtgtcactttattcagagatttattctaacactcaccagtttcaatcgcaatgaattgtttatatgtcagcctttccccttccccccaagagcttctctgggctgtcttctccttaaaacaaagaactgtatagttggctcttgaacaatgttggtttgaactgtgcaggtccacttatacacaggttttttttttttttttcaaacaaatgcagataaaaaatacaatattggttggatgcaaaactgcatatatggagggccaacttttcatatatgtgggttcttcagggctgagtgcgtaggttttggtatactagggggtactagaatgaatccctcatatatactaattgcattctattcatctttataagacccatagaaggcctttactgtattatttcaaagtatgaataacatgagcatcattaaacaaaaggtcccctatttcaaaactgtcccccttacctggacactagatcatctacaggttttcaacattcccatcaatagaatcattccataaaaatttttttttctggatagctttttttttttttttgagacggagtctagctctgtcacccaggctggagtgcagtggcatgatctcagcttactgcaatctccgcctcctgggttcgagggattctcctacctcagcctcctgagtgactggtattacaggtgcgtgccaccatgcccagcttatttttgtatttttagtacagatggggttttactgtgttatccaggctggtcttgaactcttaacctcatgatctgcctgcctcggcctcccaaagtgctgggattacaagcatgagccaccgcgcctggcctagatagcttcttataccatataaacatctcacctgagtgaattaataaatttctttgtccattaacaaattacacctggattaagtatcagaagaatagtaacctgaaggtttggaacaaaaacaaaaggagatttgatgagaatatggaggaggtgtgtactgcatggaaaagttcaagggtgggacaatgaagtagggggaattagatattgggatagggaggagacagcattaaagccatgttgcaccttcagaagtggaaatagagaggtgaaaagggatgtggggaatttgaatacatcctttgcctaaattatgattttgcccaggaccatccctgattgctctgagattggaataagccattctcacacctcatgacatgggtgctgacagacatgtgtatgtggcttttattttattgtatttttaaatgggtcaggtcttcttgggtagatattgggtagatgtcagtagtataggctcttgtacttttgtgaacacacatcaggccatgtgacagccatattattttcaagcaaactccaccaagaaaataatgggaagagctttcttcatctggctctaaaaggaaattctcctcgttaaaagagactgacctactgccgacgtggcaataaaatgcagaaaacagagcaactccactattgactgtgttaggaaagagaagccttgttagctccttgaaacagtctgggattcagtatagttgtttgctggactgacatcctgtttatgagttttaaagcttaaggagaaaggaaggagttaactattttttccctagctctacaatttgagatctctgggtcacaaatctttaaagctgtagtttatattctaaagaaaaaagtcagtgaaaacattggtttggctttctttaagcaaatagtgtaaaggtgttaattatgcagaaattccttaaaatgccagacaattaccaattaaaagtcaatacagtaatagggaagggatttctttggggctttgaatttgccacatgcaagataaagttgtagattcagaaaagagagtgaatttgttatctgtgcatacctttcttcaataaaaccgatgggaggatagtctggtctcttacttactcttgattccttccctccacaaaactacaatcccttctatatacagttatgcatcacataatgacatttcagtcaatgacagaccacatatacaactgtggtcccataagattacaatgcagctgaaaaattcctattgcctagtgatgtcctagcctttgcaatgcattactcaggtgtttgtggtgatgctgatataataagcctactgctttgccagttgtataaaatataacagatacagttatgtgcagtacatagcactgaataatgataataaacaactatattactggtttacgtatgtgctatagtaggcttttaagttattattttagcatgtactcctacttatttttttttaagttaactataaaactgcctcaggcaggttctttaggaggtattctagaagaaaccattgtgattataggagatggcaactccctgtgtgttattgccccatagaccttacagtgggataagatgtgtggaggtagaagacagtgatattgattatcctgaaactgtgtaggcttcagctagtatgggtgttagtgtctttgtttttaattaaaaaattaaaaagtaaacaaaaaaatcttaaaaatttaaaaaggcttatagaattaagatataaagaaaatatttttgtacatcttacaatgtgtgttttaagctaagtgttatttcaaaagagtcaaaaaattttaatattttaaaagtttgtgaggtaaaaaaagttatggtaagtggttaatttattatttaaaaaaaaagaaatttttttttttttttgagacggagtcttgctctgttgcccaggctggagtgcagtggcacgatctcggctcactgcaagctccgcctcccgggttcgcaccattctcctgcgtcagcctcccaagtagttgggactacaggcgcctgccaccatgcccggctaatttttgtatttttagtagagacagggtttcaccgtgttagccaggatggtctcgatctcctgaccttgtgatccacctgcctcggcctcctaaagtgctgggattacaggcgtgagccaccatgcccggccaaaaaagaaatcttttgtataaatttagtgtagcctaagtgtgcagtatttataaagtctacattagtgtacagtaatgtacactaatgtactaatgtacagtgaatgtaatgtcctaggccttcacattcacacatcactcactcactcactgactcacccagagcaacttctagtccctgcaagtctcattcatgttatgtgccctatataggtgtactgtttttttacattttataccatatttttactgtaccttttctatgtttagatacacaaatactttccattgtgttataattgcctatagtattccatacagcaacatgctatacgggtttttagcctagaagaaatagcatagcccaggtgtgtcaaccaaaacaaaacaaaaaaaagagaaaattatccataaatatgctgggtttacttaggaataaaaataaggattataatctggaatggtataaaatggcaagccaccagtgcattcagtgagggaagggtaaggggaggttttattagcaaaaagagatttatataagctgcttagaaatagagttcattggttccagaagttcaaagccagagttgtcagttcactggtggagatactgttactgggcaagtgttcttctgagaatatcttaactgaattacttcagtcctatagaatgcctagtaataaaccttatcaaagtgggagatgcatgaaggatgcaaaagggttttttgtggggtttttagaaagtccttggaaacagttcttatctcagacatgtaagcatgagcctcttctttttcgggccttcccagccctatcttgtctgggtctgacaaaagtgatttcatcctgtatctgtaactttcacaatgtgcagaggctataccatctaggtttttgtaagtacgctctatgctgttcacataatgacaaaattccttatgactcttttcttacaatatatccctgtcgttaagcagcacagcacgtgactgtatataaattatccatgttcttttcataagacattaggtcatgtccaagtgggctgggaactcttccatcctgctctgcccatttattgatattaacgtgaaagctgtagataaatgctaagggagaaagtaaaaactgcagaacaaaatttaacattacacatgatctccttttcttggcttcctacagctgtgtcatattttgtggctatcttaagttacttcaatttatcgaatctaaaataaatccttcttataaatttaggagagatggttatgtgaagatgaactaagattttttagtatacaaaatactataggtttgtgtttttttgagaatgggtcttgctctgttgcccaggctagagtacagtggtgtgatcatggctcactgcagcctcaacctcccgggctcaacttgttatatataaagttttggtgctgcaaaaggaatagcactcgaatataaaattttctttttgattctcagcaaggcaaggtacttctgtatagaagggttcacccttacagatggaacaatggtgagcgcacacttggacaagggaggggaaggggttcttattcctgacgcacgtggcccctgctgctgtgtcattcccctattggctagggttagaccacacaggctaagctaattctgattggctaatgtaaagagaatgacgggtgagtgctttagtgggagtcagggcagagaaggtagcaggtaattggaatgagttagggtggagcaggtgatcagaatgagtcagggtggagtaggtaattgaaaaaggttgctttacgaggaagttaagtttagaaggcaaagaattgaacatactgacatattctttgaaaagaaatttagaactcatatctaacaaacagatcctaccacttcagcctcctaagtagctgggaccacaggcgtggcaccacgcccagttaatttttaaaactttttgtagaaatggggtctcactatgttgcccaagctggtctcaaattcctgggcttaggtgatccttccacttggactccccagattctgggattacaggtgagagccactgtacttagctactatagtattttttatagtatgtttgtatacaactatgtactgaatttaactccttgcatttttgttagctacagtgttataaactgaaattggaacatgttaattactgcaagtattgcactagcgtaggtctgtctcaagcttgctcccaaacattaccagcccaactcactgataagataaagtggaggttattgcttcccaccacctctcaaagctttggcaatgtcttggagaagggaagtcaaggtcagagtttgttgagaaatcgtttatttttaggagggtctttcaaagtgagggcctttgattaggactgggtaaggatcatagtgcagcagtccagggctggtggaaacagcaaggggaggactttgaaaggagagatgataggaatcataggtaatgaactgtcaggttgatcctttccatggaagagctgatgagtctttcaggaagtttctgtaatgagcaatctaaccatttgcctgggcttggagactcctgaaaaaagaaagtcctactaatggagacaggaattacacaaagtcatcgtattgtagacagtaagatgtggtttccgttctcagtgtctaagctgaatgtgggctacgtggtttcagttctcaggtctactgcgatataacttaatcttgtaacagatgaactgaagcatctgatttttatttactgctccttatctttgtagctatttgacacaaacagctttttacatttcagcattgctttgcaatcatttcttagtttattagcctatttcttgtgtttggagagaaaattaaaatcggaaaatttctcaaacaaatgcccaccaacaatcaccactggaacccagctacaagtcctataaacccagagggtgcagcagagggagactgaattctatgtttgattatttaatacaacaacctgtcctttggggcagttagtaaaagatgactacaggtgacaccctgggttctgggtactttccaagcaaggaaaatcctctgaagcaggcggaaaattgccgtcttttaaaagttccagctctgtcttcagaccacttgtgtcttttcttttaagttggaagcagggaaattgtgtgagatctttgtaatctccaattcagattctctcttaacacagttcccacataggatataaattccattagatgcctctgacttccgttttctccttccaacacaggacacatgttggtagttgcagttttgagaagcacagaagggtgttctggggcaatgagcaatgcttagctgggaggaggctgtctagggggtgaagcactgaggatgcttaacatttgaaagaagtgtgaacactatttacatttaaattaaaatggaaactttggttatgtttctgaaaggtgtgtgtgcgcatctgctgaggtctattgtttattcatgctgtaaatcctttgaaatgtgttaaaatgcttcccactcattataaagctcctgccacccctggattacgactttgatgtcaccaatcctgcttcaaagggttctttctgggctattaatcacagtttagcctctgaagatatcgccagagaaaacatttggacatctttgtgctagacttgctgaaactttgaaatcttgagcatcttgcatatgcacaaattgcagcacttcctttcattaacaactttttattttgctacagaatcaaatgacactgtaggtaaaaatgcaaacaaatctcttcacacacttggtttgggggaagaacaatcagagaagtggtgaagggtgtgtggggtagtgaacaggccattcagactcttcaaaggtaaaaagtgggaggaatctgagtagccaagagttgccctatcattttttctcacctttcatagtttttttgactagccagtgatcacacagagatttggtgcgatttcctggtcttttcttgctctctcctttgagacctttgtgaacagttcacagcaaataataataaaatactacctaatgtgaaatgaatagttgccctgctctagtcctgtgttggcagtgctttttgtaagttgtcttgttgaatccccataataactcttatgggaggaaaacaggtggtactgttttcttattatggactaggaaactgaggctttgagaagtcaacttgttcaaagtcacactcctgacaaatgcaaagccctgcaaaacttcattggcccccaggactcagaagctgctgtctcccactccctaccccactgattcactgggggtggccaggtttctccttacgtgcagagagattgatggggtttagggctcactgtcccaaaatatggccccttgacctattgaatattttaagctgaaggaatttgagaaaatgacagatgcaggaatgtcactcttagcccccacccccttctcccttgaagcaggtcataaaatctaggaaggttttttctgaccttctcctaaagcaggctgtaagactctcatgtaggagctgctcttcctatacccacagaaaagaagcgtctttatctctgcggacacaaggacacagagaagaatctgaacaaataggccttgctaagtttcattagtttcttaccattagatgatactttttcctatcatatttctttactactctcctttttgtttccttataaaggctctagtgtcaactaaaacttacattaagtaaatttttatgcttttcacttagtaatctgtcctttgttataagtgcctcaaccatgaacctaggatgggtagagaaaaagatatttttcctcccctgaaggatccttactgcccagtctactaatcagtgtctgtgtcctcaaccctcacaatggcgcgctctatcgtctaacttctttctcgggaaaacttccttcagcaccttttttcttccatattcatctttttcaatgattagcagtgtcccagttggagactttttcttgttgttgcagtaaaaaatatatataacatgaaatctctctttttaagtatacaatacagtatcaaatatgtgcacagttttgcacagcagatctctagaattttttcatattatgtgactaaaactcaatacccactgaatagccactcccacttcctcgtgtccccagccactgacagctaccattctactctctgcttttgtgagtttgactacttttgatatctcatgtaagtggaattgtgcagtgctgtgttgctgtgactggcttatttcacttagcctaacgtcctccaggttcatccatgttgtagtgtatggcaggatttccttgtttttttttaaggctgggtattcaattgtatgtatatatcaaatgttctttatccatttaactgttgataggcatttagtttgtttatacttcttggcccttgtgaataatggtgcaatgaacacaggagtgcaaatatctcttggagatcttgttttcaattcttttaggtaaatactcagaagagggattgctgtatcatatggtagatctatttttaattttttgaggaaactttatactacattttccatagcagctgcaccattttatattccccccaatagtgcagagagttctaatttctctacatcctctttagcacttgtttctgtttctttgatgatgaccatcttaattgggatgaggtaatatttcttttttttttgagacggagtcttgctctgtagccgaagctggagtgcagtggcatgattttggctcactgcagcctccccctcccaagttcaaatgcttctcctgcctcagcctcctgagtagctgggaccacaggcgcctgccaccatgtctggctaacttttgtatttttagtagagacagggtttcaccatattggccaggctggtctcaaactcctgatttgtgatccaccagctttggcctcccaaagtgctgggattacaggtgtgagccaccgtgcccggccaaggatgaggtaatatttcatctcattatagttttgattttcatttccctaatgtttagtgatactgagtatctcttcatataccggttagccatttgtatgccttctttggcgatatgtgtagtcaagtccatatttaaattgttttttttttttttgggccaggcatgatggctcacacctgtaatcccagcactttgggaggctgaggcaggcggatcatgaggtcaggagattgagtccagcctggctaacacggtgaaaacccgtctctactaaaaatacaaaaaattagacgggcatgctggtgggcgcctgtagtcccagctactcaggaggctgaggcaggagaatggcgtgaacccaggaagtagagcttgcagtgagccaagattgtgccactgcactccagcctgggtgacaaagaaagactccatctcaaaaataataataataataataattttttgttatttggcttttttactattgagttgtaggagttccttatatattttacacattaatcctttattagctatatagtttgaaaaaagtttctcctattccatagcttatctctacaattcgttgattgtttccttggttgagtagaagttctagttttatgtagtcccattgtctatatttgcttttatagcccatgttttggtttcatatccaaaaaaattgttgccaagactaatgttatgaagcttttctcctatgttttcttctagcagttttatagtttcagttctttttttgagacagagtctcgctctgtcgcccaggctggaatgcagtggtgctatccctgttcactgcaagctccacctcccaggttcacaccattctcctgcctcagcctcccgagtagctgagaccacaggtgcccaccaccacgcccggctaattttttgtgtttttagtagagatggggtttcaccatgttagccaggatggtctcgatctcctgaccttgtgatccgcctgcctcagcttcccaaagtgctgggattacaggcgtgagccaccatgcctggctatagtttcagttcttgcattttaatcttcaagccattttgatatgatttttgtgtatggtataaggtaacagttaaattttattcttttgtatgtggatattcacttttcctaacactgtttgttgaagagattattttaccccattgtatactcttggtgattttatcaaagatcatttgatcatgcatctgttgtgtgtttatttctgggcactctgttttgaattcaggaaatgtgagtcctccagctttattctttttctcactgttgttttggctattctgggtcctttgtggttctatatgaattttaggatattttttctatctgcaaaagatgccattgggacttaatagggattacactgaatctgtagaatgcttgggatagtatgaacattttaacaatgttaagtcttccaacccatgaacagtgatgtccatcagtttatttgtgtcttctttaatttctcccagcaatgttttgtagtttttggtgtaaaagtcttttgcctccttgattaaatttattcctattatattttgatgctattttaaatggaattatttccttaatttcttttttgaatagttcatttttagtgtataaaaatgcaactgaattagctgggattggtggcgcgtgcctctaatcccagctactcaggaggctgaggcatgagaatcacttgaatctgggaggtggaggttgcagtgagctgagatcacaccactgcacttcagccagggcaacagagtgagactctgtctgaaaaaacaacagcaacaacaacaacaaactgatttttgggtgttggtttttttttttttttttttttttgagacggagtctcgctctgtcccaggctggagtgcagtggcatgatctcggttcactgcaacctccgcctcctgggttcaagtgattctcctgcctcagcctccagagtagctgagattacaggcgcgtgccaccacgcccggctaatttttgtatttttagtagagacggggtttcaccatgttggcctggctggtctccaactcctgaccttgtgatccacccgcctcggcctcccaaagtgctgggattacaggcgtgagccacctcgtccagcctgggtgttggttttgtatcagcaattttgctaaagttagttctaacatttattagttctaacacttcttttaatgtggaatctttaaggttttctacatataaaattgtgaacggacattaattttacttcttcctttctgatgtggatgcctttcatttcttttccttatctaattgccccagctaagacttccagtactataatattttgaatggaagtggtgagtgtgtgaatccttgtcttgtttttgatcgtgtggaaaaagctttcaaattttcactatttggtatgatgttagtgttactggaaagggatcccaatccagatcccaagagagggttcctggatcttgcacaagaaataatttgggatgagttcatagagtaaagtgaaagcaagttcattaggaaactaaaggaataaaagaatggctgctccataggcagagcagccccaagggctgctggttgcccatttttatggttatttcttgattatatgcttaataaggggtagatttgtcatgagttttctgggaaaagggtggtcaattcctggaactgaggggtcctcccccttttagaccatatagggtaacttcctgatgttgccatgcatttgttgtcatggagatggtgggagtgtcttttagcatgctaatgcattataattagcatataatgaacaatgaggatgaccagaggtcactttcattgccatcttggtttcggtgagatttgaccaggcttttctttttttaactgcaacctgttttatcagcaaggtgtttatgatctgtattttgtgccaacctcttatctcatcctgtgactaagaatgcctaacctcctgggaatgcagcccagtaggtctcagccttattttcacccagcccctattcaagatgaagttgctgtggttcaaatgcctctgacatttcactgtgggattttcataaatggccattaatatattgtggtaatttccttttatttcttttttttgtggacatatatttttatttctctttggtaaatatctggaagtgttatctcggagctatatgaatttatgcttactttataataaattttccacctgatttcaacagtagctctaatattttgtattcctatcagcaatgaaggttccagttgttcctaatacttgtgaacacgtgttattgtctgccttttttattttagccataatagcaggtatgtagagctgtatcattatggtttttatttctacttccctaatgactaattaagttaaagttatatcatgtgcttatttgccctttgagtatcttcttcagtgaagtttctgttcaaatatattgcccatttattaattgattgtccctcttcttgttatttagtaggaggtgttcttttttttttttttttttaattatacttgaagttctaggatacatgtgcacaacgtgcaggtttgttacatagtatacatgtgctatgttggtgtgctgcacccattaactcatcatttacattaggtatatctcctaatgctatccctccccactccccccactccccgacaggtcctggtgtgtgatgttccccaccctgcgtccaagtgttctcattgttgaattcccacctatgagtgagaacatgcagtatttggttttctgtccttgcgatagtttgctcagaatgatggtttccagcttcatccatgtcactacaaaggacatgaactcatccttttttatggctgcatagtattccacggtgtatatgtgccacattttcttaatccagtctttcattgatggatgtttgggttggttccaagtctttgctattgtgaatagtgccgcaataaacatacatgtgcatgtgtctttatagcagcatgatttataatccttcaggtatatgcccagtaatgggatagctgggtcaaatggtatttctagttctagatccctgaggaatcgccacactgtcttccacaatggttgaacagtcccaccaatagtgtaaaagtgttcctatttctccacatcctctccagcacctgttgtttcctgactttttaatgaccgccattctaactggcgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgattttttcttgtaaatttaagttctttatagattctggatattagccctttgttagatgggtagattgtaaaaattttctcccattctgtaggttgcctgttcactctgatggtagtttcttttgctgtgcagaatctctttagtttaattagatcccatttgtcaattttggcttttgttgccattgcttttggtgttttagtcatgaagtccttgcccatgcctatggcctgaatggtattgcttaggttttcttctagggtttttatggttataggtctaacatttaaatctttaatccatcttgaattaatttttgtataaggtgaatttccttttatttctaatttgttcagtgaatttaataattttatgttctttttgcttataaaatgaatataaattcaatttataagttacaaattattttaaacttataaataattattataatttataatttatatcatcaaagtgtcaaaattttccaaattttaaaaattcagagcagattgttttgaaaattcagaaaaatacaaggacccaaagggaaaaattactcatgatcctatttcttaacttttcctttaatttatgttctttgtggtctctttctcaggtaatttggcccagacaagagctaggataacagtggcctcaagttctttgcctccacatttcagtgctgggaaagccaaggtgagtaacagatttgcaccaaatatagtatggactggcaggtactcttgacccagggataatcttagagtgggcagcattagttcccttctagcagccctctgcctgggcagtctagtagagagattaaaggcatttaggaaatcaggggttaggaaattggaaacatcatggaatccttacaatcctgattctcagaaagagcacttaagaacaatgctacctgaaaaaataaagtctaagaaaagataaagcatttctctgacactaccagcaagctagtggaccaaatggaatcagggaggaaagaaactacagtgtttcctattgctctcctttgccctctgaaaaatgagttgtacactcatctgtgcaaaggagttattagaagggttaaaaaatatccagctgtaaaatatgtctttaactgttctatccttccagctaaagtttaacaagagtcttaaggactgcttcgttaatattcattgtaagtgccaacagagaaacacagttatcttgaaggtgttggagtaaaggctggtcacgtttctgaattttcttatcttttggtttacactgaaaatttatttaataaagaataaacaatttggccacacgttaatactgttgaatagtattccaaaattgatacagatgtacatatttatatttacttttcttgagaataaaagacttatttgcagagtgggaactcaaatcattttttgttaaaaataattttttaccaatattgctattataattcattgtaataccctacatttcaaccttgctacttcacggcaaaacattagtactatctgggcctctagaaggatttacacaggagtttcagtggttctgatggcctcttgatagcgcatgtaaaattttatctgtatttaatacagttggttctcattatttgtaaaagttgtgctctctaaagttgctgcaaactctgaatcagcaaatactgaaccattgcttccaggaggaaatacggggtcaatacttaggccacaatatttttgtgaagtgatcaatgcataacctcattttacacatgtttctgttaaaagacaccctatttaatatatgtttattctaaataattatagtcagtattttaaaatataaaacagtatgtcaattgcagcatttgtgtcattgaactcacaatcaatagcactgtaacacatgcctgaacaataagtattttctccatgaggcatatcacaaccttcttgtgcttagaaacactagacagcaccacacttgcggggatacattttttttttttatttttgagacagagtttcactcttgttgcccaggctggagtgcaatggcgtgatcttggctcaccacaacctctgcctcctgcattcaaacgattctcctgcctcagcctcctgagtagctgggattacaggcatgcaccacctggcctagctaattttgtatttttagtagagacggggtttctccatgttggtcaggctggtctccaactcccgacctcaggtgatccgcccacctgggcctccccaagtgctggattacaggcgctcgccaccacacctggcccatttttttttttagacaagttctcactcttatggtccaggctggagtgtagtggcatgatcatatctcactgtaaccttgaatttctggcttcaaggatccttccacctcagcctccagaatagctaggactataggtgggcaccaccatacctggctaactaaaaaaaattttttttgtagagatgaggtcttgctatgttgttcatgctggtctcgaactcctggcctaaagtgatccttctgccttggcctcccaaagtgctgggtttgcaggtgtgagccaccacatccaccctgggttgggcaggggtcgggggcagcattttaaacagcaaaattaccaatggaaaaatcacaaaaatgcaaaaaaaaaatgtggtacttaaacagacctcaaaaaggacacttgtttatgagagctgaaataagaaggcagagcatcatcttctttgacatcagctggaaatgtgtgcgtcaggggactgagcatttctgtgaatgaccatgaaagcattgcagatattgactttgggttacaaataaattttagcaagtaggcaaatcctcagataatgaagatggattgtctttgtggttttttggagtcactggcttccaccagttctaaaagggattatgacacagaaacattaaagaaccccgtgtcgtatttcctgtcaacccacattcctctcctttcctctgtttgatttttgactactggactaaggcatatcccctgccttccacacccatagtaccagcaaagtgttgcctccctccctgtactatctaccatggctcagaccctgcccacatgaaaagtgtgccttctagtgtgtggcatatatttacgttattaataataatgtgtatgggtctgatgaaaatgactaaagatttgttttcacttagaaaatgagttgaaaatcctaataattaaggcatcaaaaatatgaagtgcagtaatagcaataaaaaatgaaacaaaaccaactccagttactatctgacttatccaaggtaaaattacagaagtggccctggataaagctcggctctgtaagtgtgggggaaaagtaatattgtttcctcacccatcaaaaggtttatggctgagacctctataacaaaaagcagattaacaagagaaaagcctacaaatttatttaatataagttttagatgacatgacagccatcagatatgaagacccaaagaaacagggaaatctgtgtatttttgtggtcagttgtacagaattatgactgaaaaacaaaagggtatgatttaatggtattaaactggagcttacttagcaaggactgtttgctcaaattcttcttggtgtccctatatgacattccttacctctgggtattccttacctcaggtcaggacatctgtcacatgagggtcttcaggggagaagggagggagaatggcagagagtgaccttcctaggtattctggcctgcttcagagaagagctgtgggaaggtgagagtggccttcctgcttctgctgtttaaatgcctaagtcccatgtttggggatagcatgtccttgactctatcagctccaacacatggagcagcactgcacagtcagttttcaatgtgtcttgctttctattcagtactctaacgatgtttgagaccagtggtgctgtcgggttttttttcttcttcttaagggatagatgtatcacttgatagcaataaaaattcttctaaagaggctttgtcaagaagataataaatatgaacacttctgaggcttcagcatgcaaatagggagcgctaactaagaacaggaggaaattcttcagttttcatttattgccaaaatctagatggtttatgggattctttggagtctatatctgtatccaagagtaaacttagttgacaaatgaggcaaatctttttactgataccgtgctttcagacttttattttataagttatataaaccacatcgggtggtgtaaccacccagtgggttcatcttggccactgcctagacagagccaattgatcaagatgggaattgcaatagagaaagagtaattcacacaatgctggctgcgcaggagaccagagttttattattactcaaatcagtctcctcgagtagtcaaggattggagttttgaaggatactttggtaggtagggggcaagtcaatcaggagttctgattggtgaggccagagatgaaataatagggagttgaagctgtcctctggggctgagtcagtttctgggttggggctataagaccagatgagtcagtttattgatctgagtggtgccagctgatccatcgagtccagggtctgtaaaatatctcaagcattgatcttaggtcttacaatactgatgttatccccaggagcaatctggggaggtttagagtcttgcagcctccagctgcttgactcctataccataatttctaatcttgtggctaatttgttagtcttgcaaaggcagtctagtccccaggcaggaaggggatttgttttgggaaagggctgttattgtctttgtttcaaagctaagctataaactaagttcctcctgaagttagttcggcctacacccaggaatgaacaaggacagcttggaggttagaaggaagatggagtcagttatgttagatctctttcactgtaataattttctcagttacaatttttgtaaaggtagtttcagtccctttctttgggttttgtaacaccttattcttcagatgtgggctatgaagatggaaaaaggatgaagaccactctaacatcttcctgctgaacagggggcatagtggggttaggtattgacccctaggtaagaggagtagaactgctttgcagctgtctgcatgtactcataggtgcctggttggggtttcaaggcttacatgacaagggtgttagtatcctcatctatagttttaatgcatttatagaacaacatactatatggtaaataatgcattctgggataagcagtgcaattccaagttttaaaagtaaagatttgaaagcattagtttggggacttgtagctcacagataatttagaatttaatccaaattgcagaaaataataaaaactcaagaacaactaacaacaggtgtgcgatagtttttttttttttgaagtataatttttctctcacgagtccccagttttactaaagataaatcatagtaggtcaaatttacttgcaaaataaattttagccctattatgcttggcttgattatttgcataaagtccagtaggaataattatttgccatataggatcttttaaaattggctttgctgaaactttgttctacaaggaatctcagattgtacttttaaagccttgaagcccagtcacagatttatgtatgcctgcaaacacctttatgagttgagtgaattttcctcctctgaaggtcctaaggtaacttggtgctcctgggcctgtcagaaagtgacattctttatttactacagatcaggaacccagtacacggactgtgtagacaaggtatgaggccagctttccctttattagctctataagtcaactttgattatttaaagaaagcatgccattccagtcaaagcctggtaaaataaccagtttctccagttgtgccctgttacaaaagaaatgagatttttattgcagttatgcaaaaaactagactgccataagttgagaatactcacaaatagtttctaaattctggaggaatcaggtagagagaaagcaatatgctccaaatttcattcatgggagtatactttactcaattgctaaatgttctaaataactcaaaaaaaaagttttcttggctgaacacagtggctcatgcctgtaatcccagcactttgggaggctgaggtgggcggatcacctgaggtcaggagcttgagaccagcctgaccaacatgaagaaactccatctctactaaaaatacaaaattagctgggcgtggtggtacatgcctgtaatcctagctactcgggaggctgaggcaggagaattgcttgaacccaggaggcagaggctgcggtgagctgagatcgcgccgttgcactccagcctgggtgacaagagcagaactctgtctcaaaaaaaaaaaagaaaagaaaaagaagaagttttcttgactctgaaaaacaaaaggattcgcaatgtttatcacatcagctctccataagtcctagaagtttgttttgtttcctctattccaataacacaatttctacattatcagagacctgcattcaagagaacccatcagagccctatatctgattataaactgccttctgaaaaggatcaaaacaagacaactgtctgtggatgacaaaagtcttaggacagccactattaaagctacaactgactaggaattttggttacttctgtggcacacaacaattttacataataattaaaaggcttaatatacattaaattatatcagaattatagaagcttcctataattttggaacacatacaaataacatatttataaaaatacagtccaaagaaagccaaacatcatttcatatttgacagtgtttcctgtgtgatttttatataagaaagcaaatacatcatttttgcactttaggggacctaatatctaaaagattaattaggtcagaaaaagacatactttataatttaattttggaaagtttgtcacatatcaaaggtttacaacactggatatcactaaatagaatcccaggtcaccgtaagtcattcatttagccaaaatgataacccagaaattttaaaaaggaaaagacctgtactctgatagagaggagactcagctttctagacaacaagatcctatgaagacagcatgaggccagctgaatctgtctcttctctctcccctcccttttttttttgtagtttactcaaaaggcaaacaagatttgttttcattgtctctaatattacataaaaatctttttcaaaagagaaaactaagtttcatgtttgctttagggcatctttaatgctaaagctagtttttaataaaattttataaatttatgcagttttaattagtttgaccataaggtaagattttcataaacttcttataactctttacaattttctgttaaacagatcaatttttttaaaagaaaaccctgctattcagacacatgggcccagattctggctccacatcagtgtgcttttattttaatgtttgagctatagaaaaatactaaacaattcccttcaactcttagccaacttgctgcttctcacagaacttcctttatcagatcaacccttcacaaacctttctaacttgcttaaaccttcaattttgtccctttactcttttagtttaagacattctttaaaaccctcttaactagacaaaattacattccctttaacaaaaaccatattcccatgccttcttataatttcccaccaaaaccacattctactttccttctataccttgcaaccttgcatgtaaaactctttttccagtggactcaagtacatgttacactattaactttttgcatctttcatttttggtgaaaagcctgataagtaaatgattttaatatatactagctgtggagcctaggacaccagacagaagtacaaataaggtttgattcttcctagtacaggtaggcggcatggcttacgccacatgtccctaggccttatctagaacctaatgactccaaagtaggtaagtcaaacagttttcaaaagtcaaagaagcagtttattaccttaaagcattttaacaaacctaatatctgacctaatttagaccaaatgttttgaccaaatgtctaaattttgaagacatttttattttaccagtaatctttaaaattgtctttatttccgaaagattactaaagtcacatgaacaaaaacttaaagtttctatttttctaacaaaatatttgatttaagcccttatttttacccccaattgttcagagcactttcatatataaacatcacacaaacagacatgaatatacacagaaaagaagatccagtagttgtcaagattttcatttgtcaatagttggattactggcttcagggtggagcccttggaggaatagggtgaggaaagcttgcagttttcagggcctaataagcaggcacagctggaaggcaaaaacagatccccaaaattaagggtcccatttttatatcacatcctggatccccaaaaagaggaaaacactatggaagaagacagtacaacgcttttactgtgcattttattgcaaggcaacccaaagccaatcggcccattttgtaatcagcccatctacatgggagtctcatctctcagtggaaggtggggatgtttgcacaccttccagatggccaagcatgcttctctaatccaagcatgcaaagagccaagtatccctccataacagccaatatcccttaaagttgctatacaccaaggctaaaggctttcccataatgcaaagtaatttctgatacccccaaaagtaaaaaaaaaaaggttcaggtaacataacgtaaaaccaaacaaagccttagattttgagagagatctattcactttcaattcctggggttccatgaggaaaacaggttttttccagaatggggtctgtggtgccacctctgtttttccccaggagtccaggcttttgaaattcttaggttctctcatgtgggcatcaagagcaacaaaaagacaaaatggagaaaaataattccgtcaactgagaagaaaagcctttttcagaaaaatatgattcaagaagaggaaaaagataaaggccttttaagtatgtatagcttggatatccattttaattaagctgattttaacagtagagctcttttgttttttaaaaaaacttttaaaatctcttattccagactccagccaggaaagccaatatttttggcctttgaattctaccacaggtaagctcccagtgaaattaataagttttaactaaggttataacttaaccatggatgcataaagtgtctcaaagagacagtaaacagtttctttatttacaagatttagaatctacccaaagataattgagagaaataaaaaattaagacaggaaatcagaagccgtccataggggaaaataatcaataaatggcaaaaagttacacaaataacaaaccagaaaggactgatttcctaagcgaagaattgaacctaggctgccattgtcaaaaaaacaaagccttagctatggaactacaacattaagcatttcctattgttcttcccaaaagaggcctagagtagccaattttgagcttgcaaaggctttaaagtgcttaagataatttttaggactagctatgacatgaaccacaaaatccttgtcctctggatggcagagactaaaataaagtatccccacatggtcacatggttaagattttaaggacataaaacaacatgagaaacttcatccggtattggtttcaggggcctgcagcaaagtttgtaactgacaagcctgccaggctggcttgaaaagtaggggtttaggggtccacagcccacgttctatcctgtggcactgccgctccattacagaaagacaaattctttgcacaaagtacaccagatttgctgcagcctaataagacgagtttcacaaatcctttttttctattaatcatacctttgcagaagagactaacagtgatgtttaccatttacacacacacacacacacacacacacacacacacacacacacacgagagagagagagagaaagagagagcgaccaactgaccagaaacctggctggtaagaaattcttaccctttttgacagcataccaggtaccaggtttctgggctccctttctctgcaactttcagaagaacagagcagcttttgatgaccctgctcaccacaccatagctgtggggaccaagccccattacaaaagaaaatgatcactttctgttttatggaaccataggcaaaagctttctagttttgcaagatgctgcccgatagtctgcatgaggaactgaattaacattttccatcccagtctaagcaaaatacccgtaacaaaacagacactagtcacctcattccacacccagtattgacctaacaaggctcaaactttctcccattggtctctgtcatctttgatccacttaaggtgaggagggatgacctccaaccaggaattcaatgagtggtctctgggcaagacgaagagtggagaatcacagagtcaggcctgttgagctttcatcagggctaaccgaatgcaattacacttacagagggttcttcaagttaggcctgctggactttggttagcagtttcttcagagatccattccacgcatacaaacacacacacaacaaagacaagatggacagaaggccttccaaatcaagatcccttgccaagaattccaagagtattccttccaaactaacctcctattctccatctgagaaatctccccagaatcttcctgattgaggagaaatctctggaaccaagactcttcttactcattagggagggccagctgagaccttgaaggagccaaacctatcaggagaagggaggaggtgttggcagctcctagaatacccaccaaatcagacaccgataatggggctacagctacagacactccaagattgggctacagacagagacacaccctgcaatacggctccagttacagacaccctgtggtggagctacagacagacatcctaccatggggctacagttatgaaatgtctccgcaggactatttctctattgcaattaaattcatgcacattgggctggcagtgacctgccagtagagacagtgcccgagtcagcccctaatccaagagaactaggtggctgcttgggctggcctctggatccatcaaaggagaggggctaccgaaccacgggcaggtagccacaaaggcaatcccagaccagcccccaaatttgtaaccacctaacgggctcaccttgcccactgcctagacagagccaattgatcaagacagggaaattgcactagagaaagagtaattcacatagagccagctgtgtgggagaccagagttttttttattactaaaatcagagaatttggggatctgaatttttaagcataattctgtgggtaggggggacagtgcattaggagttctgattggtcagttcagagatgaaatcatagggagttgaaactgtcctcttgcactgagtcaattcctgggttgaggccacaagaccagatgagccagtttattgagctgggtggtgctagctgttccatcgagtgccgggtctgtaaaatacctcaagcattgatcttaggtcttacaatactgatgttatccccaggagcaatttggaaaaatttagaatcttgcagtctccagctgcatgactcctaaaccatgatttctaatcttgtggctaatttgttagtcctgcaaaggcagtctagtccccaggaaggaagggggtttgttttgggaaagggctgttattgtctttgtttcaaagcaaaactataaattcctcctaaagttagttcagcttacacccaggaatgaaaaaggacaggctggaggttagaagcaagatggagtcatcagatctcttttcactgtaataattgtctcagttataatttttgcaaaggtggtttcagtggcagtatataatgtttaagaaatatggtttaggaatcaaagtgggttcagatataggcatggccatctactggctgtaggactctgggaattctacctaaaatatgttagtcttaacttcctcatatgtggaatgggaagaataatattatttacctcataggttattttgagaatttagtgacataacataggaagtgtttagtacagtgatttcagataggaaacactcaatagatactgtattactcaagttttgataactatttaaaattccatgtgtggagcccatatgtatatagaagcttgctcaactgctgtggtgtagggactgtaacacaatttgtaaaacttactcgtgactactctgaaggctaatcattcacaaggaaccaaacaggatgtttatcatgtgggcagaaagcacgcttgctcagctccaactgacttacattgttttgtaagtccgtgttgtaggaggaaagtatactgggttagacagacaatggttttgtccagaatatggcttctattgatcattttgatattggtcttataggggccaagggaagacttcctcactctctgaaagtttgctgaaaataaactgacaagaggcagattaatatgagaaaatgcatacagatgtattaacgggaataggggagaatcacagagtgattacccaccagacaaatggtacacagatggttatatacccttcttaagggagagggagatggagaagtgtggatattttggtgggggggtggggcggtaaatgattttaggggaatttaatggccttgaagaacatacaatggcctgggacaaagtctgttaggtctgcaaaacaaacagtggtttgggacaagtctgtccagttgtgttgacagactgcagcccttcttcctgtgataggagtttagttaatgaaaaactcagggaagggatcacaggtaattgttttctttggtgggtctaggctttaggcagataaatgaatttcagagaacagcttcatcctgggctatgggagagacagaggattaagagatgggggttgggggtatcagagagaccttgattcttcttcagttcaacatgtcaacatggggtatatgaacccagttcaacatggggtatatgtttctgtaccccaacagtttcattagaactatttttcttaccaataaataaaaagatctccttgctgagttgcatggtagcagaactctccttctgccactgaacgcactttgcatccttgatatttaaaactacgctaaaactaaatcaatcacagtaatgatggaaggagaactaatgttatttgttatatgtgcgcaaggcagcagttttgactaaccaattttattaatgaggaaaacagaggcttttaaaagttaaatacagtcatcagtcacttaataaagtgatatattctgaggactctgtcattgggtgatttttgtcgtcgttcattcatagagtgtgcttacacaaacctagatggtatagcttactatacacctaggctataagctatcgcctttcgctgtgagactacaaacctgtatagcatgttactgtactgaatactgtaggcaatgtaacacagtggtatttttgtatctaaacatagaaaagatacagtaaaaatgtggtacaaaagattaaaaatggcacacctgcatagtgcacttaccatgaatggagcttacaggactggaagtcactctgggtgagtcagtgagtgtgtggcgagtgaatatgaaggcctgagacattagtgtacactcctgtagactttataaataatgtacacttaggctatactgaatttattttaaaatgcattttattcagtaataaattaaccttagtttactttaacttttttttatgaacttaaaaaggcctgtaaaacaaagaatggtttgggacaagtctgtctaaaagactttttcacttttttttttgtaataacacttagcttaaaacacaaacacattgtacaactgtacaaaaatcttctttctttatatctttattctataaacttctatttaaaaattttttacttttatttttaaaattttttgtgaaaaacaaagacaccaacacatacattagcctaggcctacacaggctcaggatcatcaatatcactgtcttctactaatgccacatcttgtccaactagaaggtctaacacgcatagtgtcatcatctcctatgataacaatgccttcttttggaatacctcctaaaggacctgcctgaggctgttccacggttaatgttttttgttttgtttttaatgtaagtagaagaagtacaccctaaaataattacttttttgtttctttgagacagagtttcgctgtgttgtccaggctggagtgcagtgccatgatcgtggctcactacaacctctgcctcccgggttcaagcaattatcctccctcagcctcctgagcagttgggactacaggtgcccaccactacgcctggctaagttttatatttaggtagagacagggtttcacttcgttggccaggctggtctcgaactcctgacctcaagtggtccacgcaccttggcctcccaaagtgctgggattacaggcatgagctatcgcacctggctaaaataatgattacaagtattgtaaatacgtaaaccagtaacatagttatttactatcattatccagtattatatactgtacattattgtacatgctctgcttcgatatgattggcagcgcaggtttgtttacaccaaatcaccacaaacacatgagtaatgaagtgcactatgacattatgtctacaacattactaggcaatgggattttttcagctccattataatctatgggactaatgtagtatatacagtttaccattgactgaaatgtcctacttctatggcacatgagtgtaacaggtgcatggccacacagctagcaagaatttcaaccaggtttgtcaatagcaatcactcagcctagaaaagcttttctggtctctttttttatcctaaggtaaagaacatatactttggagaggattttctctttgtcaaatccccacttttgggaagaattatttgctagatgatgccctaatagaacccactttccaggttgtttctaaaagcatttttggttaaaaaattaaatgatgctactactactataatgaaattagctcaggaagacaaactcttaggctacacaacagccttctcagcccttttggtttggagttttggggctggctttggagctccgtggaaggcctgatacagagagaggtctagtttaaaaggctgagagaagcaacttctggtttgttccttgtcggaaattcttttagatccattccaagttcaggagaaccttatgaatatgcaaatatacaagagatccctcaccaaccgaagacctttttaaattcttcaattagaaaatactccaataacatattgtgaattggtgggttcttggtcttgctgacttcaagaatgaagccatggaccctcgcggtgagtgttacagttcttaaagatggtgtgtccagagtttgtttgttcctcccgtccggagttgttcatccctcccggtgggtttgtggtcttgctggcttcaggagtgaagctgcagacctttgcagtgagtgttacagctcataaaggcagagtggacccaaagagtgagcagcagcaagatttattgcgaagagtgaaagaacaaagcttccacagcgtggaaagggaccccagcgggttgccactgctggctctggcagcctgcttttattccctaatctgaccctacccacatcctgcggattggtccattttacagagagctgattgacccattttacagagagctgattggtctgttttgacagggtgctgattggtgggtttacaaaccttgagctagacacagagtgctgattggtgcacttacaatcctttagccaaacacaaagttctccaagtccccactagattagctagacacagagcactgataggtgcatttacaaacctttagctagacacaaggtgctgattggtgcatttacaaacctttaactagacatagaagttctccaagtccccacccccacccaggagcccagttggctttgcctactggatcctgctgcaggtggagctgcccaccagtcccggcgccacactcctgcactcctcagcccttgggcagtcatgggaccgggcgccatggagcagggggtggtgcccgtcgaggaggctcaaggctcgggccgcatgggaacccactgggggtgggggggcttgggcatggcgggctgcgggtcctgagccctgccccacggggaagtggctgaggcctggcgagaatttgagcgtggtgtgggcaggtgggggacctggtgcaccttccgcagctgctggcccagatactaagcccctcactgcccgtggccagcggcactggccagccgcttccagtgcagggccgactgagcctgcccccacccggaactcatgctggctctcaagggacgcgcagccctggttcccagcccgtacctctccctctttacctccccgcaagcagaaggagccagctccgccctcggccagcccagagaggggctcccacagtgcagtggcgggctgaagggctcctcaagcgtggccagagtggatgctgagacagaggagtcgccgagagtaagcgagggctgctagcacgggctgctagcatgttgtcacctctcaatatcacctattctaggccgggcgtggtggctcacgcctgtaaacccagcactttgggaggccgaggcgggcggatctcaaggtcaggggttcaagaccagcctgaccaacatggtgaaaccctgtctctactaaaaataccaaaattagccaggcgtggtggtgtgcagctgtaatcccagctactcaggaggctgaggcaggagaatcgcttgaacccaggaggcagaggttgcagtgagctgagattgcgccattgcactccagcctaggtgacagagtaagactccgtctcaaaaaaaaaaaaaaaaaaaaaaagacatatgacctattctgtcaaacacagtactaagtatgtaggtggtgaattacagataagcattagcatttccaggttgtatatgtcaaaggataggtttttactttatttccaaacatcactctgtatgtgattgcaaggacagaatttaaagtcctgttgaaacacagatgctgtgcagttagacagggcccgtcactagctgggagctacctcctgaccacgtagccttataacttttagagtgcaaattggtgcttaactctgcatttttccaatttgctgtagggaactggtgctgatcttgaaaacaatacagattattccttttatttatttatattttatttgtgcagatttatggggtacatgtgaaattttcttataagagtattccttttaaattgtgtttcagctgaattaatacacatcaaggattttttggtcactaaacttaaattctcaaatgctaagtgtctgttataagttctgagggagggtaataggtcaattcataaacatctaccaatagaaaattataaatgagcttttcagctgcctggggggctggtgctcactagttaatttgaataaaaagggagggaaatgaaggaggaaaagccaggttcaaagcaagaggtgcttcttcagggaggatctcttaacaaaaagaagtgctgaggccgggtgaggtgactcactcctgtaatcccagcactttgggaggccgaggcgggtggatcatctgaggtcaggagtttgagaccagcctgaccaacatggagaagccctgtctctactaaaaacacaaaattagctgggcgtggtggcgggcacctgtaatcccagctactcagcaggctgaggcaggaaaacacttcaaccccagaggtggaggttgcagtgagctgagatcgcaccattgcactccagcctgggagcaaaactcagtctcaaaaaaaaaaaaaaaaaaaaagggctgggccgagcacggtggctcaagtctgtaatcctagcactttgggaggccgaggcaggcagatcacttgaggtcaggaattcgagaccagcctggccaacatggtaaaacctcatctctaccaaaaatacaaaaattagctgggtgtggtggcaggcgcctgtaatcccagctactcgggaggccgaggcaggagaattgcttgaatctggcagatggtggttgtagtgagctgagatcgcgccattgcactccagcctgggcaacaagagtgaaactccgtttaaaaaaaaaaaaaaaagaagtggtggagaaattcccaaagttgtgtgtatgtatatgtatggaggtcggcggggccggggtagaagaagaaaataaggagaaaaaagttgaagaaaatccagaatttacaatttagccaaaggctggccctagccaagaccttttcttcagacctgattaatttgccccaaacctcaccagctctgagttctgtactcaaatgggggtgagaaagggaaagaaacctccagagtggacccatctggtgacagcggagagagtataacacgctctgcaggtggtgctggtgtgttgtgttttctctttgttccctcttctttctaaacccaggatctttcctttcctcctttcccattagaaaacatcaaaatgtcaaacctacaggcagttatatcattgtttcagctgcatgtgaatggactgatggcatcggccgtgcagctcattaaaataaagctgcactgtctctgatgtcttcacttgggtcatagagctgctcactgataggttgtttttctaggttttgaaaacttagctccatgttttctccccttcttaaatgaacctgttttctttacccatcccagatgaagcatttccttccattttgcatacagtctcccacatactcctttaggcaagcctctttattcacccctcctaactctcaccccttttagcaccagtttttcactttcattgaacaaggctgcagacatcctcaccccatgggaaggtggctgcctggacggcagtccacccagcctaacccacatgctgacagcagtgtcttccatctcaaacatttctgctttatacccttgccacctgttcagagcagatgggaagctgccacggcaaggccagtgctaaatgccactcatgcactctgcaaaccaaagcagggtttttgttgttgcattataataatggaacacaggctgcttgcagtcagcccctacaattgttttcatcaatcagttcctttcagtcagcccaggtagttgggatagatattgagaacaggtgcattccattgggtttccgagtgatttggtgcctgagctcctatctgcaatgagcacatgggaactgtgggtggtaggaggagtctgatggttgcagcatcagagtctgacgacgtggaaggcaactggtgctggcctaattccctgtggtacaacctgggctttggggccatcacgtctttataatcatttcgcctcatggccctttgccaagtttccttttaagcaatagtttggtctcatatgaccttactggagaatttaacaggggttcattagaagatgtagaagtatagaaataagaggggtttacactgaaaccacatggtattttatagagtgaggtattgtcaaatgagtagaacaatgcatattctttcgtttctatgttttgaaaaattctccccacagtatacactattgtgtcctaaataccatggcccctcaggtatttggccaaacaggctttcggattttggaagacatggagcatgaggtaagtgcctagatcctcaaaccacttgcctccacctatgcttccaggtggacactctggaggtgatacggcatccggaagaaaccaccaacatgaagaggcaaactgtggcttcttacttccgggtatggagtcttcttgatctctattctgcctgcttccaaaaaggactgtctaagccttcttatgagatgcccagatggagtcagtgaaacaagggcaaagcacagagtcaagaaagattgggttggggaagtggtggaagcaaggaaggaagagaacattgggcacaaaaccctgcccattaagtgactgattctgttagcatatgagctgcttcttggtcttaaagctactagaggcagccacttttctagcatactgaatagtaaagtagttaataaagttccagaaggtggcttataagttcagatactgagagaatctgtcttagcattgactttattttcctagattgaattgaccccttgtaaaacccacttgtctgagccctattatttcccatttctgccatccctatttctgatacttcatctagttaaatgcctcctttgggtaaaaacatggtctctagaagggctctgttaaatgcacattatatagcaaagataagacatatacactcttgcacagatttgtttgtcttcaaattataaagcgttagagttggaaggcccttagagactgggagctaaggtccagatagtttcacaatagaaatactgttaggccgagcacattggctcacacctatagtcccagcattttgggaggctgaggcaggcgcatcacctgaggtcaagagttaagagaccagcctggccaacatggtgaaaccccttctctagtaaaaatgcaaaaattaggtgtggtggcaggtgcctgtaatcccagctacttgggaggctgaggcaggagaatcacctgaacctgggaggtggaggttgcagtgagctgagattgcgccattgcaggcctgggtgacaaagtgagactccctctcaaaaaaaaaaaaaaaaaaaaaatgctgttagatcaaatttagaactgatctcagggatagcagaatgaggtagtaagatagggttggcacaagaaagggcttggcagggatgagaggtcaggtggatgggaagctggaagagccaggaaggctgaagggcaggacttgggagccagcactctggatagaaggctccatggaaagctagcaggtgcagggatctaaaacgcggaagtccagcctagccaattgtgcttcagaggcaggctagaattgggctcggtatgaattgcaggggccccagaccttcgaatccagtattccatccatgcattgagtcgtgctatagcatctgtggaaggtgggcccctgcctcatcattctgatgtttggttatttataattgctacttatttcttatattgagacacacctggtcctatccccttgagtggctctatcctcatctgttagtctgttagtccattttatgttgctatgaaggaatacttgagactggataatttttttttttcttttaagacagagtctggctctgtcacccaggctggagttcagtggtgccatctaggttcactgcaacctccgcctcctgggttcaagcgattctcctgcgtcagcctcccacgtagctgggactacaggtacgtgccaccatgcctggcaattttttttttttgtattttcactagagatgaggcttcaccatgttggccagtccggtctcgaactcctgaccttaggtaatccacccacctcggcctcccaaagtgctagggttacaggcatgagccactgtgcccagccaagactggataatttataaagaaaagaggtttattggctcacggttctgcaggctccacaagcctggcaccagcatctacttggcttctggtgaggcctcggggagcttttactcatagagcaggcgtgttacatggcaagagagggaggaatggagagagaacaagatagaggggagatcccagactcttttaaacaacccgattttgcatgaactaatagagtaagaattcactcattgccgtgaggacagcaccaagccattcatgaggaatttgccccatgacccaaacacctcccactgggcccatttccaacattagaggtcacatttcaacatgagatttggaggaaacacacatccaaaccatatcatcctcctggtaacccttggtgtctgtatgtgtttcccactggatttagtagctctatttactctgtgaagtgatcctcaagatcttagggcccccctatcagcagaaaagcctctggctacggtttttcagaaatatacccatacaaccagtttggtgttctcaaaatacccgttcacgagtgctaaacctgaaaaataagttaccttggaaactaggtaacaccaattttgatctgtaggagcagtgactatgaaataatggaactgagttcctttggcttataatagctcctgaaggtgagcccagaagagctccagcagtggatgcccctgaggaacaactgaggccctccctcacaagcacccccctgattttccgtgtccttgctcccctcttgctgtgagagccctgtaccagctgcttggtgtatgttagttgatagtcaccacagtcttctttttggtacttctctcattttctttgccttgtttttgtatttttcttttctgtcccactaccttattaccaatcgtatctgtaggatttgcttagactatctggtggttcttaggctgaagaagcaaatagccccttcctcaaaagctggacattttaaattacagatacagattgtggaacatcaccttggaataccagcgacaagcattctagttctggcggtggaattacaggataacctagatagagcatgttcttagctaagtttctgccatatgggatattgcttggcactaggtgatgtttaaagaatggttttgaatctgcagatggctataagtgcaacttacattattatctcctattgctgatttcatgttcttcctcaagaaggtctgtgagcctcgaactgctccagaggcttctgcgggcctgtgttgtaactatccattgtgttggtggtaaccttgttccttgtgcatttttctccctggtagtattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtcagaccgtcatctacgggaatgcattcttataaatgtagctctactctggccatccctgtgtcctaagattgttcctcctgcgtgctctcctccaaacatgtaattggctagttgccagctaccatttacttgcttgaatgttgcatttttattgtgcttcaactaaactgcagtgatccagcagccagattaagcttccttctgatcacattattttaaatttccatatacgtttatatgttataaatccttaggtctcaagttctccaggtattttgttgttatgatgaaagtatccctccataagtgggccggatttgaatgcacccaagcaccagttcttcttccaggttctggcatgatataatacgataattaacacttacataacacctgaagtatcataagagtacaggacattttagggcactattctaaaatgtattatctcatttgatccatagaacaaccctataagctagactctattatcatccccattttacaaaacgtaaaggtgagaaaacttgggtatgaaaagaaagtaagtgattttcccatggtctcatgctggtcaatgtagaaccaggatttgaacccaggcagtctggtttcagcatgcatgcttttaatctcttcagttcagtgcattcaatcaatatttattgaaataaattgcatggcactttcttaacccagaaagtgcctttgcctaagaatgaaatgctgctcttttctgaacgactgccatagagattatgtatgaatgtgattacaagtagaattttctgtgaagaaataaggaaaacagtaacaaaaaaaaaacacccctgagaagcactgctgtctgaggatgcctggagaggaatattgaaatccattgtatgcctgacaaagacaaggcaatcaagaaaaaaaaaatacattgtagaatctgcctcactccttaagccatccttagtgtctttttacttccactctgaaacatgtgcccaaagtcattttttccaaaattttctcaggagaggatgagtcataaatatggtagcttgctttgtcacgtctcccaaactctgctaaattccatggaaaagataaggcaaaaaaaaaaaaaaaagttccttgcaatgagagcttttaaattaaaaataagaaggaaatggctttttttttttaagtgtctttgagctccttttttcctcttaaatttggaagtggaacaagaaaaaaaatttagcacatgaatttgactagtcaagtattttttgtaacaatgtttgaatacataaaaatatttaagaaaacaggtcaaatgctgaacagattggcacttctttgttcataatcagaaagccattaggcaagtatgaacaggagtttcaaaatgccagtaaatctgaggatatcaaagatttctgagccagcaagttaattggtattttgatccttttgaaccacttaacaaaatggatgagttagcagttttctcccttgatgttattcaacaaataggtacacttcttatcttcctgttcaagagtgctgttttgtaaactcttagcaggaaatatgcagacaggacaatcaaagacaggaaacagagccattcaaggtttattaaatggaggtaaataaaagataaaaactcatttaatgtgactctacatttttgtattttctggcattcaggactgaaaccctgagtatacacctggtggtgttcttgggatcatgttgttgggttccagaaaggggaaagacttccccagttcccaaattacccaagtctgcaggcttggccaagcctaaaatactttcttgcccctattatctttgagctttctggcaaaatgacttggaagtgcccttccttatcctctactcatggagcctttgaggaagagggtgtccccaacatcctctcatcaatagggccaggtgaattggaagtctttatgttctcgactaggcatgaaagaggccacctggaaatgctggagccacactgttgagggacgtcatagaaaagcaatctaagcatttattgtttttatggtcagtggattctgatgcatagtctctcagaatgtctacagagggcaaacacataactgcatgtattgggatgtgttctggcaaatgtctaaaacatagggctgagtcaggctgggcgtgatggctcacacctgtaatcctagcactttgggaggcaggcacatcacctgaggttaggagttcgagaccagcctggccaacatggtgaaatcctgtctttactaaaaatacaaaaattagctgggtgtggtggctacttgggaggctgagccaggagaatcgcttgaacccaggaggcggaggttgcagtgagccaagatcgtgccactgcgctccagccagggcgacggagtgagacttcctctcaaaaagataaagaatagggctgagtctaattgtttgtttatgaagctattgtagtaaataatgcagtttagtaaggagacctgaattctagtctccttcagtatataacatctggaaagtaacccaatattctgtaaaagatgtttcctcacctgcatgacaagaaggcaggaatatacaaagcccacattctaaagattttcaaggattacttgcagatgcctggggcttacttagtttctaagtcttctagggatttttgccttcccagtcgagctcgctggatgagagacctgcatctaccaggctgtgatgcgtaacagttgttaaccattgaacaaaatgaaactcttccctcttctctttcattggcatcttccatttcttctcatgatggcgtggagaaccatggtgtcttggtatctctttcatctcattctcctttctgttccttcactctctctcttccagaaactaggagtcacctttgacttctcctcacttcctttaaataatccatcaccaggtccagctcactacctgctaaagtttctaaaaaatgttcccttgggaatctctcatcccttctcccatagctttagtccagcccttttgttattattaacagctcaatttagatataattcacgtatgataaaagtcatcttttgaaagtatacaattcagccgggcacggtggctcacacctgtaatcccagcactttgggaggctgaggagggtggatcacctgaggtcgggagttcgagaccagcctgaccaacatggagaaacctcgtctctactaaaaatacaaaattagctgggtgtgttggtgcatgcctgtaatcccagctactgagcaggctgaggcaggagaatcacttgaaactgggaggtgaaggttgtagtgagccgagatcgtgccattgccctccagcctgggcaacaagagcgaaactccgtctcaaaaaaaaaaaaaaaaaaaaaaaaaaaagaaggaaagtatacagttcaaaggtttttaattagtcacagagttgtataaacatgactaccatctaatcatagaacatttcattacctaaaaggaaactccaaactcattagccattctcccttttctcctcaatcccaccaaacttaggcaaccaataatctaacttccatctgtatggatttgcctatttttgacatttcgtgtaaatggaatcatacaacgtggccttttgtgtctggcttcttttacttagcatgttttcagtgttggatgaaatgaatactggtactatgtaccagtatgttatttttttgtagatgaataatatcccattgcatgaatatatcatgttttgcttgctcatttatcaggggatgaacttttgcattgtttccactttttggctgttatgaataatgctgctatgaatattcatgtacaacttttaatgtggacatatgttttcacttcttttgggtatatacctacgagtagaatttcttggtcatatggtaaccctctgttccaagtggctgaacaatttaaattaccatcaccagtgttatgagagtcccaatttttccacatcgtctccaacatttattattgtttgtcttttttattttagtcattctagttgatgtgaagtggcatctcattgtagttttgatttgcatttctctaatgactaatgatgttgagcagcttttctgtgtttcttggttatgtgtataccttctttggagaaatgtttattcaaatcctttgcccactttatattgttgatgtttatgtattccaaatattagtcccttatcacatagataatttgcaaatattttctctctctctctctcttttttttttaatgagctactggtcactttgatattttctcactctatgggttgttttctcttttttttttcttctttgagatggagtctcattctgtcacccaggctggagtgccctggcacagtcttggctcactgcaaactccgcctcccgggttcaagcaatctcatgcctcagcctccggagtagctgggattacaggcatctgccaccatgccctgctaatttttgtatttttaatagagatggggtttcaccatgttggtcagggtggtctcgaactcctgacctcatgtcatccacccacctcagcctcccaaagtgctaggattacaggagtgacccactgtgcctggcctgggttgtcttcttgatggtgtcctttgaagcacaaaattttttaattttgatgaagttcaatttatgtatgttttcttttgttgctcgtacttttggtattctacctaagaagctatcatctaatccaatgtgacaaagatttactcctatcattattctgggagttttgtagttttacctcttatattttagatctatggtccatttggatttaattttttgtatggtgtaaggtagaagtctaacatcattcttttgtatgcggatatccagcagtttcaacaccattttgttgaaaatactgttatttcctcccattgaattgtccttggattcttgttgaaaatcacttgaccaggccggggcgcagtggctcacacctgtaatcccagcactttgggaggctgaggcgggtggatcacctgaggttaggagttcgagaccagcctgattaacgtggagaaaccccgtctctactaaaaatacaaaattagctgggcatggtggcacatgcctgtaatcccaactacttgggaggcggaggcaggagaattgcttgaacccggaaggcagaggttgtggtgagccgagatcgcgccattgcactccagcctgggcaacaagagtgaaactctgtctaaaaaaaaaaaaaaaaactcacttgaccaacttgaccataaatttaagggtttatttctggactctcttctattcttttctctatatcttttctgggccttttaaaacgttttttttgctcaccctcttgccagttttctaagtggacttcctgcctatttcattctccaaagagacagcagaatagaatttgttaaaattcctatctgagcatattgtttccttgattaaaatgaccatccaggcccccatggggtgagctgcagtgctctggcctggtgtaagggagtccacctgatttggcccctgcttactttcctagtctcttctctcattttccacatctcagatcacactccagccaaaattgaattacttggtgttccctaaccatcccaggctgttctagtcttttgtgctttgctcaggctatgtcgactaaatctgccttctccaagccctcagtctgctgtcttagccaagctaaatcctactcattccttaggtctttgaccaggcattaacttttctgtgataccctccttgactttcccaggctgagttaggatctcttttgatgagcttctttggtagcacttactacattgtagagcaattatctacctcttatctgaaccttaactgcctggaaggcagggatatttttcagctcactttttatctatttatttatttatttatttatttatttatttatttatttattttgagacagggtctcactctgtcacccaggctggaatgcagtggcacaatgttggctcactgcaacctctacccgctgggttcaagcgaccctcccaccttagcctcccaagtagctgggccacaggcgtgcaccaccatgcctggcttatttttgtatttttagtagcgatgaggtctcaccatgttgcccaggctggttttgaactcctgagctcgagcaatctgtctgcctcagcctcgcaaactggtgggattataggtgtgagccaccatgcctgaacttcagctcactttatgtctgtattgtccgatgcagtgcctggcacgaattcagtgtttaattaatatttgttgagttgaatcaaactcttacctcttctttttcatcactattttctttttctttttctttttcttttctttttttttttttttttttttgagatggagtctcactctgtcacctaggctggagtgtagtggggtgatctcggcttactgcaagcttcgcctcctggattcatgccattctcctatctcagcctcccgagtagctgggactacaggcacctaccaccatgcccagctaatttttttgtattttttttagtagagacggggtttcaccatgttagccaggatggtctcgatctcctgaccttgtgatccgcctgcctcggcctcccaaagtactgggattacaggcgtgagccactgcgcccagccgttttatcactattttcttttatcatcccttgactcacacttcgatccttgctctttgaaatatatgacagatacctagaactggctttgttgaggttaagttttccttgtactgtagtgtacaacctagattgatagaatgtaagatttcaggtaagtcatagtagctctttatcaataaaaggtaagaaacctaaataagttgatttaaaataaggctgtaacccagtttgacaatgctattattagaagttaatacattgaaaggctaactttaaacaaatttgcctcccttctctataacaaaaatgattttttttcgaaatccaaagagataagcttaataggacaaggaagactctctcgttttccagcttcttctctctcatctccccatctctcagctcgtactccagaaaaaaagaaaccacttggagcttcctaacacagcctacgtacattttatgaaagcaccattctgtgaaagcaggctgcttacttggtatgttagttaggaacctctcaataacaagtaactgaaactcaaactagttgaagcaacaattaaaaggggatgacatattggcttaggaaattaggaaatccaaagacatgtctggatccaggcaatcaaacagttttaccaagccagtgtctttttccttgtatcaggtttctttttcccttttttgagtttctgataaggagccaggttagctctccttacatgttggcaaagatggtccctggatgctcctatagaaagcattctataggcttagcaacattagcagcaagagagtttctgagagttcttatgcaaggaactctctgactctctgagcctggatcacatgcccacccttgagccaattactgtgcccaggggtatgattggcagggtcttgggtcaactgccagggatggagtcaaccccacttgaaccatggcctaatggactctttaaaggaaggatagggatggataggctaaaacgataggcatccatggctggacatggtggctgacgcctgtaatcccagcactttgggaggccaaggtgggtggatcacctgaggtcgggagttgaagaccagcctgaccaacatggagaaaccctgtctctacttaaaaaaaaaaaataataataagccaggcgtggtggcgcatgcctgtaatcccagctacttgggaggttgaggcaggagaatcacttgaacctgggaggtggagattgcggtgagccgagatcaccccattgcactccagcctgggtgacaagagtgaaactccgtctcaaaaaaaaaaaaaaaaaaaaaaaaaaaaaaaaaaaaaaaaagataggcatccattacccttagttttgactattctgtgtcctagaataaatgacaacagttcagaaaggttcaccttagcccagatatctacctataggagccctttaatttagaatttcgtaggaacaaaaattttgctgacaataactgaatgttaactttggaataagaactaaatatatatagttactatcgttttcacttaagaatggtcatcttgttttgtttaaacacgacttcacatagcatacagtgggttattgaaaatagtttccagctccacttcactaagggattagagaaaactcagtctattctggcccagtttgaatttatcttcttgcatttgacacagttctctgactctctcacccatgatgttcttgtcccacctaggacccagcatagaagtgctgcatgtcactatgtcacttccctttcgcagggtctcttctcttagcctctatttgtgttttgtttgttgagatagggccctgctctgctgcctaggctggagtgcagtggcatgatcatggttcactgcagctttgaactcctgagctcaagcaattctcctgcctcagcctacaagcaaccgaagactacatgtgcaaaccaccatgcctggctaattttttaattttttgtagggacaatatctcattatgttgcctaagctggtctcagactcctgggctcaagctatctatcctcccaccttggcctcccaaagtgctgggattacaggtgtgagccaccacgtccagcttattctctccttttgagtatttcctgccatactttcagaatactaatcaatctttcagctgaatttttgcttacactttgtgccttgctaactctagtctctgtttaccttacatgatcctttatactgccaccagaattacgtttataaaaatatcaagatgatcatgtcactctcaggaataaacttctgtgcctcttcttcgttgtctatgggacgaggtctaaagcctttagctcagcaaagtgaggaggcaaagcaattccatcttggacattaacttgccatgttaacttctgcttaaccccagttccagcaattcctctaagatttttattttatttactgtttcttctgcaagagcatctacttaccataaatcctgcccttaggtaagaacaaccttgaccataaatcctgcccttaggcagatttacacagcattcttgcttttccctgggaggttaactttgattatcctacacattcctttccttttgaaatgggagtgttccctgtccccccccacaggacatgcgacaagggtgtggctcgtctgtttggtcaccaccactgctgaaaccacctgcgggaaggggagcacgtggatggacacgtgcaggagctgggacaagcgctgtgggttccagccccactctccaagtagtgtctaggagtggggtgtctgcaactcccaaagcccaagtgggcatgttacagtgcactctttcagctttgctgtccgcagatggcttaagtgttaaaccagctcagtggaccctctgccttttcccaagggtagtgggccagtgtgatagctttctgtatcccaagctcttgtcttgcgccccagaagaatcaggtcatacatgggcttgaaggatgaatgcaggggttttattgagtggtggaagtggctctcagtgggatggatggagagctggaatggggatggaatgggaagatgatcttcctctggagtttggctgtccagtggccagactcctctccaactgcccctagcagaactcctctcagccttcagatactccttctattctctttctctgccatgctgttgtgccatgctctgcttgtcttctcatctgctctggagcctggggttcgtggtttgtatgggtgcaaaataggggatgtggtgggcccaaaggcaattttttgggtgcaaaaacaggaatacctgtccttatttagggccatgggtattcagacttgagggtgggaccattgccggggaaccatcctcttctaccgagtatttccctgtcttctgttcatatcactttcctatggtatataagcactgggttgggggttaatggcccagggatcctccatcttgtcccactgccatcctagacacagacatggcttttgttcataaatctctattaaatgtttctttctttctaaggaaccggatatgtcagcctctttctttggactctcagcttccttagacttttgggggtaggtttgcctaggcctgcctactgcagaacacaaagctttccataactggtctcaactgaccattctcatttttccccaccattctccctcacatagcctagactgctgtcagcctgaccttgggccctccagccccatgtgtgatggtcagcctttgtgcattctcttcactgatggaaagcctcttcctctggtggttttctcttcatctttcaatccccagtccaggcaccttctctatgaaggctgcctggactctgccaaactagttgttgctccatcctctgtgctcccacaactggatgttgatatctctgtattagaacctatagtcttatttttatcctaacatgtctgtctgccccacaagactgtgaacttttacagggatggagtggactttactcatttttttatccctagcacttcacgtgttatggtatctggctcatggtgtgtgtccagtgtttcctgaatggaggactctattaatcaggaatacatttgactgtgaatagcaaataaacattcttagtggcttaagccagagtttctcaacctctgtgttattgacattttggaccagataattctttgttgcgagctgtcctgtgccttataagatgtttagtagcttctttctagattctacatactagattccaacacctccaccctcagcagttgtgacagtcaaaagtatctctagatgttgtcaaatgtctcctgagggggaggcggggaattacccaagatgagaaccactggtgaataggtttgtttatttcttctcacataaaaaagaagttgagaggtaagctgtttctagcattagttcagctgttcagcgatgtcatcagagacctggacaccttctgaccttctttcatcccttttggccggctttagtgtgtgggttggcttatagtgtcacagtcacaagatggctattgccccttcaactatcatgtctgcatttaaggcaggaaaaaaggagcaggatgaatggctaaggcagccacgtctctactattttttatcaggaaagaaaaaattttttcagaagccattttacatatacctcattgacctgacctgggtcccgtgaccattcctagcttcagggagaggcttagaaagtggagaacaggactggggcacattgtcacccagtaaaaaactggtgttcatttagccagggagaagtgagtgtggaaatgggggaggcggttagtcatgtttctctcagagaagaaatctaatatttattaattgaatgcgggagtgatttaaagaatacgggatgaatgaatattaagtaaatatttcgagttccttacaatccattcatttcttactccttgctacctcatttaagagtcagaaagtgcagacgtgcctgactagaagcaggtgagatcctgggaattttctaattccgtggccatggagaaggtgtgtggggtgttattgtacacacacacacacacacacacacacacacacacacacaggtttttttgtgtttttttttttttgagatggagtctcactctgtcacccaggctggagtacagtaatgcgatctcagctcactacaacctccgcctcccaggttcaagtgattctcctgcctcagcctccgtaagtagctgggactacagccaagcgccactacacccagctaattttttgtatttttagtagagatggggtttcaccatgttggccaggctgatctcgaactcctgacctcaggtgatctcggaggtcttggcctcccaaaatgttgagattacagatgtaagccaccatgcctggcccatatataggttttacatacacacacacacacacacacacacacacacacacactaaacctatatatatataataggtgttattatatatgtatatatattttaaaaacctatatacaaatatatattatggctgagcatggtggctcattcctgtaatcccaacactttgggaggccgaggcgggtggatcacctgaagtcaggagttcaagactagcctggccaacatggtaaaaccctgtctctactaaaactacgaaaattagctgggcatggtggcacatgcctgtaatctcagctactcgggaggctgaggcaggagaattgcttgaacccgggaagcggaggttgcagtgagccaagatcatgccactgcactccagcctgggcaacagagtgagactctgtctcaaaaaaataaaaaataaataaaaaattaaaatataaatattatatgtatgtgtgtatgtatataaaacctatatatttatatataaaaataatatatagaatataattatattatatatctattatatagatgtgtgtatatgtatttaaaatatataaaatatagattttatatatatacacacacatatattttaaaaacctatatataaatatatgttttatatatatacatctatataatagaggtgtattttatatatattttatataaatgtatgttttatatatacatacatctatataataaaggtgtattttatatctattatatataaatatataggttttatatatacatatatataacagatgttacatatacactacatatataaacatataggtattatatatacacatatataacacctattatatataggtttaatatatatacccacatatgtgtatatgttgtaactgaatgttaactttgtaataagaactaaatatattagtatacatatacacatatataggtttaatatatacgtatatatgcatatataggtgtatatgtgtgtatatatatgcacacatatttataggtttaacatattttataggtttaatatgtgtgtatatatattaaacctataaaaccatatatgtgtatatatgtatatgtatatatattaaacctatatatatgtgtgtatgtatatatattaaacctatatatatgtgtgtgtgtgtatatatatatatatataaaataacaccacacacatatatttgtttatttatagacagagaggttttcagcatggttcctggctcataactcccataacccttattacagtcttttgtttataatgtttggtgtgtcaggcctcaggaaacagaatccttctgccctcctttcacgggccccaaggcaagactttaatcttcccctttctgattgtgggtcataagaccctccccagagagggtcccatcatatatcacagggggaggaatgctgaagtcatgaagcttcagtgataacccaagaggtttggattctggatagttgaacacatggaggttcctggagggtggcacacccaagcaaggcatggaagctctgcaccctttccccggtaacttgccctactcatctcttcatctgtatcctttgcagtatcctttataatgaactggtaaaagtaagtgtttccctgagttctaagagctgctccagcaaattaattgaactcaaagagggtgtcatgggaaccccaacttgaagctggtcagtgagaagtttcaaaggcccagacttgtgactggcattgcggggtggggagtggttagtcttggggactgagccctcaaccagtgggatctgacactatctccaggtggacaatgtccaaattgatttgaaggatgcccagttggtatctgctgcagaattaactgcttgcttgtggtggggaaaaactcacacacatttggtcatagaagtcttagtgttgatgattgttgtagtggtgtgagagcaaaggaaaaacatcatttgagagtttttcccacaacagtgtgtttgcagttttaagcctacaacacatcctttaactctcgcaaagtgaactgaatatcatcagttaacattgtgaaaagttcacctatgaggacatggtccaccatattcccttattaagccctaaggttagtgcctactcacaggatagcgtttagagaaatcagcagcacagaagaacccagacatctcgagaaaggctgaatgtcaaacttcaattttcaatgagtaaaagcttctgcttttttctctgggtagacaacagtgaataaggaataagaaaacacaaatcctccaggacatcattagacttcttttcttttcacctgtagctacatagatgagagtctgatataaacagatcttaatgtgtcatccaggtaagctagtacatctgcagcaaagtgaacagcatcctcaataccctggaaattgctgggtgcagtggctcgcgcctgtaaccccaggaggccaaggtgggtggatcacttgagcccagtcattcgagacctgccttggcaacttggcaaaaccctaaaatacaaaaatgagcagagtgtggtctggcacatgcctgtggtcctagctacttggtagctgaggtgagaggatcgcttgagcctcagaggtcaaggctgcagtgagctgtgattgtgccactgcactccagcctgggtgacagagtgagatgtttcaaaaaaaaatttaaaaatttttaaaaagtaaagaagaatattccatgaaaattaacttacatggtgtaaggaacctgttaagacataattagggaggatgacagcttcaacattgtgagtaaaatatatttcatgcttgtatgaagtctccacatctaccttctaggggcaggagtggcatggtggcttctctgggagggtctttaacattgctctccttgcatactatcgtttccatcagcttttctttgtttagttgagagggtgagttgctacctgcttcccaactgtgtgtgttggtgccttttaggtagtttatgtattagagtattagggaggtgaaactttgaatgacttcttttctctcttaatccttacattacgaatgttataaccttggtgatatggtttggctgtgtcctcacccaagtctcatcttgaattcccatgtgttgtgggaggaatgcaatgggaggtaattgaatcatgggggcacatctttcccttgttgttgtagtgatagtgaataagtctcaggagatctgatggttttaaaaaggggagttttcctgcacaagttctctctcttttttttttttttgagacagggtctcactctgtcacccaggctggagtgcagcggagcaatctctgctcactgcaacctctccctccagattcaagtgattctcctgcctcagcctctcgagtagctgggattacaggtgcgcaccaccatgcctaactaatttttgtgtttttagtagagacggggtttcaccatgttggccaggctggtcttgaactcctgacttcaggtgatctgcctgccttggcctcccagagtgctgggattacaggcatgagccacagtgcccggcccaagctctctctttgcctgccgccatccacgtaaaatgtgacttgctcctccttgccttctgccatgattctgaggcctccccagccatgtggaactgtaagttcaattaaacctctttcttttgtaaattgcccagtctcaggtatgtctttatcagcaatgtgaaaacaaactaatacacttggttagtgcagtaaacaaaaaactttcttaaaatgccttttacaatatcactgaaagactctaagagatggcttgatccaactttctcatttacagatctgtatttacagatcttatttacagagtctgaggcaatagaggtaaaatcacttccccaaggtatctctaggaataggcaatatcagtctttccagaatattataggctaaagagaacttctgtgaccacctctacttattcttatggggcaggatgggttcaaattggcattgtgggctgaggaccctttcttagttgcctaaggcaattgggacaaaatcccaaaactaattgttttaagccctgcctttttcatggagcccatgctgctggcagcagcttttcacatagtcaattagaaaaatcatttctgtagttgatagctctgtagatttagccaggaatctgtagtggtggtttgaaaaagtggatgcaagaattaatattcatttcactgttctccaaaacactgaatggtggcagaataataagcccaggctatcttttctgattttccaaatgttctgtgttataagcaacctcatgaattagttcagttgtaggaaagaagaaataataaaggaaaacaagagaaaagacattatgaaggcattaaataatatctggacatttggatttgcttgcccagcttactctggaaatcagtggctgaattaaaactccttgcttggggattctttttttttttttttttttttttttttttgagacggagtctagctctgtcgcccaggctggagtgcagtggcgcgatctcggctcactgcaagctccgcctcccgggttcacgccattctcctgcctcagcctcccgaatagctgggactacaggcgcccgctaccacgcccggctaattttttgtatttttagtagagacggggtttcaccgtgttagccaggatggtctcgatctcctgacctcgtgatccgcctgcctcggcctcccaaggattctttaaaacaaatatcagtggggctaacttatgttagataataacaatgaagcagcaaaaagaaaaagcaatgaagaaaataacaaaatggagaaaaagaggaaagagaatgtgaggaaacctcctggcatggggatggcaaatacatgggtatgagcacagcttcactcttcaaccctagctgcagacctggctcttcagtcaaggcatgttttcttcacagcctcgatgtggccttggaatccctcccaacatggtgctctaggagaacactacccagtccatcagctgagcagttgtcctcttagccgtgactggtacagcatgctctagttacttacagtaaatatctgcctacccctgagcacgatggtttagggatgacttacagaaaagattgctaactatgtttcttcacatgtttgggtaggagaagagaaaaatagatttttcttaaagggaagaagagagagatggacatttattgagaacctactgatggtgggcttcatgctagggttttacgtatatcatctcacttaacactggtagtagtcccccagatagatggtatttattctggttttacaaatgaggaaactagctcaaagttacacagagagtatgtggatgatggagtcaggatgtgaaatgcccatcctcaaaataaataaattgaggtggttgaacacatctgaatattcattgtgaaatcaatctgtagagttcaatcagaaaaaaatgcattaataaattttctaattgtaaataatcagtttaaacttaagcttttattacaaattaatttgagtaaatccagcctcaatttccaattcccagtgtcattgtgatttttcctctttaggggcctctcatttaaagtttatgaggaggcagcagtagcagtatcagaaacatttattaagcacctgttgtatgctaagtgctatctatagtgagtaatactgcattagaaggaatctataatttcaggactttttctttctaatagcacagattagtgcaatttcttaacccaaggcccaaatttaggagtctaaggatataatgaatatatggcttttttttaggcagcagatggtggccagctgttctgtctctttactcaaggccaaacatgaagggaaaaaattaaagtaacagggattatggtaaatataagatagaacttaatctaaatctgaatttttatacacacaaaggggaatgggcaattgggggtaattatcagattatccaagccaaaatagttctgctacctccattatctacataagagaaaattatttatatggattgaattgttcagataattgtctagtattttgggtttctgagtagacagtctgggtggtcattgatatacattgagggtccttcaaggaatattttaaaatgggaaaagcgtttatttctttgccatatgactgggggcgtttctacttagatgcaagtaatattgatcaaatttgtatagtcacgattctttgaccaggatttgggcccattacaataaaaccataacaatttttacccaatgtttgaagtcaatttttaattgtaaaaataatgtatgaacaccctttcctctaaaatttttaagtatcacatataaagctaaaatttcttttccatatccctaattccatttcccagcatctgcccaatgatgccccctctctaaagtagctttagtagttttatcctttcagaacacacacacacacacacacacacacacacacacagagagagagagagagagagagagcgagtgagttagaggaagaggaatttggactttagcttgtgaaccacactttttataccatttgccaactgcttttctacttatacatgttagagataaaaccatgttgttccatagctctaacaaaattcctttcaaccccctcattgacattcatgatatttatttagccgttcctctactggtggatactaagattatttccagttgtttgctagcagtgctcaataaacaatcctaaatattaaacatgtgtgaggatttctttaggggagattctgagcagttgaccttttccaagagaaaatgatgtgctccagagactccgtaagtcatttgggcctaacaaagagaaaagatgatggagatacttgggagccagtttctttgcttatataaactctgtcactggaaacaagtcacttaatttccctgggattctatttctgtaaatcactgattctccaaccttctcacacaacagaagctcctggaaggctagctaaaatgcagattggtgggcctcatccccagagtttctgattcagtgagaaagaaagagggagagagagagagagagaagagagaatttgcatttctaataagtttccaggtcatgctgcagctgctgatgaggacactacactgacagccactgttctaggtgtatgttggggagactatcctgtggaagagatcatagttgaggttttaaagcccctaatagattatctagggatattttaggaggcttccaacttattatccaaacataagacaataactcaagatttatcacagtaacagtatcagatcaatgataaacatctattttaaaaatcacagaatccattcttttttttttttttttttttttgagatgtagtttcgctcttgttgcccaggctggagtgcaatggcgcaatcttggctcaccacaacctccacctcccaggttcaagcaattctcttgcctcagcctcccaagtagctgggattacaggcatacaccaccacgcctgactaattttgtatttttagtagagacggggtttctccatgttgaggctggtctcgaactcctgacctcaggtgatccgcccgcctcggcctcccagagtgctgggattacaggcgtgagccaccgtgcctggcttagaatccattctttttaaccaagagagaagtcaacctagaatctttgttagaaggaatcttgaagggtcatccagtccaactacctggctaggctttcatcagtagcattcttgacctcatcaactagcgtcccattgaatagattcagtgtttatgaattcactccccagctcctgaagtagcccattccctgtgtcgagatgtctgatcaccatcatgtccttcataaccctgaccataggaaaccatccttcagaagcttctaagcatctaccccggttctaccctcaaggctttactgaacaaatcatttcccttctccacttgatggcagtcaattatcatgttcccctaagtcaatggttctcaaactttagtactcaatatcactgtaggagtttattaaaatatagactcccaaggtccagccccagagattctgattctatgtctggagtgtggcccaggaatccacatctttcattgtatctccaggtgattctgatgcaggtggtctgcacatgactgtttcagagaccctgctaagtctttttgtttttaagctccacgttcccagcctcttcatcagtttctcatacgacatggcttgagtttcatcactatcttggttgcttaaggctgcctgccaaaatatacccctaaagtatactcattgaccttcccacactgattttttattcttatccttatccaaaatgatgtccttcatatttctgtttatgtttgtcttccctactagaatataaagcttcatgagggcagggaaattgtgtgctttgcttactcgtgtcattcagcacttctgcccatgcctgatacatcagtagatcctacgtcaagttttatttaatggagatgaaaaaccaatttgatttacaaagtggtgaatggtgacaacatggttataccaaagccctaaaactctacagagtgaatgatccattctaaaagaaggaatttgtttaaagtctttataaataaaaaaatgtttcagtctgtgtaattagccttgagataaattttcacattgacttagggctgtgcagatctccaagccgggtgcagatgttttatatgcctttgagtgcaaaactcaattggagggatgaatcaaagcagagctcattcattctaggttaggatttcaaagccatctttaaaacatacaaatccttccccagtgtaaaaatgcaggagcagaatgaccaaaatgagaggtgcaaataaaaaatgtaggccatctcccacgctaatacaatttttatctaaaatggtgattcttctttctcctctcccttccatgagtaagagtaaccaaggggaaaaaaatagagaaataaaattcattgttcattgtgagagaacatcattgaaaacaaaaggaaaaatccagcctctttaatcaaggaaattcaaattaaaaccacaattcaacaccatgttatgcctattttggcagtaaccaataagtctgttaattccatagagtgtcatagttagagagcaatgggactctcatattctagtggtaaggatgtaaattagtgtaatctctttgggaaatagtttgactttcttgataaagtccaacatgaacatattccacgaatattttccacttcaaagattataagtagaaaagtagcagtggttttatttatttatttatttattttattcatttattttttttagcctactaggtaggccttttaggattgcttggtagcattgggtctacccaggtatgaagactgcctacctcaaaagttgcccatttgtgtgtgtgcctttgtgtcaaacctggatctatagcgtagatttttgtacttctttctttcccttgttaaaaaaaaatgttcagaagaagataaaatcatgactggcatacagaaataaagatgaatgtgttaaaaagaatttattttattcatacgttatgagggaactaggcagatgttataatcagttcaaaggaagagtcaaagtagcatagcttatatgaaataaaagaatgttgggatgaattgcaaatggaaataaaactggttttctgcagtgggtaggaagtcaattagaatcattatcaggctggacagaatttacatatctatttatcagttggaatttagaaagagttgcaaaatggctcaaaggggataacaggactctaataatctgataactcaggaagttattttaaagacaatgtatatagctttctactgaaacagaagcaccttcctgatacactaatccaaatagaatattctttggatccctcacacgtatgtcaaggagagccagactgctggtactcagatagaagaaatcaacactttaagtcaaaagcctgatattccagatacctgtaaacactcatgagttccaatgaggtgaaaggtgctggagcatcagaagtgcctgccagagtgtcaaagataccaggtgcacacaggaagagctaggaaggtttgataagtgtaaagaagcctgaattagaagacctggtaagcctcagatcttctacttactaaatttctcaccttgggccaattgccttctctctggctttctcctctgtacaaagaaagagttttttatcaatgattttaagttccccctcaggatctaatgtttactaaaggagccagccagtcccttgcagagacagccctgtgggaatgcccaggcatagagttttgacgcagggcagggaagatctgtttgtgaatgtgaggaggaacaatgggattggggtgtcctagatccccagtgtgcggtgcagaagcccccaaatctgtggggaacttgggtagtcagtgaacaaagagaagagaaatgatagggaaggaagtcactaaaaacaaccttctaccatttatggttttgcacagaacttatctctacctttagcaatattgtaagtttatcaccaaggttggctctgtctccacagtttacctacatgagagcaatcagggttctccagagaaacaaaaccagtaggggtgtgtgtgtgtgtgtgtgtgtgtgtgtgtgtgtctgggtaagtgtgggtaagtgtgggtaagtgtgtgtggtgtgtagactcagtacagtctagagacagaatccctttcttcctcgtcacgggacttcaatcttttaaggccttcaactaattttatgaggtccacccacattatagagggtaatctgctttacttaaataataacaatattatttcttctgacctataaacatgatatctctctccatttatttaggtcttctttaactttttttagccaatgttttgtagttttcaatgtacaggttttatacattgtcagatttatccctatttattttacattaaaatgctattacaaattatattttttcattttcagtttcttttctttcttttttttttttttgagatggagtcttgcactgttgcccaggctggagtgcagtggcgtgatcttggctcactgcaacctccgcctcccgggttcaagccattctcctgcctcagcctcccgagtagctgggactacaagcatctgctaccacgcccggctaattttttgtacttttagtagagatggggtttcaccatgttagccaggatggtctcgatttcctgacctcgtgatccgccctcctcggcctcccaaagtgctgggattacaggcgtgagccaccgcacccggcctcattttcagtttctaattgtttgttgctaatatatagaagtacaatgatttttgtatattgatctttatcctaaagccttgctaaattcacttactagttatggtagctttttcgtagattacactggattttctattcaaataattgtgtcatcttcaaattaagacaattctacttacgcccttcaaacatggatgttatttttttttttgtcttattgtgctggataggacgtctggtacaatgttgaataggagtgatgagagtggacatcttgatttgttcctaatcttaggaggatagcattcagcttttcaccattaaatatggtgttagctttaagtttttcatagatattttttaaaagtcaagattcagaaagttgtctcctagtttgaggttgttgaattaattttttaaatttttaataagaattagatgttggattttgtcaaatgcttttttttcatttattaggatcatatgcttttctctttagcttattggtatggcataaagtcattcacaatatttccctgattattctttaaatatttgtagaaactataggatatcaccaatctcatacctaatattggtaatttgtttcttcttttcctttctttttttctgatctgtatggatagaggcttaccaattttattaactttatcagaaaaccagcttttggtttcatcagttgctttcctattttctatttcattgacttctactttgatctttattatttcctttattctgcttactctgggtttaatttgctcttctttttctatttcttatggtggaggtgaggtcatgtatttgagaccattctttcctgataagtttttaacactatacatttctaaatactgctttagcaatcaaatcttgatacattgtattttcatttttatttaatttaaagtactttccaattttctttttgattttttctctggcctctggtaaatttagaagtctcttcataaatatttggaaattttccagatatctttctgttgttgatttctaatttaattccaccgtggccatagaacatacttgtgtgacttgagtattttttaattaattaattaactttttttttattttaagacggagtctctgtcgacaggctggagtgcagtggcgcgatctctgctcactgcaagctccgcctcccaggttcacgccattctcctgcctcagcctcccgagtagctgggactataggtgcccgccaccatgcccggctaattttttgtatttttagtagagacggggtttcacccccttagccaggacggtctcaatctcctgacctcgtgatctgcccgccttggcctcccaaagtgctgggattacaggcatgagccactgtgcctggccatgtattttttaatttatgaagtcatgttttgtgaaacagagtagggtatatcatggtaaatgtgtcatgtacacatgtcagcactttggaaggccggggtggcagatcacttgaagtcaggagttcaagaccagcctggtcaatgtggcaaaaccctgtctctactaaaaatacaaaaattaaccaggtgtggtggcgcatgcctgcaatcccagctactcaggaagctgaggcaggagaatcacttgaacctgggaggcagaggctgcagtgagctggatctcaccattgtacttcagcctgggtgacagagatgagactccgtctcaaaaaaaaaaaaaaaagatttgtgatttgttaggtagaaccagagctgtgttaatgactaatatttcctcactatgaagtgagatccttctaagtactctattgtcctatgaattatgaagtcaactggtcgggctggcataagcagctggtattgccagccctttgtaagcactgggcactgttccttctaatcctctcagatggttctttccagtcttggatagtttcctcgtatgaatatgccagttagtactctgctgaatgcttgaggatatcctccacagatctccagggttctctttatctttagctctctcctagttttctgtcctataaattctagctgcctaggtggtagctctcgacatgtggtagtagagtctgaagcctgatcagttaagttcagttccgttttgcccacgttgtgttgaaagaggtcagatactagttctttacatgaacgaaagtaacctaagaaataatctgacaactgatcaggaacacacaaagattccaaaatttctaaacacttcttttcctccataattaagttgtctttcagaaatacagagctcatgttgagtaaagtccagggccacattccctctttactccttctccatggtgccctcagtctctcctacctgtcttctctttaaggtcctgcttcctctgggggaaagcctggaagttatggagacctgatagactttgtttctggctgtatcctggaaaagcaatgtttggtcgttacagtttctcagacttatgtccttcgcaatcttctgagtagaaccagagcaaagaccacaaaccttgtttttgctgacatgggccaggtctcataggacaactgtggtgcatttaacaaagtctctgtttctctactctgtcttaccaaagatttttcttcatttgcactaaagaacataagaaaggagaatgaagggaagtgaaagctcccttccgccctcaaaggtaatactgttcaagttaaatcagttaaatcggccaagaaattaaccaccgttgttttgatgagggatgtgcctacattccaaacaatagcattttgttgggacctctctataaagagcataataacgtgtaacatggaaaacctattatatctaaacaagcaaaagctaaagaactaaaagagatcaattcttcccaaatctccaattttttttcaggtaggaaaattttatttttgtgtaggcaagtttatcagtcttttcctttctggcaagaagtagcatttaactttactctttcttgttttttttccccttgcatcaaaaattaaacttcattagctggagtcttgtcagttgtttaaaaatattaatgacctggacatcagtgaccttggataataattttagcctctgtcatttaatctgtcatcttggataagtcatcttatatcattaagagtggtttttgttatcattactagatagaagacttgatgagcttgagagatcttttgtggtggctttaacatacgtctacaaattatttgatattcctcccttcattcctctcctattgaatgtgatctggacttagtgactcacttctaaggaatcgaagaatatagaagaaatgagcgtatgtcatttctaagcctaggtcataaaacacattgcaaattcttctctttctctccctctctgcccccaaccccaaccccaaccccaagacgctttgttctgagggaagccatcttctatataatgaagggactcaggcagtcccctggagaggcccacgtggcaaggagctgaggcctcctgccaacagccagtgaggaatagaatcttgccaccaacagccatgtgagtgagtcatcttggaaatggatcctccagtgccagtcaggctttaagatgactgcagccatggctgacatcttgactgtaatctcatgagagaccctgggccagaaataagctgctcctgaattcctgaccctcagaaactgtgtaatgataaatatctgtttttaaggcattaaattttgaagtaatttgttatacagcaatataaaacaaacatatcctggaatcttacagatccttccagtttatgattccataatttaaatgcaggaggatgtatctctagttgcctgttgcttttgctaacaaactgctttgcctgttacatttaaaaactcttccttgaaacagcctgcattccatgcaacaaaacattttagacagaaaatgaaatgacattttttgaatagagatatttttcaactggatatacactattgtgatagcttatatgttttaataaaatgaagccttgggaaatttatgtcttcataaaattctgcagtgttctttggtcctcgagggccatcagaagttatgtggggccagatgcgttggctcatgcctgtaatctcagcactttgggaggctgaggcgggcagatcacttgaggtcaggaattcaagatatgcctggccaatgtggtgaaaccccgtctccactaaaaatacaaaggttagccaggtatggtggtacatgcctgtaatcccagctactcaggaggctgaggcacgagaattacttgaacctgggaggcagaggttgcagagaccccagatcacaccgctgtactccagcctgggcaacagagttaaactgcgtctcaaaaaaaaaaaaaaaaaaaaagaagaagaaaaaaaagaaaaaagaaaaagaagttacgtggatttcttgacattgtatgcaatgtgttgtgttaagagcattttccaagatagaatttgtatagcttttaccagactttcacagagccttgagccccatgtccttctccctacccaagataatagttaagaaccacttatctggttcctattcccacctgtggaaagttaggtacagagaggtgagtgactcacccacagttagagacagagatcttctgactctgaactcagtgctcagactccaatatataaaatcaattctacttagaagaggcagctcagggaagtctggtttttgcaatgccctaaagtgtgcagattctcaagacagacttttacatttattattttgctgttgcatatcttttgcttaactcatcatgctgcttcaggaaaggggtaaaatggatctttccagaaaactctcccttcctgatggacctcttggcttggttcctttcagcttagcctttacattgaagtacacaggagctcaaagtgatttatcaccatggtgcctgctagaatccaaaattattccgtgaaggaaacatattatgcttttcttacttgattactatagatatgtcacttacatgtttcttcactatattttgaaaactgcctgtttacatatagtactgttacccatgtctttctgaactaagctagatatgaatattattatcataataaattaagatgttttggttgatggactgaaaatcaaagttaagttctaatattaatgatcagaatacattctgcctatttagaaactaacagttgctaaaaaaaaaaacacccacagatgtccgaaaaataagtataaatctttgattggtgaactggaacatatcttacactcctcttatatctttcaaggtgctggtcattcatcagattctttaaatacttcatcaccagtaacactgagcattcaccataagcaagcctgggctacttaaagccggtggaacccatgttgtaaatggctggtcctaaaagtataggaaatcctgattttaccattgacttttctcaccgcaatagatttgccagccattcccaccatccctatgtgctccatgacacaatctttttgctgtggccaaagccaagtcagagaaatcataaccaaaactacagtcctggagaacctggggctgaagaatctgtgctgatgccatgaactgtccagagaaaggtctaagcttgactcctggctttccctcctcccacttagctccggaagatatctgctatgagcaggttcctgggttctgccaaatgatctagcatcatctggtcttggctactgttcaggttcagagagcactgcccctcctccccaaaggtggaaacagagattcagagccttggaaacagccccagggtttctgaatgcaaatgtttccagcaaattcagcattatatcctaacttgcaaaataattctgtagcaggaagataaagttgaatgagtcaagtactaattaggtacacttattcttccataaacaggaagatatggatatatttggcaggggggagggatatctttcacattttaaaaagtaaaaacagctctatatttaaaagtaatttcaaaatatcagattagtctcgtttgaggaatggcaggaaaatcctttgacaaagaaattaagtttatttcaaagttttcaaggggttgaactaaattatagatggcagcaaagagcagagaaaaaaatgccttgcaagttttctaaagaaaaactaaggtgagattttctaaaaggataatatattcaaaaagttatatataatatatatgtataatataatatatataatacatatttttatatatatgtatattttttaattttgagacaagatctccttgtgtcacccaggctagagtgcagtggtgtgatcatggctcactgcagccccaaactctgggctcaagcctcccaggtagctgggactacaggcacatgtcaccatgcctggctaattttttaaattttttgcagcgactggatttggccatgttgtccaggctggtctcgaactcttgggcttaagtgatcctcccactttggcctctcaaagtactgggattataggaatgagccactatgcctggtgcctcaacaagttatatttttaaaaacagggagaataaaggagaagaaaggaaaggggaggaaaaaacccttttggtaacgatggagttcaggacacaccacccccaaatatggcactgtagcatttgagaaaatagcagaggtaggaaggtcactctcacgttctcctgcccttctgccctgaagcaggtcataagacccacacgtgaaaggtactcttcctatacccagagaaaaggaacatttgtatctctgaagacacagggacacagagaagaatctgaacaaacaggtcttgctaaatttcctcagttaattaccattagggtaataaactattttttcgattctgtttctccacaattatccacttcttcatcaaagttggcatagaaatacacaagtctaggccaggggcggtggctcacgcctgtaatcccagcactttgggaggtcaaggcgggtggatcacgaggtcaggagatcgagaccttcctggctaacatggtgaaactctgtctgtactaaaaatacaaaaaattagccgggcacagtggcgggcgcctgtagtcccagctactcaggacgctgagaggcaggagaatggcgcaaacccgggaggcagagcttgcagtgagctgagatcgcgccactgcactccagcctgggcaacagagcgagactcagtctcaaaaaaaaaagaaatacacaagtctaattgtttcttcaggttttcatttcctcatgaaggctcctgtgtcacttaaaacttacgttaaatgaattggtacgcatttctcttgtttatctgtctcttgttctaggggcctcagctgtgaacttggatgggtgaggaaaagatatttttcctggctgggcaaggtggctcacgcttgtaatcccagctactcgggaggctgaggcaggagaatcgcttgaacccatgaggcagaggttgcagtgagccgagatggcgccactggactctagcctgggcaacaagagtgaaattctgcctcagaaaaaaaaaaaaaaaaaaaaaaaagatgcttttccttcactacagtgttcttctctgaaactctttaatctgaaagtttagaagttcactaaaatgaagtaatttaagaaaacaaatgtggttttcgtgattatatcaagaaaatacacctcctctatacgctgagtaagatgaatagctcagcagaatcagtagtgttaggctgtgatcacttctgctatctacaaattgctttagacgggactttgcaaagcagagtcaaaatatatacaatggaatttattttttatagtagtaatactaatatttaggagtattactttcactaggagagttgtctaaatttcagctttctaaaaagattattttgattttgaatgcactagacaccaagtatgcactgaatatgaattacaaagcaacattaaaagggaagtaaatacacattgcagaacatatgaaagtagggaagagccaagttcataagtataaattttgtatcttttactacctactatgctattattggtgctcgacaaatatttactattaaaaaacaaggtgtgtcaatggtcccgagtaattctactatgctgagtcaaatggtgactgaaaaggcttcacttaattcttttattttgcaggtattattacttggcattcacagcacatcaaacacctcttgctagcaaagagagctgtgtggctatcttggaaaagtccagattagatcactgggtactgggaaaaacaaaggtagttcgttctttattgttcaaattgtcccgtatgatttctttgtctcttgtcagtgatgtcactggcatgaatggctctgtaagttgtgtagcttagcaaacaagactccaacgtaacaatggtctttgctggtattaagtcaagaggttggggacgttagggagtagaggaggagggtttgcctcctgttctgtatgtaatttgagagctatttagcatttttagaatgagatctttgagctcatttaaaaacgtttcttttctcaatgctgcttattccagtaccacatgtaaatacacaaatcatattaacggcagtgatgagtttctagtagagttttgtccattttttcactggactcatgttatttgctgcatagcctgattattagtctcagcatctgtagcttttcatttgggagaacgtcacgtccccataggatcccaggtttttatggtccatcctgattgccttataaaaccagcctctgcctgagtgacgatggcaacactgctcctcctcagcagaaattagatcactgtggatcatctaggtacctcaccctctgaacttccactgttggctgggtcagtcctcttggttagcacctttatcagaggctatggggaaagagagtagatagagctcaaactgagaaaatgaactcctgactgacatgagacaggcctggagagcatttggaatcgcttaaaccctgttgacctcatcatctatttacatcaattatcaaggattggctcaatcttagaaggagaattgtatttacctccatgaagtcagtaatgtgagcataagtcacatcgctataaactttatttatatcattgttttaatattttcatttagaatatgctgtagtagagtgaatttctgttgaggaacccatatgtaatgctaaaactactgtctcgtttcaggtttttctcaaatattaccatgttgagcaattaaatttgctgcttcgagaagtcataggcagagtggttgtgctgcaggcatataccaaggggtggcttggagccaggagatacaaaagggtcagagagaagagagagaagggagccattgccatccagtcaggtaaatggtcctgttctcataaatactgccctgggtattggcatgtcattaagtactggggaatactcaactgtttctcttctaagtggtttccctccctcccttccttctcccctccctccctcccttccttccttccttctttccttccttccttccttctttccttccttcctttagcaaatgtgtatcaaatgtgtatcaagtgcctactacacaggttctgtgccaggtgctgaaatcacagccatgagcaagactgtgtaggggtgaaagaaactttctttccgtgtcctgaagatttgataatttgagtctataaaacaaactgagaaagacaggttaacaggagaaaagacatacaaatttattaacatgcaagtcataaaaagtgtgaaactcaaaggccagatggttgaagcttaaataccctcttcataggggagagggaagtggaggatgtagatagttttaagggaagattcaaaggtttacgagggaaatgaatgggcctaaggaacaggcaatagcctgggacaaagttcatctgacctctgggtgatatttactccagtctttcttcctggggtatgcatcagtttctcctggttgaggagatatctggggaagggattcacacagttgaatatcttctggaggagtttgcctttaatagatagggagagttcagagaaagcccttccctgcatttgctgctacccaggtgctctaagtttgaagtcaaagcagcatattttggagaattattatctgagccccaacaactgccatggtccctgacttgcaggtaagcaaacaagtctttacaacatgagtgacaggatagatagtggcggtataaatggaccagtgatgtaaagccccagtcacacagatatgtgccgcatctcccagaatgactgagataatatacacttcaggtctgtggtcaggtgttcagtaccagagttactaacgccatttccagaaggcttttctagtccagatggaacttataaaccaagggaagaggttgctaatctctttcatgtgccctgcctagtcagtgcctctttgtttacgtatatgtgttattagtgttacacacaacatttaagttcctgtgcaatagacaaatgattatgaaagcaccagatcttgaacaaagtggatgatttcccttatgctctcataacccagaatcctcatgtggctcagtctattttggacttcatgagctcacccagcaacttcgagagttgtgatgctgagacgggaggaacaaagacattatgctcctcgtgggtggcttaatgccccagttttgtatctaaagggcttaccacctttgccccagagagtcccttcctcttttctctctttttcttcacctttcttccctgccttttcccttcccactgcacatctttcctctccctcagcatacctctcggcacagaattcactcacagcaaatgacagtgttgtgctacttatcatttcccttaactccgctctttctcttcttcaactttcctgtttatatttttctcccaaataacagattttgaaagggtcaggctattccagttcctttctaccatccctgccaaacccttccacctgtatcatatccccgagtcttgaagacagggctttctccagggattagaatgacaggaaaccatctcacctggagtaggggtcccatgtgattcatcagtggaacccagagtgttctggaaatcactgcctgaacaaaagcaacccctcagaagcatctttaaagccaagctgtgagaacagagaggcctctcttctcgccatagatcacatacctctgcttattttgttcagtgagaaagcaggagggaggatgagacgggcaataggctggaggggaaaacagcttatatcaattctctggcacgttcttaaattaatgtcattcctagcacatggttttatatttttagcctggagaggatatgatgctcggaggaaatttaagaaaataagcaacagaaggaatgagtctgctgctcataatcaagcaggtaattaaaacatcattttcacagtgtccacttgaaaatattctgtgactaacttctgtgaatgtagaaaagctgaaaggttaataattcaggagcactggaatgagtcaagagttctgggagacaggagtcctagtgttctgaccctccttgtgtgataactatgatgctaacggtgagcatgagcatttgctgtttgccacacttggctaaggatgctctgactgggttctcttgtatacctgatattatagaggaggaaactgaggcactgagaagtgaagggacttgtccaccatcacacagttcatcagttgcagagccagcatttgaacacaggccgtttggatagagtcagcatcgcatactgccacctgaacaaaaccctttccctctcggagtcatatgtccctcgtctgttaaatgagagcgctggttaaaaaggtccagaaggtgccttcccattttggaattctctaattatatgcaagacctgtttcttagcatcacagaggaggaatcactcagggagtttcccagcaaactgtttcccaaatccaggcttatatgtggctatcatggtcctctgggccccatggcatgagcacatggtggcttttatggctcggcttgctattggcagcctgagaggtgtaagctctggtttctgactcatccgtcccctctctggctcttcagtcactctgctcttctgcaaatggcagtgtccactgtgggtgcgggtgccaggctgggctccttccctcatttgaagctgcatattcctactcgaggctctggaagaaacaggcccctgagctccaggagccacaagaaattagagacagaatgagagaaatagccaggctggtagactcagcagcagagagagtgataggatttcacatacagctgagcttgaaggaaactcttaaataaaacagctgcaacctcttgaaagaagtccctcctcggaacctggctccaagtaaacttctcagaactcttagaccactgtagaagcctgatgtcttcattcaaaacgaaaatagttgggcggaaagagtgctattaaaatgcaaatgttaacttttaacaccatctcctaggaattctaagctctacaacttcaaagccccaggaagagggatgcaattcttgttacagcttaagagagaactcaaagtgcatcatttgttccctacttgcctgcctcccaacacgcacacaatctctcattaaaacagggtaccaaactgatttctgatcttgcagtttggtacaaaggccaacatgtgttttaaaatttaaacttgcttgagcttatttattgttgatccactgagttcagtatacaggaatcataaatccaattttccctaagtgaaagtcatcttttgagtgctccctgtcttgcactctgttaatgccaagtgaatactgctgtaaaacagaaatgggtctgcttcatcatcatggatcaggatagtaataattgtatcttttcagtggagcacctatggggtagctaccatggaaggataatgttgctcagcgaaactttaaaaagcatgtttctttaagggtgtctcccttttttttttttttttttagccttgcaagcacccagcaggactttagaaaacacattaaggtgccttccttttttttagccttgcaagcacccagcaggactttagaaaacacattaaggtgccttccttttttttagccttgcaagcacccagcaggactttagaaaacacatttctttaagggtgccgtccttttttttttttagccttgcaagcacctcccctttcttagccttgcagccaaagtgttcttgcctatcaagtgatgttgggaacttccattaactgagtctgcaggggcttagatgggcatgaaggtggcaccaacaccacctctgccctcttagaagtagtgtggcagccagagcaaaggcagacagcatctgccctttagccaacaccgtggacaggaattggtgcgctggttttgtgttggtggtaaagatgcatgaatagggtagcaatctttgcaattttatgggcagtttacttttacttgggaatattttccttatctttagatttgaaggcataattgcgtttatctaagaagcaaagcaactcattccgacgtttctgtttggggttgtgatcttccccaaacataatctcattacaagcctctcttcgtcccactaggacatttcctagtagaaccagacccagatacagtggctccccgctttaggagcctgcaggaagtggcttagggatgttgtcacagcacaaccatttccggttgttttctaaggttattctctaatttattattttttcaacaaatcatttcatttgaaatttagattctgtggaatgcatttgtatttctagttctggcccatagtattttcttaagtggtgttgctaagatatgttatatatttttaaaagagcggcccttgaaatttaggaagcatttggcctacatgttgctacagggcagcacatattgaaatttgttttcctttcatctccttcccaataaaagcagccgtgcggcttatccctttagcttcctcagaacttcctttcagaattcccgatctattacggcacattcacataccagaaacaagatgccttttcatgctgtcaacctttttcatctgaaatgtaaattaattcttgctggtatgccttgacagagatcaaagtcagggtattaaccttcccaggctttctcctcataaggactgggcggccaccattaggaactctgtgtccttgttatcgggccctcctccaggcagccctcggtctaggagccaccatttcaaagcctcagagtccttggtaaatgtcctcatcattactttcaactgggtgagaaataatctgcctggctaattattgctcgtttttaattgtgggcccttcattcagattccaggagcaggtttcagtgattctgacagccagtggtcttggtgtgatcgagggagggacagggctccagattggaaacctctcccccaactcagtgggtcatttcttgcctgtcagtctttgaggtaggccacatttgcattttcaaaataaacagatgcctttcaaatacatgagctggtggtctagagatctctgcgggcccaaacagttcaccagccagtaatcaaatgctggaagagaaaacaaacggaaaaaaaataccctgggtacacaaggatacatttcctatgtgtataacactgcacagtcaataaagggcctttatgagatgtaggggggagaggggagaggggagaggaagagaaagtaaaggagcctgagcaaaggtattgtctatcagtttcttttctgcggggctgagggaggtgggaagcaactctgcatatcaccttggcaagaagtggcatgtttcattgttttttgtactggttaattctgacaatgggttcttgccacaggaaaacacattcctttaaatgccaaataattaaaatacatactttgttaaaatccgaaaaaaattgtacatattagtgttcaaatagatggtgtattctaagtaaaaactaacagtgaccttgattccattactaatctgttatatttttaaattaccttatgtttcagaaattggacctaactacatttattcaaccaaaaaaagcttacattcctcagtgaaaattatcaaaacaaactaactgcagggaactttattaaagacctacatgtaatatctcattcattaatttttctaaagctctggctttaaaactgcccctctaattcaggatatgtgttttagatgagagcaaagttgtgggcctccctctctcaaaggagaaatgccctttgaataggtgacagtggagccctaggggctggaaccttctcccaggaggagtggtcttccagcacctcactgcttctccccacacacacgcacaggagtcggaagagacgctagtttacaggacattttcatctaattgcttcagtgctgtggaaattgttattttctctttctctctgttgttggatcagcttcctacatactcccctccttggccctgccaaaaacacagatgttatcacaagataacaatagctctaacagtgacggccatttctcttctgatgctctttggggagagtgcttttcccagcatcagcagagactctgacgaggctggcagggtgccttccttgagcctgtgaacaggcattttaagccactgcagctgggaaccactgggcacatcatgtgatgcatgcagagcagagttgctttaaatgctgctaccagaagagaaagcaaacatcgtatccagacagcctgaccctactttgtaacagaaccaagtttttggtgtataaaactgcctgaacttttaaactctttcagtgcaaggttttctcctagccttttcaaaaggctgtttaaaaggctgtttcctttagcatcatcagtgggttggcaatgattaggtggttgtaatttcctagaactaaatttcccgctatttgcctacgtgtgcaggacaactatatttaaactgggatatttctttcattcacttacttaactactatttgttaagcacctactttatgctggggctcccacggtaaacaatgagatttaatttggggcttcaaattatccaactccaatacagagcactctaaaatatgctttccctcaaagggatgctgtttgaataaatcaagtactctgtattttgccaacgctctttggaatggagctctgtaaaatctaaaacaatacaaagagtacaaattattataaaacacagccaagtgtatgcattgaaatgacccatgcttcttgaaggtaaaaatgactgtagtagatatttttcatcctgctaaagctgtacataagtagattgttgatcccaagccaaacaagagggggactgtaagtaaatgcaccattgaaagaaaaggtccattttgaacaaacagaaggaaaacaagcatgccctctgtcactcttttctgtgtctctatttgtagttctacctctatttcactttttcttcactcatttcatttctatttcttagatccctggtcatttcacacaaaagctaaattcttcaaactcactgtctttatcagaggaagcacaggtgtgagagaagacaagatccaaactcttcttggccgtagggcaggaggcagctgcttctcttttcctggtgttttccgtatccacatatccacagaatagcaataaaacatctgggggaaataatttacctggtgcacctgagcttgagatgcactgtgaactgcaaactagccctccccatccgcctacccccccatcttctaaacctttgtttaacacaagacaggatgcccttcagtcctaggcgaggggtcctgctcacttcactctcatgctatcttggtttccctagctctcccatacttgagaaagtggggctttctttctttctttttctttttcttttttttgagatggagtctcactctgtcacccaggctggggtgcaatggtgcgttcttggctcactgcaatctccccttcctgagttcaagggattctcctgcctcagcctcccaagtagctaggattacagacatgcaccaccacacccagctcttttattagtagagatggggtttcaccacattggtcaggctggtctcaaactcctgacctcaagtgatccgcacgcctcagcctcccaaagtgctgggattacaggcgtgagctactgtgcctggcctggggctgatttctgacagctgcaggcttaacatatcttgtagggggaaatgtctagggggaaagcattgtggtttacttgaggaaaacataccttgtctgtgacaaggcttagagcaagtggtgtagtacagagacaggatggcctgtggtttcgaggtttctgacaagaaatgagctctgccaaatctctctttggcacaaacgatagaatttttgtcatggcatagcttggaatgcacaggaatctcctttgctatggaataaaattattgcccatgctaggattaaataagccagagggcagaatactgtttacctaatgcacagagaggaagctgcaaagtcattgtgggctggaggtccacttgtgcccaatatcataccggcatggcacaagtatgcttaagatgaaacttttgtgcaacagtaggtacccctaggactcgatattataacttcagaggacgccagggttagagcctacaatctggaatcagttttctccattatgaaccttgtttagcattccagagtctagctgcaaagaagtggtgcctgaaaaggtatctttgccacctcaacacagaatgaaacaacattattatgatcgattacacacttgagttgcctttactctatgtctttaaaacaatttcatgtagaatcataaaatatgttatcacattttataacttttattagttgtttagactgtaactacacaatagtaaagaaacgtttaggggaaagctaactgggctgtggcaagaatgatcatgctatttttcttcaaaagactcttggaaatagaaaggcaggctttgttttacctcttaacagaggaaccaggagcacagagagttaaataagttgtgtctcccttatgtgttctgcaagtttaaacactggtttcagagccctcttcagagccttcactcagtgctcttttcagtagaccatgccctgccattggtttccatcttgaatatgacacattggaaataaggtaccagtcaaagctttggaaagagttgaaatactgtcctaggcatgtggagtttagagtcaaacaatgaatgttaaatgatggctatgctgccatttgccatgtagtttggggaaaagtacttaacttctgagccttagtttcctcagctgtaaaatgggactcattaaggcctaatcctcaggactgctatgaaaatgatagcaggtaatatatgcaaagcatcctgcacagtacctggctcatggtacgtattcactaaatgaaatgttacttccctctctgtactcccttcctaaatgtcaacttcactgggggggaaaaaagtctgtgaaatactcttctatggaggacataataatgctgtaacttcaggccgggcacagtggctcaagcatataatccccgcactttgggaggccgaggcgggtggatcacttgaggtcaggagtttgagaccagcctggccaacatggcaaaatcctgtctctactaaaaacacaaaaattagctggacatggtggcgcatgcctgtaatcccaggtacttgggaggctgagcagggaggattgcatgaacccaggaggcataggttgcagtgagccaagatcgcaccactgcactccaatctgggtgacacggtgagaccctgtctcaaaaaaacaaaaacaaaatgctataacttcaaaaagatgaaacaatttctttcatttctggagaaaaatagtacctgtcaaatctcaaattagattacagtaaaatctttgtaaaaagaattttccaagtcttaacttacgtcttgtttatttgacagggaaaaaatagaatacaacaataacatgtaagagatttcaagtggttttgtttttgttttttgtgaagagctgtgctccattcatgctgaaaccttgattcatttgtgtatataaaattttcaggaagctcaaaattgttaagacttaggtgtgctcctgacatcatttgtccccctcactagtttgaggcccttttgcaacttgttctgaaagatagcaagttccattgtcaccctgcttctgtaaagccagaaattctaaaatctaggagctaaatatcaccagatttgttgccttctggtgtggaaagcaagttgcctttcagatgtctgaagagttggaagatcttggtgtacctatcatgtttaacccacagtgacgggtgatgggcagcctaacagctgaacgacagccgtttggccgggagttcaaacctcaacacgatgagccatagcaggatcacggtttgatttgctgtggccatgaagtctgaatcaccaaatacagaagcagaggcaagggtgacagctggtagccattctcgtcaataaagttgtgacagttgagatgtacaagtaactagagcctgctaatttcatagactttgagccaagtgcttagtgtcaaaaccagctatggtcagtgatgcaaatggttgtgaaaagtccctcatcagcagcaagactctccccatcagactctttcctctgatggattagaagcaaattggatcctgctttctaggaatagatccagtttgaagaaaaggaggccttattttttaaaattctagtaaattcttaaaagtctattaagtataatttacatacagtaaaattcagtttgagaacactagatcccctccataatcaagaaaaagaacaaggagacacaggtccttcctccaaggagcttgcattctaatacagaaagtaagaataaaaagagattaaagatatgaaagcacctgaaacttttaaggggggtgtgtcagtttgactagtgatatcccaaaattcatgtccattcagaacctcagaatgtgactttagttggaaacaggatttttgcagatgtagttaattaaaaatgaggtcatactggatgaaggtgggtcctgaagccaatgactggtgtccttataaacatgccatgtgaaggcacaaagaagaactccaaaaagttcccttatgcccttcttgacatccacccccctcaccctcagcccctgataaccactaatgggttttctgtcctatagtcttacctcttccagagtcttgtccttatagtcttgacactgtaaatggagtcatacagcgtgaaacttttgagtctggcttttttcacttagcataatgcttctgagattcatctgcgtgttgcgttttttagtagttcatttattttcattgctgagcagaatttcagtgtatagatgtaccacaattttattcatttaccagctgaaggacaattggattgtttccagttcttggtgattatgaataaagctgctataaacatttagagcattttccttttgttttttttttttttttgagacggagtctcactctgtcgcctaggctggagtgcagtggtgcgatctcagctcactgcaaactccgcctcccaggttcatgccattctcctgcctcagactcccaagtagctgggactacaggcgcccgccaccacgcccagctaatttttttttttttgtatttttagtagagacggggtttcaccgtgttagctaggatggtctcgatctcctgacctcgtgatccgcctgcctcggcttcccaaagtgctaggattacaggcgtgagccaccgcgcccagccttagagcattttccttttgagtaaaatgtatagtaaagtaaataactttgcttcacaggaaaccagaactgtaggagcaggaatgatcctagaggtggaagttgttttctttttgattagctgacaggtatagttattttatacttttgcatagcaatttatagtctattcaaagcactttcacacaccttacttcctgtaattatcattatagtaaccctgagaagtaggctaggaatcttgcttcattttacagatagaagctaggaaatctcatataatccagacttcctaatccttatttgctgtcgttccttctaaacattttctcaacatcctgtctgtgcagaacagtctgctagattcttttggggtacccacaaaatattttttcccatcaagacggagcagtcttacatggaatcaaactgaccactctggcccaggcttgaaaggaatacaaaactgggccacttaacacagccacaagaagcagtctatgaagctaccagaagcaggcaggacataaattttaagaaagaaatcctgaagctggtgggagtcagaaaataatggattgacggtccctagatgatcagaaggaaggggaattccccagacaatgctgtttcaggacaagcaagaaactgatttctaggataatggaaaacttccctccttggcttccaggttggggaaaacacttaccagggaagattttctttgaactcaaagtttaactgggataatgactggaattaagtactggataatcaaagtggaaaatgctttcagaggcctgaaattactagacttgttttgtgtggtagagatagaggccaggatttcttatagggctgtagaaaaaaaaaatgtgtcaatgagattctattccttaagaatccaactttcttggtgctgcttttggtggcatttgcctgtcagacctcccacaagttggcctctttatcctttatattctgataagatggctgatgaccagctgtcagtccaagccagaaaccacactggctccttgtaaaatctgccagcagcagttaggaggggaagcctgggcttttgtgcctcatccgtatgagccttctctgccagatacagtgggtgccctttgccaggcccattatgagggcaggaacgtttacccagcctagatcaccaaccaggaaacctaccaggacagtgtctctgctgaaacaatgcctgatctgtcctttgggtgggtcactaaatgccaggccaggccagagcctctttctgcagcagctaatctatgggaccattagaggcccaagcacatgaaagaatgtaacaaaggtctgatttttttactttcatttataaagggggaaaaaaaaggagaatagggattattattttgaaatgtttaaataaatgacctgcatcatgtaatatttaggagttcagactttaggaaaaaattttgtgcttgggttcaaatcctggctctgccagtctacagctgtgtgactttgggcaagtcatttaacctccccttgtctcaatttcctcagctgtaaaatgggaataaagtagtcgctctcttttagggttactatgagcattaaatgagttaatgtttgcaaagggctgagaacaatgcatggaacataataatccatatgtatgataatgtttgttaaataaaaataatggagcttttcttcccacccaatttttccccgcacaccccagccaaatcaagctgaaagtacctaccgttcagcttgatcttgtccttctctttcttctaatttcagtacttaacatctgtcatgccactccccaaccccaaaattagattcctagggctgccataacaaattaccacaaactgtgtagctgaaaacaacagaaacttattctgtcacagttctagaggctagaagtccatcaaggtgtcagcaacattggtttctactggaggttctgagggagagtctgttccaagtctctctccagtctcctgttggttcctggcaatccttggccttccttggtttgtagacccatcacttcactctcagtttccattgccatatgcgttctcactgagtctctctgtgtcttcacgtggcctgtttatgaggacaccagtcattggctttaggacccaccttcatccagtatgacctcatttttaactaactacatctgcaaaaaccctgtttccaactaaagtcacattctgaggttctgaatggacatgaattttgggatatcactagtcaaactgacacacccccttaaaagtttcaggtgctttcatatctttaatctcttcttattcttactttctgtattcgaatgtgagctccttggaggaagggcctgtgtctctttaatttactttgaggcagctagaaatgtttatttggccacttgaaaggattggagagacaagggtgacaccaagttgggtgtggaaaggtgatgcctgagatggaggagtcaaccagaaggagggagaaagacaggattttaaaaaatcacatctgaacaaataataaaggagaaaggtcagggataccaaatattctaatgtggtatatttggaagcactgctgccggaaatagaaattgccaaagccagaaggaaggtgcaagaagtgagaacaaggtgtaggtaagaggccaggaaaagaggagatggggacagggttattgcctcggggcaggaccagaaaaaatctcctccgtgaggaggggcagtcctgctgccagtgtagtttctgtctaaagtcaggagatccaatggaaagaacctgccttctccagatatctgaggtaaaagatgttggaacatcttcagccgctcgtgaccttgaggtcatggagaacggaagaagagatgtgacagctgggaaaatccctggtagagccattatgttgtggaatccaaaaggaagtaagctgactggacaatgagaagctgcaatgtgatattcctcaagtgaatatagtatgtagtccatcttctccctgacagcataataaaaatctatgatcagggctgcgagttcacaggaagggaggggcacttccaagaggcagagatgtggaggagaaaacggagcagcttcctgggagagagctcacccttctgtttacttccctggtagtggcaactgaaagacagcaggaaagctatccagtgaccaaaccaagaatcctagcctggtgcactcatgacctgtgtttgtcactgagtttccctatttgactaatgtgatcagtgacacagtttccccaaattacccaatgtcatccagctagtagagaatctggccagaacaattattaattctgctgtttcctactattgtgccctttctcaactacactgtattaaatcttaaaaataagcaccaagttcataagtgagattagtcaccttggtgccttgaaccgtaagaaaagtgtggattttcctggccaacttgtatcacccagtttggtaattcatctaggtgtgggagcataaccttgagaaagtctttttgtttcattccacaggggacacttcaaaccaaagcagtgggccacattcccccgtcgcagcaggtacgaggggaagtgccgaggttcaagactgcagcgagcctggtgaccataaaggtagagtctttcgagatttagaatgagtgttctaaattcaggggcattccggagaaggttccaaagctggaagtgatcacctcttatataagaaccttctgtccaccactccttcttttttctataggtgacagccaattaaatttaaggccaaccttgcagaggactctgaagggtgatttcatagaagggaatagaatagatggggataagctccgttcctcacagttgcccctccacctccttccatgttccctggaacactggtctagttgcagctctccttaccaatggcttcgccttaacctgtcctcttgaggcagactctgacatgtttgtatcagatttaccttaagactgaggaaagtttagtgtcttgggaagatctttctatgatccagaacctggtatatagatctcagactgattgagaacattcatggaaggaaggggtactgtggacaagaagtggaaacgtgggtttctggttctcagtcctccaccagttaatatccctaagctccagtcacggtaacatgagacaattggactaaatcatggttttcaaacatttttaaaatattgcagtctcacccttttgaattttgaaggtccctggacttctgcttgagaggctatgatttttgaagtatggtctttaatgccagcacctgcatttgatggcaagtgaagattttgtggtagaatttacagttacagtttatctgccagccccagcgccactgcccagtgtgtaggcagagagtctctgggtacctcagactcctttagtatctctcactcagtctgtttcaaggaaatactgaactggaactttaccttggggcaaggaggttagaaagtaggagaaaaagagaagtagcaggatccaggagaacatcagtgtttcttgaacttgaggagacttggggatggagacaatgagaaagttttcattttcaaaagaagggtgtctggctattactgactgagggtgcagatcactgtttccccctagaagtcacaaataggagatcctccagtataggaagtcacaaataggagatcctccaaagatgtgttatgcttggccacacacagtgctttttaaaaaactttgaacctgaatgtctttaagtggggtgtgaattctctggttcatcacaaatcccacgattccccatcctctttgcctgatacttcacacatttatatttcttcctacgtgcccccaaaggcatttgcaacacctcctaatggtgttcttggtgttttttgttgttttttttttctgacaggcagatgcttttccatcttacttcaaaatagtctgatagagatgggcgcggtggctcacgcctgtaatcccagcactttgggaggccgagatgggcagatcacgaggtcaggagatacagaccatcctggctaacacacaatgaaaccccatctctactaaaaatacaaaaaattaggcgggcatggcggcaggcacctgtagtcccagctgcttgggaggctgaggcaggagaatggtgtgaacccgtgaggcagagcttgcagtgagccgagatcgcgccactgaactacagcctgggcaacagagccagactccgtctcaaaaaaaaaaaaaaaaaatgtgaatggcttatagagctcaaccagattttggaaggatttagttcctctagaactccactccaagtattgctttacttcattaaaccagaaacacataggaaccctccctgatgaaaggtgacccatctctagcgaagcttctattgtcacacctgtacattccccaagttcggcattttatgaatatttctactatttaagttcataattttatttttcagccatgtcactggtctaatttttttttaactcaacctattcatacacttaaaatgagtcaccttctctctcttttttttccttcatatctccatttctccaatgtccttgttcagcaattcatttgccagagagaagccaggtgattccaactgtcaccagctcatactgaaaactgtttgacaatttcggatgctgccttgaattcagtggtttgataatcttatttatctctttagtttgacccaaatccttctccctgttcttcagcaaagctgggggatggaggagcagattccttctaagctttattcagaatattctgtaagtttctggttttatacttcaaataactcttaaaaatcaatattttgatgactgaagtgtaaattaataagaaacatggaataagttttcccttcaattacatgaacagaaattctatggaaaccccagcaaagtagctgggggcatttgctgaaccaggtaaagatattgcttcctctcgttctggtcttggacatggcaccttcataaggagagtcccaaaccaaaagagattttacagttttttttttctagatctctttgtgctattttcttctttggatggctattgctccttattatttttagttttttaactgaggatctcaaaataggtacagacaaaagcttgcaatcttagctttccacaagggcaatatcatttggcctttgatcagtggtagctcttggtgctgctgatttgggccagagaacaaggttaaaaattatttgtggtgatttttccttcttaacagggaaacagaaagatacttgtatccctgaagtgggttccccttttttgtttttatgtcagttcttgcttttatgttgcttatcacagcattgcaagtgagtgtgggccaaacagtgatttagaatctccaagaggggggaaaacctgcctggtgctctaactagaggattttatcaacggagaaaaggcagtgggggaagggaagggaattagttaatgaaattctaacaggtggtggctatttttctttatttctattttttccttctttcaatattgttgtttcactgtttggccataatgtttgtgtgtgtgtgtgtgtgtgtgtgtaataataaaaattgtattaatgtctcacttaaatttttctcttttggtgtttgtagcaataataacaacaacaacaaatctttctatccattaccttagctcaaagaattgcatttattccacacaagaaatatttatgctgaggaaccaaactgacaatttaaaatcagcacatgttcttcccagaacagacaacacaaaaaaaactgatttctatactttttatttatttttctacactccatttctatcatgtattctgtaatcataatgtcaaccatttatgcatcttccacagtaagtcacaattcccaaatttatagattatctttgttggttacttttcagtttggatggttctaggttatctaaaataaggatggcaaataggtgtgcagtctccttccaaccctaactgatgggtagtgactacttggaacagtggttctcagccctggccacatattaaaattgtctagggagcttttaataattgatggcagttcccatcccagatcaatatcagaatgtctaggggctggtcctaggcatgtttaaaatcttcctgggtgtttctaatgtacagccaggagtaagactcactgatctggaagcagtgtctctcaaaatttaacatggatcaaggtcacctggacagcttgataaaaacacagattgccagaccctacctgcagagtctctgattcactaagtccgaagttgggcccaagaatgttcatttctagtaagtttccaggtgatgttgatgctacttgttgggccacactttgacaaccactgatgtgaagtgttaagaaggaacttcaggttgaattaaagttcagtggaaaagaaggccgtgattgattagccatggtcactggaagaaagaattgtatttgttaccctcattgttgagaaactcatcaataaactgtcctcaatcaaaatgtggaaataggttactcctggaattattccctgtttacagttaatcctagccacatcatcacattttgctccttgccctatccacatcagcaagcagcctagccagaactagaagctgatctgctgtctctgtctagcacagtgttgttccagctgttgtatactgcttctaccgggacccaaatcacttggggcctctaatctgtgcactctttatatctattgccagagagaggtagcttgttttcctataagcatgaaaacagtttgctgactgagaccaagcatggaacaagacctggaatcgagaacagctcaattttaatgacatatcctagaaaaaaaacctatagaaagtcacggagtggtatgagggcagggagagaagggctgcagagagtgtagatgggcaccaaaagctaaccctacctacttctgaacatatgcttagccctcctttcttttctctcagttctcaggggctctgtacatcgtaggagccattcacaagcagaatccaacaatggccgtacacagacttcaagcaactctcctgctgtcacagagaaaaatgggtgagcattatctgctaagagttccctgttgtaaactcaggtgctccattctaatggataatgaaatggtaatggataatgcaacaagtatttctaccactatggtattttggtgaactggagagagtggaaccaaaaagcgtttccagggctgggcgtggtggctcatgcctgtaatcccagcactttgtgggggccgaggtgggtggatcacctgaggtcaggagtttgagactagcctggcccacatggcaaaaccccgcctctactaaaaatacaaaaatgagctggccatggtggcatgtgcctgtaatcccagctactcaggaggctgaggcaggagaatcacttgaaccatggaggtggaggttgcagtgagccaagattgtgccactgcacttcagcctgggcaacacagcaagactctgtctcaaaaaaaaaaaaaaaaaaaaaaagtgtttccatcagattctcccaagtctttattctacagagcaacgtgaacacaaccctactttttgggttctcttcatggttaaatctatacttagcgtcatcaggttaaacatcctccccctggatatttagcaatgtctgaagacatttttgtttgtcacaactttggagggaagagttgtgcagttggcatctaatgggcagaagcctgtgatgctgctaaacctcctgcaatgtaggacaaagcctccccgcagcaaagaattgtccagcctcagatgtcagtagtcccacagttgagaaacctacagccaggcatggtggtatgtgcctggagacccaggtaattgggaggctgaggtgggagtatcactttagcccaggaatttgagtccagcctaggaaatatagttagaccctgtctccatattaaaatatgtatatatatacacatatatatatacacacacatatatatacacatatatatatacacacatatatacacacacacacatatatatataatctcatttgggggagatatatatattatctcatttgagtagaaaaatgatgagcttctagaaaaaccctagatttaagctaaagcaaaaagggagtatcatttcctgtttagccacaggtttgagttaaatataattcaaaaggagtatagcagagcttgcctttcagtgacctctgagctgctcaagctgcagggcccgataccctggctaaatgtaggctcaagacactttaagtccagccaggccaggcatgacaccaagagctaaagacacaaacagctcctaggcctgttcttcacggaagcctttataatgtgccttctctcagataaggtttccagaacccatcatgtatgtcaccaggaggaggacacagctacaggaaggagtggaccatggcaaagggaaggcctaatagaatgaaactcacctttcttattttcttccacattgattatggggaacttccttaaaagttttagtcaaagatttcaagaaagaagcaggtcattagagagttctttgcatcttttcacctggaaaagagaaagtcttaatttacaattttaaacaaaattttaattattttttattattttattttgtgagatcgcttaagatttttgagacttgataaattaaattcttaatactcccccagtggtctcaaattgtcattgggcttcttttaaagtaaagtactttagactacttgcttaaaaagtcagaatagctcatttaagggcactttaggaaaagacctaatatctcatattagaataacaaagtttacaatttctaatgtggtagaaagatcactgagcttggttggaagacttggtttctgatcccagctaacattttccaactgtttgaccttgggcaagtcagtgaaccagtttggaaaacaacttcagccccagtctgacttcctcaatctcaactgaggtctgactttactgagaacaccaggacagtgctctgagctcttccaccgcccttctcttcaccttagaatctctccttatcttcggctgtccttccttcctttgctcccatctcacagaccccagatcctctgccttgtgcagtgttcctgccatccaggccctaccactatcaggtagcacctcccctgctttcccatcttttacactctgctatcactttccattttgcttatacctccccccatactaaaaaaaagcctgcccttggcctgtccttccttctttttgcttttaccaccagacttcctccaactgctgtccaggtccactgcctcatttcctcactaaaccaacccctttctccctaatcctgaaatctgatttgtgtccctacaatgtccctaaaactattcttgggaagcacagctcccagttgctagagctttatgttcatcagactctgcagcatttagttccatgggccatgcgtgctttccttgaagagccctcttccaagggtatctgtagtattgccttcttcaggtgcttgctcagaggtattctcagtctttgttttctctggttccattcttcttctcttccgcttaccattaaaataaaggcaattctccaagtcttagattctctcctttctctccttctcaccctggatgataccatctctcaccagtgtgttctggtatcaagtctctgctaggtgagcacgagtcgcaagtctctgttctgagctccacactcctacacccaactcacagtggacatatattcctgattcacacaccaagacttcaacagaaaagcccctcctaaagcacctcctccactcacccttcccacttctatgattgacataaacactgtcttgtgacctggccttcaaacctggcacagtcactcttgacccctacctctcacttaatctcacttccagtcattttccaaatactctttcctggtccaggactgccattatctctttttctttctccttctgtctttacagtccagctttcatttctcacacctgatcaattgtcttacaacatattctgacttgttcaaagaactttaatggcttcctattttagaccaaaaaaggttccgacttctcaggctgctgttccacgcctctctctagctcacttcagtttgtcctccaggctcacctccaccttgtccctaatacaccttatggctaaccagaatcagacttcttattgttctaccggtgcaccttcctctcttctctctgcccattcctttctgttcagctcttaccttttggtcaagacacattatcatatccctttcctccatgaagacctaattctttttaatactccttgagctgtagcccttttgtaacagtactactcaaagtgctttttcacaacaggataatgaatttgtgcccaaatgtaaatcaactcactgctttcttcattaagaaactcttgttactaaaaaaaatcagctgaactaaacaatgtacttggtgatgaattgatttacattctggcactagccccttatgtcattgtgagtagtaacagttcacagactgggtcctcacaccacactttggtgtttcaatctctctggtgctcttcatattttgcctggtgttatggttgaccttgtgctagcaagttagcttctcaacagtgaggactgagtcttactctttcttgtatccgatatacacaatagctactcaataagtttattgagctaactttcaaagccacttctcagcactcagatttttatgagggaagtgtttttcttgtcagtctttgggtagtggcaacaataagaggatcccgaataacttaccaaacagtgggccagggtatccctgatccagggactgggattctgttgtcccccttatgtttgtcaactcagtgttctgtgaatcaacaagggctgataggaaggagtttttgggcagagggtggggtgggagtagggaggggtttggggtgggcagagtaagaagagagctggattgtgtcactggtgatgttctcattggaagtaacaaacattcaacccatagattcaaggatccctcgagacaaaaggtccaaagacagaagttccagggctcggtcagccattcaggaatgtcagcaaagacacaggccccttgcatctctttgctttgctgttctcagcatgtcagtcatgcccccacttatggccacgaggtggccaaagcaacactaaacatcacttctttacatgccaatgtctggagcaggaagacagaagcggatggaaaggggcttcttctcaggagtctctctccatttgctaggagggaaatctttcccagaagtcacccaggagacttttcttgcatatgattggccagaatttgcagtggtggttctgcaggagagctgcaaaggaggttgagagattaggcaaagaagaaaggaagagggaagcaaccaacaaggtctgcctcaagagtcctggagagacagtgatgggagcagataggtaccaggaaaagatgaagggaaggcaaaatcagagggaagagttcataaggacgatccgtatatgtcaagaaatattgctgcaaataagaactgaagggaagtgttgagatcattcagattgattgttagcatttattgctatgccagttttttttccccccacattttatctcatgtaattctcacaccagccttctgggttggtgttactcactctatgttacagataaactgaacctggggaaagctaaggcaaatagctcataaacattatctcagagaccagtgctggattggtttcagatctacctacacctgccccccatcagctagtcgaggaatcactgggttatgcagggtcacacagaataaatggtgggtctgggctttgaattcagatcttctgtctccaacaataataacaactgctagcatttggttcattagcaatttcctgggcactgtgctaagtggttttgtttttgttttttgagatggagtttcactctgttgctcaggctggagtgcaatagcatgatctcagctgactgcaacctccgccctctgggttcaagtgattctcctgcctcagcctcccgagtagctgggattacaggtgcgtgccataacacctggctaatttttgtgtttttagtggagatggggttttaccatgttggtcaggctgatctcgaactcctgacgttctagcgattcgtccccctcaggctcccaaagtgctgggattataggcatgagccaccgtgcctggcctgtgctgagggttttacacgcattatcctgttcaaccttatgggaaaggtatagattttacaatctctgacattgagagatcacaagtaacttgccaatgttacttaatcagtaaagtgacagaatcaggatttgaacatgggccttctgaccacagcactcattttttaactggtacattctactgcctctcaaggctccaggtctcagataattagtccaaggctttttctctctacccacgttgtctctatacctgtcattgtttaaatcttaaatcaccacccactgagaaatacaccctacttgttataactgtcaccctgtgattgatgaagaaaattccagcacccagttcttgggagaaagcctaaagcctcatgggaaaggtgctcccatctgtgcatgatgggacagagttaacttggctggagagaaggaaacctcaagttgaaagtaaaagtgagtggttgggttgatgcttctctgcttcacttcctatgtgagcctgtaactgtgtacagtgaatgccaaaatggaaatagtcttttatgttgtggggctttgttcccatgatggtaatcccccattttaatgctgataaatacaatggtgaggattatgccccttaatttaatttggcctgcatatggcaaagctctcacaaggcttttatgtgacattctttagcacagctagcctgtttttgtgtaaaaggaactcatatgaagaggcaggagattgataatgctggtgcaaatgttttcacaagacggcttgtaacacacccccagtgaagctgcttcgttatgggcccttcaatgaggattcagattcagagtgatgggaacctccgtgactcaggcagctcaaggagaactggcacctcacaaggggaaaacaagtgcatatttctcctgtgtgtcatccttgcagctctggggcttggagccaattgggctgacctcagaattgatgagccagagaaacagcctcccagtcagcagggccgactgtgggccagattttcatgtgggctgtgaagtacagattgtcacatatcttgacgaacattgtgtgtgaggggtcacggcagaaatacatggcagttctaagactgttgaacagaacaaatcctccagcaaatttcctaccagtgtggtcaagttagtgcactaacacgttagaggaccccacatgaaaccagagggaaaatggcagcatgatgtgggagtggtggtaggaatagtagccttctctgatcaagtgcttaagatgtggtaaacactgtatgtattgtctcatttgggtagaaaaatgatgagctttggtgacagacctgggtttgaatcctagttgaattacttacgagctatgagacattggacaagttccttcctctctctgaacctcagtatcctagactgcaaaaagggaataattgggaggactggagataatcaaagcaaaggaactagcacagttctagacatgtaatgaatactcaataagagattatggcaagctgttgtgggtcatggtgatagaagtagcagcaataatagtagtaatattagtatggaaaagttttctgtaaagttaaactcatatgaaggatcaagactttgacttagctctagaattgtagactaaaataagcattgaggtttccatcaccttagaaactttgaacaatgctcactctctgctttaactttagagacaaattttattttcttgtattcctggctcctatctcaggaatgaatctgagattgactttgggttcaggagtcacccttaccaacattgccagcatgacattatcataccctcaaataataacattcagagcttagttgattgctagagctttcttagactttctagatttttaaaatattaattggtcacgtgtattttcaaaacctttttgaaggcagaaaccttatcaccagctgaaagaagcttcaaggagaaatctgttttgagttatatttttccttggggacttgcttatggccgtacataaatatttatctgaactatttcaacaaaccctaaatcatcagtgatccttatgcaaagagtccttttagaagatttctgtatgtcaagaatgccaacagtctctttctaagaacagattccaaggaccagaggcctcttttaaaatagttggaactctttggtggttttcaacatgtcttttgttttcatattctgtatatctgttcacgctattccatctgaatagaattcccttgccagtcctgtctttacctgctgatgttttactcatccttcaaggtctcattcgtgtgacatacagacaagggcaagagaagagcatcccaggcaggagaaacaagagtgggccatagccagaggcaggatatgcagagccattcttggaaggtgagaggtccagtgagaagaaggcagagggtaggatgggggtggtatgaggcaggaagaactattacagggaataaggcaccaagatatgggaggtcttcaaaagtacacaaaatgttttgttgttctataggtcaaaagatgtaaacccatagtgtttgggtagaatatagtctacagacatgttttgtttggcctgaatgttgttaaatttttaaaattagattctaacacataaaaatagatttcatgtcattcggacttctgatagctcttaaaaaacctgagtatctggcagcaaactgctggaagtgagcaggagctatctttcacagatccctacttaaccgcctgcctaattcatggcttggcctgccagcatccgagtttgattctctcccgctgtctgcagagcaccatctaggtagaggaaacgattcagctacagaccctggagccaaactgcctctgttctggcccaggtttgtgtccaactacctcaatgaccttgggcaagtgtgtttctaataatggtacttacctcatgccgccattgtgagaataaaccataggaaacgtttagatgactacctagtacgtagttaagtggacaaaaatgttagctcttattactgtatcccacatgagataataaactttagggctgaaactgtcactcatttctgtagcactcacagaatccagaatttagaatctttggccataactggcataaaatgaaataattgatgaatggacaaatgaatatgtgctccttgagtttttatttctgtgaggtccaaagctaaatttaattactttgttctctagaaatgcttcctatttaccttgagtttgatttgagcatcctagttagttgataaaggagctagctttctcaaaaagtcgaaaatcctaattaaacaagtgaagggagattctattaacaccatgtcatttttctgtgatgcatctaccttcctaactcaaaaataagctccaagtttgggaagatgtttctgtgttttctttaggaagctcacttattggctggtagctgcctatggttaatatctcaaattgagggtcagttgctaggaactaggatgtggtggacttcagcagatatgatgttagaatgcatgtttgacttgggttttcttatatcccatgcctgccatgtgatccacacttcaaggcaaaattttattttattttttttgagatggagtttcgctctatcgccagaccggagtgcagtggcgcaatctcagctcactgcaacctctgcctcccgggtttaaccgattctcctgcctcagcctcctgactagctgggactatagctgtgcaccaccatgaccagctaatttttgtatttttgatagagacggagtttcaccatgttggccaggatggtctcaatctcttgacctcaagtgatccacctgcctcagcttcccaaagtgctgagattgcatgcatgagaaactgtgcccagcctcaaggcaaatatttttgtgcccaatgcatcagacgacgatggacggtttggcatgggaaccaattttcagttttttaacatttcttctatatagctgaagtcacatcatcatccccatcaaggccttcaatgtgatcacctgtggacatgaacgtttatgtttacattaatctatccctaaacagacttgctgtcaacaatgttgctctacaaagttgactagcaaggttaggctcacgtgctctctggaaaacttgaacattttcaaacccattttaatttcgtttgaataaacttcatctaaaactgaatcatgtactcaagattccaaaaaattgctgtttaatttcacctgatagctctcttctttcttataaaaagtcaattttttagtatgatatttttagcatgataatgcctctactttttctaaagaactctcagtctctcacacatggacacgaagaggagaacaacagacactggaacctacttgaggttagaggtcgggaggaggaggaggagcagagaaaatgattattgggtattaagcttagtacctgggtgatggaatcatctgtacaacaaacccccatgacacaagtttacctatataacaaaccggagcatgtactcctggacctaaaataaaagttaaaaaaaaaaaaaatttcagtctcccttagacctctcctttccttccttcccttctgtcctccttctctccctccctcccttccttcttccttttttttctttcttcttgtctctctccttatactatttatatctacgtctctaaagttctggtttctgatccaaaagacaatttcaaataataagaaaatctgatctctaaccatttctccatccctcatccccttcctgcattacccatagaaattcagcacattgctggtacctacgttgtatcctcatcaagctctttattatattcccgctcagaatgagtttctgcccaaaagacctttacatattgagcctattttgaaaagtttgagaaaggaaaatggactcaagtggaaaatattgcaggaaacaaaattttgtaaaaatgaactttatataagagtgcttcattatcaacacataatgaaacctagattataatcctacatgttgaaagaagattaactttgtacattttcacaattttattaacttcactttcttcactgggttataaggaaaacataatggtgtttcagttccaagtatattttgtgaattaaatagcagcttgttcctcactataaaaaacaaatatgccaatatattttccactagcatcgccctggtcaccttaaattaagaagaaactggagtatttgccattaaaagctgttaacagtagtaatgccacaacatctccgtgtgcatcttagtaacttctcagacttgtctccttgatgaatagacaaaacaggaggaggggtgaatttgttctttttatctgaatggtgtaggtggggaagacagagagcaatagagagctctcgtgaaacagagctctagcgactgctgtgcttgggaaattagataataaacagtccctgataccaaaattctaatggcctaagatcaacacagtctggagacgcaggtgggagtggccttcctcgctctgatccagaccctcccgggagagctctttgtgtcaacaagaacagccagtgctcctggccagctcccaggactcagagtggggctatcatttttgtttgctttgcaaatatcttaatgggaagtggttcaacaccacctatgggttaatctgaggggttctgcttggcagctgttagctctgagaaccacatggccgctctcgggtgcagggagtcaggctagctgttaactacccagcgccaggttgaggcatcgtctttgcttattggatttactgactggcaggaagcaccttgttgacttttatttttagtttgttcctcctgggagagcaaggatgttattctcagatccaactgtgcttttttctccaagggagggcagttgtttaaattatttttactagcatgaagcatcctttcacctaagctcattctcagaatctgaaacttcatattaaaagtggtggtgtggtgaaggtggaaggggcattgttgccagaagaaagatttagtatattagcctgcagggagggcaaacagtggaagccacagccttgtcttcacctgggatctaaagaattggatagatagtgaatttctctgctctactgttcccttagtcctctccccctccctctcctccaccccaacatggctttcacttgtcttatcttgacccataggaatgtttccctgggcgacacaaccaagtcatgcctttctggatctgtgtctgctgacattgacacagatgatctctttctttatgctttccttacaggatttcaggcaggtaggatggtttccacaaagcaggttagggaagtacctggagtgatgacagacatgtagacagtttccaaatgccccatttgtaaaaatgcaaaaagttcagatttctctgtaggtcctggaaaaagtgtctagctaccctcaggaatagtgtaacccagcttttaaagccttattctttcctgggggttttctacacctacttgtgggattgtcttgtggttgacaacaagggccctagagtccactagacctgctactacagggtaagaacttcataaacgcacttattttctcaaggcttcagtttcctcatctttaagtggaagatcaaatagcacaatatctacctcaccaagacatgaaagttaaatgaggtaacatatacaaagtatgtagcatctcatttgatgcataaaaagcactcacaaattgtagtgattagaggagttgttgttatctctgaggcatccactttaagtcatccttagtattatgcattttgtactcattttgaagtctgttactcccaaccctttaaaatcatccagtgccaaactatgagtatcaaagtaaatgatgacaaaagagtataatccattgaataaaataagatatcatgagtccatgtggatggatggaaggaaggaaggaaggaagagaagaggctgagctctgacttacaataaaatatgaaataataaaggtagatgaaattaagaaaacagaaaatcatcatttggcaactgcaaaaataattgtttcaggcaataattatgaatggatgctaacactactatgtgaaagtttgaggagtaataaactatttgcatagtctcagagtaagtccccataagaaacttattaattacaaaaggacagtgaagaaacctggcagaaaccaccttaacccaagtgatgaaagttagcatcaccagtaattgaacaaactgacagcatgtgcctcctgttatgatgtattgagaagaagacaacatcacttttgtggatttcttgccaaatgtgcataacctgaatttaatcacgaggaaacagcagacaagtccaaatagagggagcctttacaaaatgaccggcctgtaggctccaaaatgaaacatgacagaagactgagaaactattccagatgaaagggaactaaaagaacgttacctctgaatgcaatagatgatctaggaatttattttgctatagaagatgccattgagacatttggaaaaatctgaatacaatctgtagattggaaaatagtgtcatattaaattctgattttgatcattgtattctggtcatataagaaaatgcccttcctttttgaaaatacacacactgaagtatttagggataaaagagtatcaggtaggctgggcgcagtggctcatgcctgtaatcctagcactttgggaggccaaggtgggcggatcacctggggtcaggagttcgagaccagcctgaccaacatcgtgaaaccccatctctactaaaactacaaaaaaaattagtcaggcatggtggcagatgcctgtaatcccagctactcgggaggctgaggcaggagaatcacttgaacctgggaggtgggggttgcggtgagccaagattgagccattgcactccagtctgggcaacaagagtgaaactctgtctcaaaaaaaaaaaaaaaaaaagagtatcaggtttgtaactgactctcaaatggttcagaaaaaaattatgcatgtttgtatgtgtatatatcaatacagagacagagagaggacaaagcaaatatgtaagtctgctgaggaatatataggattccttatactattcttgcatcttttctattaatataattaaatcaaaataaaaagttgcaataaacaagtcagtgccacttcttgccctttagacagggcagttcatcagccactttctctttagactcctgatctttctccattcacacctaaaagtctattccacgtcatcattgccgtgctcagtgatggtcctcaagcttctcggctgtgacattgctgactagtcagcactcactgcacacaatcttgtttaggcttttcgtttgtaaaagtttctgaaaatgtccgtccctcctctcacgccccctccctcacctgtccttgggccccatcatttagtgccatgtgtgtcatgcacttcattttagcacttcttacttctccttccctggactaagtactactttcagaattaaaagaggaaaactgggttaaatattatcttttgtgggggtggggggggggtgtgcagtggtgaaaagaacatcctccagttacagcatgaaaagggtgtaataaatggtctctgaagtttcctttttctctacaagtctatgccttggcctaattcagtcttaaactgctagaactgtaactcaaaagtagctcaacccacaagttactttaagactccagccgaaggaaaagcacagattctagaaaggcagccacacagatacctcatcattactattctcccttgaagtttccatgtttacggatttgtctttcagatgtgcaaaatcataaacaataagtaaccacattgttaagtatgtgttttatttctaacttctgactatatatgcatctttaatttaattattttaaaaccttgtcttgtgtgtttattttgttctgcccaggagaacaaatgcaatcattttttccttagctcaggcaagagtttttatttatattttgctgatgaagaaggggagaggtgatttgcccaagttagagttgccatatttggcaaataaaaatgcaagatacccacttagatttgaattttctataaacaacaaatagtcttttttgcttaagtatgtcccgttaagtatttgaaaatacttttactaaataattacaaacataccttgttttattcccttttgcttcattacacttcacagatgttgtgttttttacgaactgaaggtttgtgccaccctgtgttgagcaagtctgtttttgccatttctctaacagcatgtgcttacttcatgtctctatgtcagaattttttagccatattttgaaattaaggtatgtacattttttagacataaggctgttgcacacttaatagataatagtgtaaaaattatatgcactgggaagccaaaaaatgtgtgtgactcactttattgtgatatttgctttattgaggaagtctagaacaaaacccacagtatctctgagatatgtttgttgttagtctggagttcaaattcaactgggtgtcctgtttttttgtttgtttgtttgttgagacagggcctcactctgtcacccaggctggagtgcagtggaatgatcttggcttactgtaacctcagccttctgggcttaagtgatcctcccattttagccaccgaagtagctgggactacagatgtgcgccaccacgcctgactaaatttttttgtagaaacaaggtctcactgtgttgcccaggctggtcttgaacttttgagcttaagcagtcctctcatcttggcctcccaaagtgctaggagtacaggcatgagccacccacacccagcctcagtgtcctgtattttatctaacaactctagttcaagtgttttagaactaatatatcatgaatatgtacgcatatagcctgactgtatttcatgaaatatattgctaaatctaccaagtgtttatagcattcctctaacctctacgtgccataacacatagtgttttttgccctttaaggacttttgaaaccgtattcagggatatcaattcctacttatttattaaggtctttattcaaatgtcactttctgtagccactcaatctaaaattgcagaccctgcctccaatactttctatcccccttccctgctttaactttcctctttggcacttacttgtatttaatatgctacatagttacttttctgtttcaatttgtgtctgctacttgaatgtaggttcatgagcagaggactattggatctcctctgctgtatccccagtacttacaatagtaggagacaaatttaaaggtgctcggtaaagacttgggagccgaatgactgatgtctgggagcctgtagaagaccttatattgcatgtgtcatacacattgttcttatacagaatctcaaggagacttgcaccagattagagccttcagtgtggtacgagtgtgtataatcttagtaatagtccatagacacaagataaatagaaggtcaggccagggtttatacctccagatatcattgggcttcatttaatctgcctcctagcaaattttctagaactgaatgttagtagccccaggtatcattcattaagatccttaatagaattgtgtgattatctggaagagtccagtaacaaaattatgctgaggctgagagcatgggctccgggtcaaccagatcaggatttgtatctggttatgacctatgttactcaaatagcccaagcttgggtttcctggtctgtgaattgggaacactgggggacctctgctgctagcactgtcatgggatgaaatggatagtctagccaagtcctcagcacagtgcctgatggaaaggaagctgcttccatcaccgtcacccaggccacaccacaaattccacctgagctcacataaagctcagctgttctagccatgctgtggccctcagcccacggctctgtatcccttcagatcacaatacccttctccactactgcgtctcttgttttatccctgaactttctctcagctcccttggttgctgacaaataactgaaataagctttatgggcagctgtcagttgagtgtccttttttccaataaagcaagcattctcagcagaatgaagaaaagccttctgctcctaccttagacttttacacagtgacagctgcctgcagtaaagtagtgaaggagggaaaagaaaacaaatgagaatgcaaggactggcaaattaagactgtatgggctcacggttggggaaaagcaatgaggcaaacaaatatgatcacatttaaagggctcagtgggatttgagaaattagcataagtgcataaatctaactactgctaacttagagcaatggcattatgagacagtcatcagcctttttgagcccttctgatgaatttatccttgagccatgttctaaaacttaaaataattgtgtgctttagagcaaacaaatatccatatatttagatataacttgcatattcaactcattcagtaatgattagggtgggatgcagtgcatgcattcagaattgttccaaaagttactgggtatccaaacctgatgagaaaaagtaatacaaaaggtgtgaagtttattccttcttgtttcccttattttcctgcaataatggtgatcttattgtgtactgttactgtttctcctttcctatgctctttgtatttccttcatatcacacattaaagcccaggaataatgtttttcctctttagaaatcaagaagtacaaattaaaataatagtgaggcatattttgcaaagagataagcaaagtatctcttctctgatgtcattccttaaatatcttaatttacctttgtaatttgaatttactgaaaccgtttctgaagatgtgtatgttttctattatctcttatggtaataacttccataatgaaagttatatgacttgtttatctgaaacttgcctccctcaagattcttggggcccctactatttaaaagtatgctggtctcggctgggcgtggtggctcacgcctgtaatcccagcactttgggagtctgaggcaggtgaatcacgaggtcaggcattcaagaccagcctggccaacatagtgaaaccccatctctactaaaaatacaaaaaattagccgggcgtggtggtgggcgcttgtaatcccagttacttgggaggctgaggcaggagaatcgcttgaacctggagggtggatgttgcagtgagccgagatcgtgccactgcgctccagcccgggtgacagtgcgagactctgtctcaaaaaaaaaaaaaaacaaaaaacaaaaagtatcctggtctcaggaggctgagataagaggatcacctgagcctgagaggttgaggctgcagtgagccatgatctcaccactgtactccatcctgggtgacagagttagaccctgtctcaaaaataataattctggtctgatcatatcgtctgcagagtggttttactgctgcttcttgggaacaagaaattgaccttctcttattaagagctctttgatttttttttttttttttttttttttttttttttggtggggaagctggagtgcagtggcacaatcatagctcactgcagcctcgacctccctgggcccagatgatcctcccaccccagcttcctgagtagctgggactacaagggcatgccaccctgtctggctagtttttgtattttttgtagagacagggtttccccatgttccccaggctaatctctaactcctagattcaaggaatcttcccacctcaacctcccaaagtgttgggattacaggcttgagccaccacgcccagccaagagctctttggtttttgttcaaagttatcaaagaggtggaaacaaattacttggctatgctgattgcctttcttttggggctaccaaatgagacacaaatttactaggagaaatactcccaaatttagagacaatggaaagctaacaaaaatcaaccaacattgaattagctattttgaaattagagtatgctttcaagcgtgaacgaataaatggatatctcagtttctctccaagccattctaacttataattgataaaagataatcttgaaaactttatcaaaattaataaaaagtacacaaagaaacaagtaaaatttagaaaatggagaatctgaggggagccagtgtgtctcaacgcctatccaagcaaaaaggtactgattctaaccctaaaatagaaaaagccagttactaggcaagcttgactgatcagatacattctcaaagagcaccctgcttcttttgctttaattctaatgtgtaatttagtctccagagtgtatcaaccaactagagaggggaaaagtatagtccagatcataccattcattataaaatcacactcgcattgtacatttcaaatatgactcttttgagattggttattgcaactcagctctccccaaaatcatcatccctcaatgaactgacaaattgaattttggagcctgtgaagctgaggcccagtccctggaccatggtgacttcacctagtgccaccggcgcagcgtgacagagccagctggcctcatggatctctgctgcagaagaagggagatgctgggtattctcagcagccagctactcaggagccagccttcaccttgcccctcatccactcacactgggatccggatttaagaagaaggaattagatgtgagttttgtctgggggctttttcaggacagatgcccagcagaagggttctcaacggtgactgagagtttccgtctcccctagaacccacagttcaatgaactgacttcagcgaagcggtcgagccctggaggcaatctgtttgagactttagttatgcttccaagacgccaatggagccctagaaatatgtgatgaattatacaaagagggacaactactttctattcaccttattttgatagccatatacactgcttctgcccatttagcttatgatttccagcagaggccgaggacagtgttatttgttaaaaaaaatttcctgtggattcagaaaacaatatcacacttcataaatgaattaattccttaatatcgtcccataccaattcatagtcaaaatttcccaattgttctaagaatgtcctttgcacatgtttatccaggccaggatccgatctagaatgttacagtgcatcaagttgttatttcatctacatttcttttgatacagaatagtcacttttttcagaatactgactttttcagaggatcgagccataaaataggattatctcataaaatagctcaccttctgtatttagctgcttgcttcctgtggtcttatccagcttgtccctctatgccctatgctttgcgtagactgtaagttagatctaaagacttaatccgatttaagttacatgtttttgaccaaaaggaaaaaatacatcctgggtgatattacatacttcatgttgcctcacattacaagacaatgttgtcgtggtgttagtggtgttaaaattgagcaccggattaaaatactgaccttctgatttctccagtgtacattgcctctcttgtgaaatgaaagaaggaggttagccacctgtatggtggtactttggctccatatgaatgtcctcttccctattaacagtttgtctatgattttatcagcaattaataattctttttatttatttatttttttttttttgagatagggtctcactccggctgtccaggctggagtgcagtggtgcgatcttggctcagtgtagcctcgacctccagggctcaggtaatgctcccacctcagcctcctgagtagctgggactacgggtgcacatcactatggcccggctagttttttgtatttttaatagagacagggtttcaccatgttgcccaggctagtctccaactcctgaactcaaacattccacctgcctcaacctcccgaagtgctaggataccaggtgtgagccatcacacccagcaacaattgataattttggcctgataatttccctctggcatcaccttttccatagtcaatataccatagtcttatggtacactgcttaccagctgtggtttgaagcaaatcactggcttcttgatgcttaattcctttatctgtaaaaataggttattttaggaagcagaggcaggaggatcgcttgaggccaggagttcgagaccagcctgtgcaatatagtgagacttcatctctccaaataataaaaaattagccaggtgtggtggtagcacatgcctgtagtcccacctacttcggagtctgcagcgggaggatcacttgagcccaggagttcgaggctgcagtgagccatgatcatgtcactgcactctagcctgggcaacagagtgcgattctatctcaaaaaaaaaagaaccaatccacatggctgtcagcagtatgtaacatgctttgcctggtgcctggtggtatgtatccatgcaataagcattggcttttttttctttctttttaaaaaatattttaaaaattcaattaaatagagacagggtcttgctatattgcccaagctaatcttgaactcctgggctcaagcagttctcccacctccacctccccagtagctgggattgtaagcttgagccatggctttttgttattattgtgctttttcttattttggtagtgacggattgcagagcattatccagtctcatgtccctaaggcaaaaacaaaaaacaacaaaaaaaacaaaaaaacagcaacaacaacaacaacaactctataaaggagttgaggaagttagattttttaagaaaactgacttgtaccatcttcttaaaagcaaggtgtgttctaagaatcagtagtgcctcaacatggtacagaggagaagggtccattgttaaaataatgtctagaagatgtttccaattcttttcctttcttggagtctcattgaacatattattaaattaaagttgccggaaagcctctcgggaaagaaacctggcttgtaggctaatctagtattttctaatttatttgcctgtagacactactccctgacctctgccgctgacttttcttaaacacacacaaacattacattgagctgccttcgattcttccaaaggcttgaatgaagagggaatcaaacagataagctgactccctgtggagagttgggaggtgtctgccattggctttggattctgaaaagccacacaagctagaggagttgtcaagaggttcattttttgaggggtcaggaaaggcataaattaggggtctggcagtaattcaacagctaaactctctttcttagactttctcctagaggatcttagaatccacccatcctataggtgtgtcacagctactgggacttgcctaggccagacaggagtgagtcctttgggccaatgcttagatactgaagggtatagaatatattatggttcagaggaagagcagaggatttggagtcagacaaacacgggtgaatgccttagctctaccaggtatttaccatgatacctgggaaaatctcttaacctctctgaacctctttgtttatctgtatgatagatacaattaaagtacttagaccaaatggttgtgaagctttcttaaatatttaaaagcattttttttaaatgaagtagtatataaatgatagttaatttaattttaatagtaagagtattcttactgatctacatggccccgcattttgtggattgactaatcattgttttatttattcaaatggtcaatatttactgagcattttctatgtaccaggcactgggtaggtgcttacacagagcgtgaaatagagcagatccagtccctgacttaatgtagcttacattccattgtgggagacatatgataagcaaatatacacacaaataaatatagaattatagtcccctccttccaggtactgatgtggtaatttttaaatgggcatattgcttataatatatattttgaaggtaatatccacaaataaatatacggaaatgaatttgtcagcttaagtaaagaataagattattaatatagaactggaagagaccttaggaataatttatctcaatctcctcattttatagatgaggaaaactaggaccccgaatactacagaaacttacccaaagtcacatgtttgttgtgtcatgtgtgtcacatgtgtgcgtgtgtgtgaggcaggggtcagaacacagatttcccttctttactcagtgctttccactctgctggttccatctgaaaggcattatgagtggctcctattttatctgtgtgttataagtacactcttatacaatgtgttctgattatcaaaaattggggacccagaccaattgatttttccaaactttgttccatgaagcattaggattttattagatgttaataggttatcactttaagcttcttggtcaaattactgttggaactttatctttactatagagatccataaatgtatattgtaattttaaaagattattcctgcagtaaggaaacctttcaaactacgcccaacctaacattccccaaacttacttgattacggaatccattttaagttctgtaactgtgaatgtgattcatgtgctgtgcaggaagtgtagccttagcatccatttagttggcttcttggtaaaggttgtggaagcccaatagagctcgctaaaccaaagccaatcacacaactttaaaaggagcagtttcttgggtcttaggaattcaggcagactgtggatgtgctgtaacatgtaggagcaacacctagtaggactcattttcttaaggtgaccatgtccttttaaccaaggactgaaatgggaaaccatggaagcataaaaagtatgttttgatatatctttgaagaaaaacagtcctctctaagtttttctattattattttcaagtcttttaaaattattattattgttatcttttcaggcattcacaagcccagagttctccaaaagggtgcgatatcttcgcaggacatgcaaacaaggtagctggatatcttgattccaaagtaaatgtgtatcactccttcagactcatccaagttcataggcatgaagcttgtctgcggctgcgtggttggaccatccaaacttgaaactgttagtgatattttgaagtctttgagacaaaagcccagcttgctgaagaactttggttcagtagagagacagggaggtacaggggagagagaatcaaaagcctggaaatttgctgctgagaataaatgttagctgctccctgaggtgatttgtctgtgcactccactctctacagatgttagagcctctttttgagtaaggacccgaggttctttggtagcactttgatatcctgctcgaattcaatatgtgaaatggaggcgtctctctgtgacttggagcccacagcaggctttgaagtctgatccaatttttgctgcctactatttgatgttgaaaggatgaaatgaagaaaatgtacagtttttgccagtaactctgctgagcatatgtaagattaaaaaaacaaaatcctttggatgatgtacttagaaatgttaagcagattaataccttcctataggttttcttttttctttcttagagataaaaaataagtataggtgaaaatcagcacatagctgttttatattctggactataattaatttaacaggaagctaggttgactcgttctgaggaagaaatgaatgaagcaaaagatgttaagacttggcttctaattgccccaaggagaggacctccattcaattctatgtaagatgggagcaacttacaaatgattccagtatacttagcctcttgcttttagtcaggtttaagtgccccttcattaaatagaagccatgtccttaaggctgtttcatcagaggataagaataatatttctcttactgggtttttctgaagcactcggtttctgggactgatttgctgtcttctcggatatgccatcctgctccagatcagcaaggattgagtctctggggagcccctcaaaagcctggtaagaagaacgttttgaattgcatgcggcttctaccatttgcatgtttgtgtactttttagtgtgttgtttgggcaggactcaattagatagtaatatgaccaaatgttggcaaaaagttttgggaagccatacatgctggatgtaaaacttgtattaaaggtagcagtttaccatgtacccatgtcatttaagacaatgaatatcaaagtccatgcttttccatttacttaaccttaaactaggaaactgttctaaaatttcattttattaaagggaagataaacagctgaccagcttttagtggagcggatcacgcagggtcgaaatctaggagttgataaagaatatggatttagaaagtagttctgcccttttggcaacatggccattctttgagcaagtagacagaaatgcctttgggacacaactctttctggctcgttttctaaatgtcttgctacagaatatagtaaaagtcagtttcaggtttgcatgcagctaaaaccagtgcttctggaaaataaaatagaaacataattgtaagaaatatttacaagctagaagatactaaggactacgtgaaccattccaagaaaagaaatgctcctgatgttacacttaatgtcaacctcatctatttttctgaaatataaagtaatttctcagatctcttcaattttcttcttagcctgtttttcggtgacaaagtagcacagtatgaagtgggaaatgcataataaatgtgtcatgacttcagtctatatggatcttaaactcttggagagagacaagaggatgggtccattatagcagaaccttttaaatggacatgtagtaaatgataaacccgacaaaggaaatattttcctcataggcagacagtattcaggaataaggccacaatgaagtgggggtaaaagtagtacaaaaaaagaggagagaatttaggggaaaaacagtataatggagcaaaattcattatgcgagagtttggttggtacttttctctatccaaacagacagtctctgtattttaattggagtgtttagatcatttatatttaatgtgattattgatatgttttggtttaaatctatcatcttgctatttattttctatttgtcctatctagtttttgttctctcttggtattctatttttaaatagatgtaattcctaaaaacaaaactttgaagtacggttgaatagctaaaccatactgacaggttctggcatcagacctgcctggattcaaatctctgctctcctgtgttaatcaagttacatagcaactccttaccttagtacctacacatgtaaagtgagggaaatagtaatgcatatctgagtggttttacttaggattaaatgagctagtgtaagtaaaaggcatagcatagtgtctggctcatagtaagtgtttagtaaatgtcaattgctgttacggtaattattgttattgacattatataaatgcaaacgtaatctatgaacatgaatactaggtagagaaataaagttctttttgtaaggcattaagttttggtgtgatagttcaggggaagtaaaaatacattgcattttgaattaatatttattaaaaagaaaagagacttgttggattacaataatctttcccattctttaggaaagtatcttaaaaagtcaaatttattaataagttacacatctgatttgctataaatggctcatatgcactttctttctagagttgtctcttccttccagtctaaatgattttctattgggtctgccaccatcaccattacttccccttacactcttataaacagcatcctaagtatttttcctgcctccattcttctgctttagcttctcttatgccaacagaaacctaagatttctaaagcaaaatcctaatcatgaccttctctccctccatactcttcagtgtctccctagtatcccagcatgaccttcaaggctttctctgttctggtcctaatcttcttttctagctctaacttccactgctctctctttttcattctgtgcttcagaatctccaaactattctctattctccgaacatgcctggtgtgttctttccctcctctgtgactgttcatgctgcctcttctgctccacatgtccttcttcctcgtttacttttcaaaatcctctccattcttcaaggtccacaatggctccctactcttttactctttcttataatacttatcacatcctgctttgtgttatagttactttaatgcatctactagatttaaaactctctagaatcatgtcttcccatttatgagttctctcctcacaacctagcctaggtctcgaattgaattcttgaacatccaaagtggtgatgaaatataatggaagcaagaatgaaatgaaactctacctaagtaagcaatcagagaaaagttttaaaatgtatttctaacaatcctagaacaaagtaaatgtttctgaggcaagctccaaatagatatagtgtactagtggaagaaattaaaataatccaagctatttcattttgttgctattgctgttttgggcaggagaagcaaaggaagtttagacatgaagacgtgagaaaacactatatgtaaatcgaattccccttgatcttagaaaacgacaaagatgaagaacaaattagtttttccgtttcgcatatattatcagttgtagaaacaagaatatattatttaagcaacatttttagcaaattatacctttgtgtttcattctgtgctttaaatgacccattattttaacccatgtttttgtggaaggctgaatgagaacattgtgaccttttcagtttaaaaaaacactaacatccagaaggtttgccttctaacttgcagtgaggcctaacttcgttattctatgaaggggtctggtgaggtgagagtgagaggcagggaataaatctaaagttactccatctcaagctcagcttagagcagccactcaaataagtctctaaatatggggcttaaacaaggctgtcttcagagtataagaagtgtccctggcacggcgtggtggctcacgcctgtaatcccagcactttgggaggccgaggcgggcagatcacgaggtcaggagatggagaccatcctggctaacacagtgaaaccccgtctctactaaaaatacaaaaaaaaaaaaaaaaaatagccgggcatggtggcaggcacctgtaatcccagctactggggaggctgaggcgggagaatggcgtgaacctgggaggcggagcttgcagtgagccgagatcgcgccactgtactccagcctgggcgacagagcaagactctgtctcaaaaaaaaaaaaaaagaagtgtccctaaactggcccatgtggtccggcttattgctcacattaagagaaaagcacaatatacccgggaagtgcataattctagtcacttggtcactaatccaagcagtgaaattatttaataggactgacagcaatgtatacagacctcatctggttttactaatgcaaatggttatactttaggcatttgttcttctacttatatttatttattcaaaaaataattattaacgctatgtgccaggaactgagcagtatttctcaaaacttttataaaaggccagtttttggttggttgttttccatttcaccacagtctgatacttttgtggaatacaataaaaatgaattactaacaaaataatcatgcacttggatgttgtgtcaatatcaaaaccctgtccacatgatgctacactctagcagagggagatagacaataaacattaagcagacaagtaagtcaattatgtgggatgttagaagggtgaagagttacggggagaaaatacagcagcaagggtgataaggggtggcccaggcgtagagggtgagtttgggtggttgtatttttaaacagggtggcttcattaagaatgtgaggtttgtagccgggcgtggtggcaggcgcctgtagtcccagctactcggaagactgaggcaggagaatggtgtgaacccgggaggccgtgcttgcagtgagccaagatcgcgccactgcactccagcctgggaaacagagcaagactccgtctcaaaaaaaaaaaaaaaaaaaaaaaaaaaaagaatgtgaggtttgagtaaaggcttgagggtggtgagccagttcaccatgtaaatatctaagagaagagcattcctggcagaagaccatgataaaggcctggaggagagaatgtgaatggactatatgaagagtagaagtccctgtattggagctaagagagcaaaaagtagagtcataggaaatgaggagccagatagtgcaggttcgtactgcttaatgtcctaacaaacatcctaggaatctagatacaatgaagattctcattcagcaggtctgagtggctctgagattctgcagcactaatgagcttgcaggtggctctgatattgtcggtctgaggttcactttatgagtagtgagggtttagtctcagtgaaatgggaagccagtgagtgggagagtggcatgatctgggttatgattttaacaataactccagttttggagttgagaaccaactagacatcatcaagaaatgagatagtctgtgtaagtacattttctctacagctgaaactctctcaaacctaaaattacctttcatattgagtgcacaaacacaattctccttattctttgtatctaggggcatgattattaacagcagttatcacattgggctgtaatgcagagcaatcctcagagaccaatatgaaatggggccacctacccttgcagtaaatgacccttgaccattatgatttttagttaatgtgccagattctctgtttaatttttcctctctcaacacaaagctgatgtttcttgctgttgttaatgagctgactttttgtgacatacttttcttctccttcttcctttttcatctttgctatggtctaaaaaacaggttttaagcattttttttaggcagtaaaagaagtgggtttgagagggagatctgagaaaatcccctatgaataaaagaacaggaactcttatgtatgtagtacctatattaggtaccatgccaggccctttacttacattttcttaatgtaaagtacacaagctttagtttaaccttgtgacctgtgcctgttaaagaaccctcactacctgcccttgggttttcttttatacctcacctaagaggtacctctgttctgggttttcttcctgtctacagggagtataccttaatcacgtttctttttgaaggtcaaaagtagcaagcagtattctactggcctcctgagggggtcacagttggcaaagcacactgttgggatgtagtagagccaccagagagcatgtggaacctggcatcaggcattagtgattgatttcgggtctttcatggcctgtctagccacagctcctgagcaaatcacaccactttctttcacttagcagcttctttaatgccatctacttcattattttcctttacctttccagttgctctcattactaaattttataaattttatagtttttggcagcaattcagctatcagaaagcaaactcaggctgtattttattcttggaaactttgatccttaaggtgaccaaatatctcaactttcctgtgacagaaatgttttccaaaatgtgggattttcagtgcttacaccaggacagtcccaggcaaacagatgagtcggtcaccctgtaataatacaggaaattgagtttgatttaggcaagatcactatatcgggcaagactatgcctcagatccatgcaacagaatcacttcacactggccgcctgtgtttggaagggagcgcaagcagcttgccagacagcaatgctatgatcataaagggctaagatgtctcccatttgatagggaaagcatgttcctacaacagagtctcaaaggccgcataatctccctcaggaaggcacgtggaaatcagacactaaacaaaggcaaggctactgggcatctctgtcccatacccaaattcatgactgaatgtcacacacaagactgtattcatttatgggtagtctctgaggttctgaatccctgctctttttggctccctcaggctgaaaacatcttttcttcttgtctggatgccattgaattcaccttaaaccctcaccagtaaaacttggtaaagtcttatgtgaggacttttctcagtaaaatgacaaaggaattacaggtatagaattgttattgctagcatgtgaggttagaaaaacacctcaaatgaagggatctttttagacaaatggctctcaaacttcactgtgctctccagaatcacctagaatgctagttaagacagactgctgaacccactgcatagtttccaattctgtgtgggatggaggcggggattcgtattgttatcaagtttccagaggataagatgctgctggtctggggacttccctttgaaaatcactgctctggacattacctatctctgtgacacaacattgaatcagagaaagtgggctttatatatgtggctttctcctcattcattcaacaaacatttattgagcacctactatatgtcaaccacagggccaggaaatgaaataagacacttaagagactaatacgattataatatcttggtctttgcagctgttgttttccaaagctagtctggtgacatgttgagtgtcctcctgtatctcaagtgatctcattaaattctcgggaagttgtcaagaacaaagttacatttacttttagctttgctgtgcaggaagagggtgggagtgttccagacttctaaatagtctataaagtatatcattttctaaaattattaggaatgactgcctttattgtttgtttgtttttgtgagacagagtcttgctctgtcacccaggctgcagtgcggtggcatgatctcacctcactgcaacctctgcctcctggattcaagcttttctcatgcctcagcctcctaagtaactgggattacaggcctgagccaccacacctggcttttttttgtatttttttgtagagacaggatttcactatgctgcccagcctggtcttgaattcctggactcaagtcatccatctgcctcagcctctcagaatgctgggattacaggcatgagccaccacacccagccagaaattattgctgttaaaggttatttccagattataaactatgctacttctgctaacctggctgtagtatattctcccacatggcaaaattactctaagccccaccagatctgaatgttttcatatatatttaatttaatttaatttaattatttatttatttatttatttatttatttatttatttttaggtggagtcttactctgccacacaggctggagtgcagtggtgtggtctcagctcactgcagcctccacctcctgggttcatgtgattcgttcttacatatttctaatacatatgtcattgccataatgtttgttccctgactttttgcaaaaaaaaaaaaaaaaaaaaaaaaaaaaatctaggcaaggccaacataaggaagtgtacagtttgaggcttgtgggcatgaggacaaagggatggaagaagaaagaagacagattatagttgtcttaatccccaatccaatttctaattaagcttaatttatattaatcatatactttttctgttttgcttaagtgactgatatggtttagctctgtgtccccacccaaatctcatgttgaattgtaatcctcagtgttgggggagggacctggtgggaggtgattggatcattgaggtggggatttcccccttgctgttctcatgattgtgaatgagttcttgtgagatctggttgtttaaaagtgtgtagcacttcccccttctctctctcctgctgccatgtgaagatgtgctttcttccccttcccccttctgccatgattttaaagcttcctgaagcctctccagtcatgcctcctgtacaccctgtggaactgtgagccaattaaacctcttttctttataagttacccagtctcagtctcaggtagttttttatagcagcatgagaatggactaatacagaaaattggtaccaggagtggggtattgctataaaggtattaccataaagataactgaaaatgtagaagcaactttggaactgggtaatgggcagaggtaggaacagtttggagggatcagaagacaggaaggtgagggaaagtttggaacttcctagagacttgttgaagggttgtgaccaaaatgctgatagtgatatggacagtgaagtccaggctgaggtggcttcagatagagatgagaaacttactgggagctgcagtaaaggtcactcttgctatgcttatcaaagagactggtggcattgtgtctctagagatctgtggaactttgaacttgagagagatgatttaggatatctggtagaagaaatttctaagcagcaaagcattcaagaggggtcctggctgcttccaaaagtctacactcatttacataaacaaagaaatgacctgaaactagaacgtttatttaaaagggaagcagagcataaaagtttggaaaatttgcagcccaatcatgtggttgtaaagaaaaacacattttctgtggaagaattcaaggctgcagaaatttgtatgagtaaagaggacctgaatgttaatagccaaaacaatggaaaaaaactcctccggggcatttcagagaccttcatggcagcccctcccatcaaaggcctgcaggcttagagggaaaaatggtttcctgggctgggcccagggtcccactgctctgtgcagcctcaggacatggtgccctgcatcccagccgatctagcttcagctgtggctaaaaggggccaaggtactgctcaagccattgcttcaagccccaagccttggtggcttccacgtggtgttgggcctgtgggtgcacaaaaacaagagttgagacttagaagcctctgcctagatttcagaggatgtatggaaacacctggatgtccaagcagaagtctgctgcaattgcagagcctcatggagaacctctaatagggcagtgcagaggagaaatgtggggttggagcccccacacagagtccccactggagtactgcctagtggagctttgagaagagggttactgtcctccagaccccaaatggtagatctaccaataccttgcactatgtgcctagaaaagctgcaggcactcaatgccagcctgtgaaagcagccaaacttgcagaaccaaaacgctgagctgcccaaagccttgggagcccacctcttgcatcagtgtggcctggatatgagacatggagtcaaaggatattattttgaacctttaagatttaatgactaccctgctgggtttcagatttgcatggggcctatagccactttattttgtccaatttcttccttttggaatgggagcatttacccaatgcctgtacccccattgtatcttagaagtaactaacctgtttttggttttacaggcttataggtggaagggacttgccttgcctcagataagactttggacttggacttttgggttaatgctggaatgagttaagactttgggggactcttgggaaggcatgattggttttgaaatgtgagaaggacatgagatttgggagaggttggggtggaataatatggtttagctctgcatcgccacccaaatctcatgttgaattgtaatccccagtgttgggagagagacctggtgggaggtgattggatcatgggggcggatttcccccttgctgttctcatgatagtgagtgagttctcacaagatctgattgtttaaaagtaagcagcacttcccccttccctctgtcctgctgacatgtgaaaacgtgcttgctttccctttaccttctgccagaactgtaagttttctgaggcctccccaatcatgcctcctgtacagattatggaactgtgagtcaatttcacctcttttctttataaactaccgagtcttgggtggttctttatagcaatgtgagaatggacaaatacagagacttttctcatttttactagatctgggtttttggtttctttgtttttgttttgctttgttttgtaattttgaagaataggaacagggtgctttggacatcagttatagtcctagtagtttacctcaactgagggctctgttcaaaactggtgctctctgaaggaactctgtggatacctaccaagattgatcatagtgccccatttcccttgaaagaatcaggatgaaaaggaagaacaagggatgtactccacaaaggtcagtgcttttctccaccctcagccagctgaatcaatagcaagattctgactctattggaggagctgaggctagaggagtctagaggcggctggaggggaaagtggccacagatgtgagagtggcagatacaagccgcagaggtcacatgccaggccaccattcctgaggccacatacctcaggaaaaacctttcacagcctgttctcattcctgcgactcattaaagcacattacagaattgaacagtttttgaacatcatttcttcttagattgttgctgcaaacatagctgtgaaaagttcttgctaaacttttccggtgctttcctgagttcgttaggtcatgatgcactttttgccaatgccaagttaggttttggcgttggcccaggacatcaggagtgcagatgccaaacaacacaaggcgggtggtgtgtgagtcaagttagggtatttggcttccaagattggatgttgatggcatggctgtaaaatgtgcctagagaaaatttatttttaaattcttttcttatttgatataattgaaacaacacatactctcaagactgccctgttaaccacagctgcctagtttatttcattttaaaggattctttcaactttaaaatcaaacatacaattgtttaatggtagggttgtagtgatttttcttctttttatgtttgtttgttttctaagattgagaataataaatttgtttgcgttttaaaaagttaatagagtttacttatttgagtaatttttggcttacagaaatattgagcttaaagtacaaaattcttacataccctttctcctctccttttctccctgtttcttctataattaacatcttgtattagcatggttcatttattacaattgatgagcccatattgatacactattattattattacattagagttcactgtttgtgctgtacgttctgtgagctttgacaaatgcgtaatgacctgtattcatcatgacagtatcatacagaataatttcactgacctaaaaatcccatctctacctccttattcctccctccccacaagcccctggcaaccactatttgtttttttatttatttacttattgattttagtgcctccatagctttgcctttttcagaatgtcatatagttggaatcatacagtatatagccatttctgattgacttctttcactttagcaatatgtacttaagaggccaggtgtggtggtttacacctgtaatcccagcactttgggaggctgaggtgggaggattgcctgaggccaagagtttaagaccagcctggacaacacagcaacaccctgtctctacaaaaaatttaaatattagccaagtgttttggtgcatgtctatattcctagctacatggaaggctgaggtagaaagatcacttgagcccaggaggtcgagggtgcagtgagctatgatggtaccactgcactccagcctaggcagtagagcaagatcctatctctaaaataataataataatatgcatttaagattcctccatgtcggctgggtgtggtggctcatgcttgtaatcccagcactttgggaggccaagacaggtggatcacttgaggtcaggagttctagaccagcctgagaaacatgacgaaacactgtctctactaaaagtacaaaaattagctgggcgtaatagcacacgcctgtaatcccagctactcaggaggctgaggcaggagaatcacttgaacctgggaggcagaggttgcagtgagccgagatcacgccattgaactccagcctgggcaacagaccaagactctgtctagaaaaaaaaaaaaagattccttcatgtcttgtcatggcttgatagcttaatatcttggttgcttccaagtttggacaattatgagtgaacctaccataaacatttgtgttcaggttttggtgtggatgtaactttttaattcatttgagttaatacctaggagcatgattactggattgtgtggtaagagtatgtttagctttgcaagaaactgccaaactgtcttccaaactggctttaccattttgcatttccttcagcaatgagtgagagttcctgttgctctgcatcattgtcagcctttggggtcgtcagtatcttggatttttacttttttttttttgagacagagtttagctcttgttgcccaagctggagtacaatggcacgatcttggctcactgcaacttctgcctcccggactcaagtgattctcctgcctcagcttcccaagtagctgggattacaggcatgtgtcaccacgtctggctaattttttgtatttcagtagaaacggggtttcaccatgttagccaggctggtctcgaactcctgacctcaggtgctccacctgccttggcctcccaaagtgctgggattacaggcgtgagccactgcacctggccagattttgacattttaatagttgtgtagtcacatctcattattttaatttgcaattcactgataacatgatattaagcatcttttcacagcttatttctttcacatgcttatttgacatctgtgcgtcttatttggtgaggtatctattcagattttttgaccattttaaaattgcattgtttgttttcctattcttgagttttaagagttctttgtatattttggatacagtcctacgttagatacgtgtttttttttgtttttctttccaacttttcttttaggttcaaagggtatgtctgcagggttttttatttttatttttatttttttttgagacggagtctcgctctgtcgcccaggctggagtgcagtggcacgatctcggctcactgcaagctccgcctcctgggttcacgccattcttctgcctcagcttccggagttgctgggactacaggcgcccaccaccatgcccagctaatttcttgtatttttagtagagatggggtttcactgtgttagccaggatggtctccatctcctgacctcgtgatccgcccgcctctgcctcccaaagtgctatttatgtttgctaagttactaaaactcctggaaaaactagaaaaactcaggttgtctgctaaaacagtatttagcaagagatcagtttgttggtttaaatttcagagagggctgggagataataaaatatacctttattcctcattcattaggatatttgtccagcagatgttacttgagcacccactaaatggcagacactatgtttgatataatacagggagcaagagccaggcttgctcttgtgaaatttatattctgagagagatggacaaataaatttgaaaacaagtctgctttgactagggtgttgataggggtgagcacaggagctgtgggagctccaacggtgatatgtggtctccaggaaaggttcagataagcttactccaaaactcagacctgcagcgaagagtcagaaaagatgtttccagccgtctgcccattctttttccacacggggagaagctcacatgtgagagatacaagatcaaggtggttgtttattttgttttgcacccccagcccccatccttggttatttttggttttgccttttaaaaaattctgaaatgtaacatgcttacagaaaaaaaaaattcttaaaacggaggccagacaccgtggctcatgcctgtaatcccaacactttgggagaccaaggcgggcggatcacaaggtcaggagatcaagaccatcctggctaacacggtgaaatcccatctctactacaaatacaaaaaattagccgagcatggtggcgggcgcctgtggtcccagctactcaggaggctgaggcaggagaatggtgtgaacccgggaggcggagcttgcggtgagctgagatcgtaccactgtactccagcctggtacagacagagtgagactctgtctccaaaaaaaaaaaaatgcttaaaacgaaaatggacagtataataaattattataatgcaagcaccatgtgagcacaaccgagatcacaaaacagtccttgccagtgccacagaagccatcagcatgccctttcaggattatgactctcttcctgcatcctacaggtaaccacctaaatatgtgtctctaaatattatagcttaattttgcctgtttttaaactttgcacagctggaaccacatagcatatattctttgacttctagctttttctcttttttcccttaacattatattttaaagattcacttgtatattttcgttactgtatagtatcccattttaggatgagagcacactttatgcattcatgtttctgttgatgggcatctgggttgtttctagtttggaacccttacaaagaagagatgttcatggatgatggtcccatacccttggcagggtggcaaagctggctttggagtcagtcaaacttaaatttacatcccatctatgccactctaatagctttgtgactttggtcaagttaacttaatctccctatatccctctttcctcatctccaaaataggaatagtaacagtacctacgtcatagggtatagatgtaaggtgcttaacacactacttcacatgtagtaagcactcaacaaaaatttggtgctgcatggagttattcttgttactcataggaatatttcatttttatttgaggaagttttctacagagttaatatggcctaacctatccagatttaagattgtagaagctttcaaggtcttttgttcaactctcattttatagatgaaaagactgcatattagttggccaacccagagctagaacccaacccagagctgggctttagggagacatagagtcagtagtacctctggatcagcattctggcacaggctattcttaagggctcattggatggccattttagcttcttaaatgtattctcctctttgttctttaaataaatgggaaaatagaagccttaaggggttgaccagttagctctatatttggctgtagactgtaaagtctattacattatatccaagttgtttgattatttattcattggtcagaatttagggtttcaagggctctatcctaattaggccaaaagatcagagagcaaaataaggcacataaagccatgcctgggggattattggcattaggtagaggtgttttgtttagtttggactgcagttgaatttggattaaaaatacttgcaattttttaaaaagaacagatatatctcttattaaacaaactataaatatagtttggataatgacgggagggagaaattcaacataaactggatattaaatgagtctgtaatttttctccctaccaagaacaattcacaatgacttcctgacctcccactttcaaatcatgcactctatcctagactagagctttgcctgagcactgcccaccaccatcacccccacactcactcctccggtcccacattgtcccctctttccagtgttttgctgatatttaaggtttttattacactaaaattccctgttctgtgatctgtgttcctgggttcctaagaatgtgtgtgtgtttgtctgtgtgtgtgtgatgctctggaagctttgaggggattctgggtcaggacttatccaaaaataagactccagattattagcttactacatgtagaataatgcctggtacatagtaagcatctaataaagtttagctgctgctactgctatttcttactcttccattgcgaatcacttttgaaagtacctaatttccaagtttagcaactcctttcttctttccactcaaattatcaagtcttctggagtgcgctacaatttctaaaaaactacacttgttttccctcgatactaccacaagtctcaagagtatatcaccttgaatctttactgcatttgagtgggaccaatttgttggtattttctgtgtctggcagtttgtgtaatgggagggagttgtttcattaatccacctaaatggtttcaggaatatttatagctcccacagactcagatccccaagtcaccatccagaaaggtctgtttggctgcttagcagtgagcaattagaacagccagtctacccagacaccaggctggtttgtctgacctaatatacgtgaagactcagtgttcccaaagggattcttcctttttagaggaagaaattaatgatatccctttttgttaaattggtgccagtattttccctaagcagcccatttaaaagagcaaattcaaacagggtccaagaaacaattgcaagagatctacaaagatcttaggggatgagtttacacactatcctaatttcaaaggagccgtttttatgccaggacacaatggctgggttctcccaatggatacacacccactgtaaatggcaaactctgcatttgtgcagaaatcagataaatggaaagagctctagatttgtttctgctcttaactgatttgtcctccaaagcacagtttccatgctaactcattagcctgggtgaatgctgggggtaccgacgggggacagaacatccaaggatccattctaaatctccgagggtcagattacaaagtgttcattccttttttgtccttcactgctgtatttacccatgtccagagcagtcagctcacaacacacttgtactctgccttctgattttcaacttgggttgccattaagaaagcaaggtacctcccttctcttgtgtgctgcttattctttgccctagacccacattctcatattcagtccattaatggaacccccattcatgtcatgtagcagtttctatttaacactgggagggcactgggaaacagtccattatgttgtctctccccttaaaagaagagttagaatggatgcctccctctcatctaccaccctgagcaaattaacccatatgaccagaagggacaacctgtgaataaccactgaatgattagaggattgaacatatactgcataaaggttttacttactagttatctgtacccagaggattctaaacattgcccttagagtgacaatcttttcttcagcagtctgacaaatggtcatccatgctaatttcccacattcttttgcacatctttttacatcacaagcctctgtgggaggctaatggaatccatgcaccctaactctagaaaaatgcacaaatgtacaccggcaacattttgcacataaaatccttaataccttcatgttcccatcaggatctgtatcccaggttaagaattcttgtactaatgagaggaattgactaattgtaaagactatcaattttatgtttgggaagcttgatcgaaggatttttcttcccatgtggtagttcttcaagtatttgtagattgctcttttttggttagatgtctctttgggggatatgtctctataaatcatcagatgaccctcaaaagttatttaagaaaattttgtgctatgattaaagtctttgggctagaagatgtacacgcaatacataaaaagaatagacctgtggtttctcaaaaatgccaaggcaggttgctatagtctttttcttcttcattaaacaacaacaacaaaaagttgattcctttaaaaaaaaacctcagaattcttgaaaaaaataaaaacattgaatcctgtgtttattgctccatcatcttaatttgtttttgatttaaaaaattacttggccattgctcaatttttcatatttaatagaaacagaaggagaattattagtggaattctaaagttagaacatgaagattgggataatatttcacattttacttttagctctctgcaaagtggtggtaatgttttctgagccactgttacatgctcagataatttatgcacaacataaattagtgttattgctctctttgaaagcagttttttcctggttctcattcatatccgtataaacttagatgttaaccctattttgacgttttagaccactgattttaaaagagtaatgatagttccagatatctcagatattttgttttggagtttttacattgtctctagtttttctttcatcaaaggctgaaatttggtagaatttagagaagaattatgatatagaaaaataaccccaaaagccgacaaaacccaaaaataacaataacaaccaaagcttaactgaaaatctagagataatgtatttatacttggttccaggcagtcaattagccctcactaaagatgagtaagttgagtcaaatcatgcatgaatttcctaaagtcacatgattctgtaatgtgaagatattaaagatcagtaatgaggctgtgcattgacagatatttgagtcatcctttctgcctcctgtaaaatgattgcagtttgtccatttaagaaagtatttttcaaacattgattgtgatgcctgttataacagtttacatccttcctttatatagttacttcagcaatttctgtagccatgaagtggtgctttgagtctacccactaaaagtgttttcctgtctgtcatgtcacagttaactcttcacttttaaagggaaactatgtgagatgcttgctggtgtgggcctatggcctttcctcaaatccttcttataattttagcttccctacttccccatgcagataaacagaaattgactgaacactacaaagttgtaaaacatgcatacacacacacacacacacacacacacacacactctagacacacacactacacacacatacactctttctctctctctctctcacacatacacacacacacacacacacacacacatacacacacacaccccaagaatcaaacagaatctcagcaggaaacagattgcacactcaaattaggataattggagtattgtttaataaagggattattttttaaggttggggcaagatatagtgaaaccataaaggatagtgtagttctccaaggaccaatgagagtaaagccattaccacatacacgtaaaggagcaagaagagagcatggcatctggaatgcaaaaggagagagtcatatggatataggagtcatgagaagagagatgaccttcagttaaggacacagtcaacacaagacaaccccataggaagggagctggggaataaaagagaatcttctttgtccctttcttccatctgatttcctgatagggctctctattggccaaaccactgagaagccagactagtctatacaggtcagtaaaattgtgcttcagttaggaattagtctgtgctttcagaaacacatactgaaatagggtgacttcaacagacaactattttcctcatatcaccagaagtccaggggtaggcaatttctggtgttggttcagaagatcaagaatgacaagccaggccaagtctctgcaattctctccactttttcttcatagtcccaagaacatgaaagatggctactgctggagctccagccatcatggctataaaaaggattttcctagaagctctatgcaatgatctatttatatctaataggcctcctttatctacagaagaagctgggaagcatagttcagttgattacattgctgtggcatatgatttaagggttctgttatgaaggaagcagtgaagaatggatgttgagtagacaaggagtagcatctacccaagatagaatttaatcatctgaggcacatgtgcccagggcattgtttcatgctcatttctgaacttgagaattttcaaatcatgtgaatgatcagatttcaccttgggtccttcttcatgagatatcaagacctgcaggcaagagaaggaccacttagatgaaatggctataaaattctaaggcagccaggtgtggtggctcacgtctgtaatcccagcactttgggaggccaaggttggtggatcacttaaggtctggagttcaagaccagcctggccaacatggtgaaaccccatctctactaaaaatacaaaaattagccaggtgtgatggtacatgcctgtaatcccagctacttgagaggctgaggcaggagaagcacttgaacccaggagatggaggtggcagtgggctgagatcgcaccactgcactccagcctgggcaatggaacgagcctccatctcaaaaagtaaataaataaattcattctaaggcaaatatttaagtgtgtcttgtggaaacagtttgtgcaaataaaatgaagttatttctggtattccagaaataagagaaatggaaaagacacactttgttagcatgctgatcgaagtataaagatacaatttttatacaaaaatatttgcaatatgtattgagagcattgaaaaaatgtttggatgctttattccaacaattcgctcagaatcttttttttttaagttcagaaaaagttaagagaacaagtaaataaattctacagccacactgtagaataatatgtaactgttaaaaattacatttacaaagtatttaatgtgtggaagacttttttattatcataataacctaaggttctgctgcagttttgcctggagtattctctaattccataaggtctctcttttaatatccaattaaaattgcttgattttccatcccactaaatagtaaaatttatattctctattcttttgctgcctgtcacaactcaaactgcagggggaaaaactcctttagaaagaaattgacaaagaattttaaagggcagttcataaaaggagaaagtgcaagtgaccatgactccatgcaaaaatgttcaacctcgaaatttaatgagaaataaattttttttgcatatcaaacaggcgaggattgaacaaaaaagatagtacatgggctgtcaagaatacaaggaaatgagcattcgtagtattgtttggggcaggaaacagcctttttgtagagcaatctgccaatatattatttgacccagcaatacctgttttataaacttatcctttgtacgtaattggattaagctatgcataatatttttgtgaagtttgtactgaaacaaaaactgaatgatgttcattttgggtcatcatgagaatggtggtagatgaacagaggaacaggaaactgctcaacgtggtacctagcacacagtaagtgcctaataagtgtttgccgaatgatgaattcattcagatgggtagtctctaagggagaaattggttttgtttcaaatggcatcttgcatcttgcattttagtcacactttgtagatatttcttgtcaacagttgtagccataggactggagctcaggagatgggcacagctgtctgtctagaacagtgggggactataaggaatgacatttctgtttgtctttttttatatagtcaaattcattgtgaaaatgaagtctccaagtgagagtagagaaagagattagtagtgggccttaaaaagtctgcagggggcaaggtagaccaagtgaggttactcttgtgatttatgtaactgcatacaatactttcgatgagagaaaaattaactgggttatctgattgataagcataatcattttagataaatttgcatagtctatggagatggtctcaggccctactgagagaggagggtgtagcttgctttaaagtcttttctcctcctatgctcaaatgcttttcccataacacacctcaaaaatccccaaacctttgttgcaagagtctggactataataatcagtgaaggcaacttgaaatattagtcttcatatcagtaggttatagtacattaaaatatacttggattttaaagatgaaaacatgctgaattagaaacttctgcaagtttcattattttctcagtaattcccaacagattgtactcaaatcatttaatgtaagaaagcatctaaaataggagattaaggaatttattcttaactgtttatgttacaaaaggatgaagtaatgctgctagttagaatgattatttcgggttgaaagtgcagtgtaagtacatggtgacaaataaaaattatgagttctaaaatatggcattgcataatcattttgttgattgtaatgcttgagtgtttttaccatgtgaaccatgtaggcaataatgttaaaatagtttaaagtttagtctctttttgaatatgcattacagctagaattctgtcacctggatttttctgggttctgcttacccaggtaactaaatattactgatcttatagagggagttatgagtagccagtgagaaaattctaatttcttcaataacatttttcactgatcactttattactgatatccccactaagtttattaaaatattgaaatctctggagttactagatcacacaggtagaagaaagctcaaattttaaaaagttgtgtaccaagtgtgaatggatttaggattttgaagagggtctcattctcagtaaataaatcttctctatataaatctggagttcaaacggttctgattagagccctgctgtcttactggtacctcctggaaagcaattagattagtagagtgcatgaatcctttatatcttgtcatgattgagtccaggtttgaaagcagggcagtaaccctgatgaagaaccacatcattctgtgcctgagtcacagactcagactttaacatggctgtttttcaaccatccaatctttaatattgtcgtattttaaactgagacacttagccaagtggcatatgaaaaagaggtggtagaatctttgcaggcaaccttctgtggaaacaacaatttgagctgtatttattgcataaattgttatgaagaggatgtcttcttgtctttccagagcctatttcctaagagcaaaaattaaataaggcagtagaggaagaagaggagctgatttagttctaaacttaaaataccaattttaataatgtattctactgaaattgtcattctgataccaaaatcatggctagatgagtattaatgaaatgaataaggatttcaataagatttttgtgaatttctttaagattctcagctaaccatgtaaattttttcccgtaaccactgattttagttgatgctagtgaagggtaggggacatccaaagcaaaggactaatagaaatgtttaaagccctctttggacctaaaagtatgacattcctttgtttttattgtttttaatcacataatgaaatgtttatgaaagttaacaggacacaaaactccaatcagagcagcaaagaacaaatcattgcgctttgcttctgtcagcagaaaatgctttgtttcagtctttggctgaagttggaaggggaatgaccttctgaacagctcttatggtaatgctgagaggcctccaggcagaaagtccagtgcaaaaagtacaacacagcaagagtgacaaactgagtatcactgtgagaaaagccgacatgactccaggtgtttggagagtagcatcttaagtagtcttgacacagacccaaattctgaaaagtttgatgaaatttagacatgggatggtgaaaagccatgcacatttttatgtgcttttaagtaaacctttatattccatctaacaactttttaaagaagtagtaatataacatcacatagaaaatgaatacattttataatggaacttcaagcaaggtgccaaggtgcactgatgggtcatggatgtgttatggttgtgccaagatattgataccctcagctttcaaagcagccaggcagtactgggcaactggaggcacctctgtctacttgatctctgtttaccagaccagaccgtacaaatattattattttctatgtgtgccatgacatggcaaagcctgaaaaactctgctttgcagatatactttgcaaaacccctgaattccaataagaaggggtatgtaaagttatcttatgtctaaataaacagaggcagaaagagtgtggtatatattcccagatactatgcacaatgcatttggtaataacaggggcagagtatggaagaaggccagtgatggaaggccagggacttcccgtctgggcttttctgcttcttctgcctgactgcactgactctctaacaataaatattcagaaattttctagcaaatgttcaggagtgaaggcatatggagcgtttgattttgtttgtgtttaaaatattgtttccacacagatggcattggtttagctattgtgtgactttgtttggatcttcttttgcccaaataagagatgagaaccatagctctttgaaactcaagctaccaggtttgtattctgcagtttgccccaccacattctgcagaggctcttgtcccattttgtccacaaagatacctttgcatatcaatgagaatacagtgactttcagcaatgatttcaattggctcttgaaatataaggattaagacataaaaggagaccgtgaaaattgcgtgaactgtgggtttagatgtttagatatttagattccagagtgcagtgactgtagcagcaatctggccctgatactagggctgacaaagtcaactcactgtttctttaaaaagtaaagaagactgttggacagtcttcttaaaagatgtttagggaaaaggtctacaaaaaatgaacttggtgacatgtgtgtcctattagataagtttctgttttgtatctaaagatatttttagacatccagtctgccatgttgttgcttctaaccttgttagtgccggtgggtagggggagagaaaaacaagcaaacacatagaaataataccttaaaatacaataaatttataaaattgcgaacgtttttcttttattaaccatcatgactacgctttcctattaccaaggacctcaatactactccagggaacaagagagtgcctactttgtttcctcccctctgtatttagctttctttcacccattcttccaaaagttgactaaagtcagagtctcacttttgcatctccccagagctaggcaaaaaaaagtctacttccagcaatactcaaatatatgttcttcccttcacaataatgactgtataataagatacccacttagtcagtaacagcctctaaaagctgttcttctggaatctgtggacctgaacttgaattgtatgctaattcataagcagaagagccatttccttcctggaatcttgtgagagggagagacagaatctataaaactgggctgagttttttttttttttttttaagctttactttttgaattgtgatccataggaaaccgagagttggctgggtgaggtggctcacacctgtaatcccaacactctggatggccaagatgggcagatcacttgaggtcaggagttcaagaccagcctggccaacatggtgaaaccccatttctactaaaaataaaaaaattagccagccatggtggcacatgcctgtaatcccagctactcaggaggctgagacaggagaatcacttgaaccctggggcggaggtttcagtgagctgagattgcaccacagcactccagcctgggcgacagagcaaggctctatctcgaaaaaaaaaaaaaaaaaaagtaagaaaactgagagtcatggaaacgttttgctcttctattccctaaatcctagaattcagactgttttgccaggtctttctgaaggacctggctcttttaaaaagctcctcaagataagacaacatggattatttgaacatgagcatatttcacctacctaaacccaatttaactagaagagggttaaggagactcagacactggtgtgattctggaggaagatccaagattaatatactgagatgccagaactattgtttcaaatgttgcaaaatcagatttagatcttgtatgaaagttcttggctgaagaaaaagagttttccaacttagagagaaaaccaactttgcccatctgctgtaacaagactaagtaaggaaatgatgtttagagggaaaggagacttgaatgtaaaacattagtttgaagattggagttgagttggtttgtctatcttcctttttatttagctgcttcttttacgctaggaaaccttatattatgagatacataattaatcttttttatattagatctctgtgaaccaaataaaagaatatttccatctcaccggtgaggaaactgctgcttataaaggttgggtgcattggccacattcattgagccagaaagtttggagccaagatgcaacccaggctcttttcactccagcgcctgggctctagcagaccttgctatgccttccacagcaaattactctactcagtgttgtaagacacgtaactgtgctttttggcggttttccttgatcattattgtaaggccagcggggctgattttatttagcaaatgaccattttgattatttgtccttgaagaaacagtcatttgcgcgttattctggccttgtttttggattctttatttgatttttttttagtggtttttcaaatttccaggcagttctcaattgttgcacaaatatcaaaatgctctacaaactagcattatcccagcaaccctctttgagcctcttgctctcattgctctctgtgtggtgctaggaatgtagatggaactcaatctctgtgaaacgaatgaggctatcccatcatcctaaaaggatcaccaataacatctcttttgctgaagtaggattacctccaaaaaacatatttttaatataaccttatgtttcttaagacaggtaacatgtatatagatttaatttttcaggctagctggctttcaccaagcaatgagtaatttccaaaggaataggagatgttagtggaggtttttgagcaagagcaactaaaggatttattcattcctgaatatacattcctttgttatttggtatgatccatgccacagaaatagaaatatgaatgattctgtacctgccctcaggtgggtaatattattatgttgttatgtacacgatgaaatgggagccctgtggaagcgcatttaacatggacctagaagtcagggaaggcttccaggagaagatgagactgaggtgtttcttatggggctagcaaagctagtagtttgttttgttagagtgtaggctgagttctgaggaatggcaggagatgagctggagagaggtaagtaggtgtcagattaggaagggctttgtgtgctgaagagtgccatttttgttctgaatgttgtggagaaccactaaagatagtaagcagaggcatgacatgttcatttagaagattatactgtctaccatgtagagaatagataggatagtacaaaactagagatgagattagcagagaggctgtcactgtggtccaagcaagaactgatgagagcccgagtcaaagcagtgagatagatgggatgattcatgtagggaggataaaagtggagtatatagggcttgatgactgatatatggtggggagtaatagagggaggaatctggaatgatgaggaatctggaatgtttctgacttgtgttctctctgaacacactgcagaaaagtgatgccttttcaacaactttttaaggcagtaaatctcaatgacagctgctaacatgatgatgaaatgatgctagagaaataagcctgtaaacaagggtcagtctttcagtataccattgaaacatcagtggtcagatgatagagaggtggaggaagcattcaaaggttaacacctcaaccaggagcagtggctcacctcctgtaatcccagcactttgggaggctgaggcaggtagattgcttgagctcaggagttcaagaccagcttgggcaacatgacaaaaccctttctctggtcgggcatggtggctcacgcctgtaatcccagcaatttaggaggccgaggcgggtggatcacgaggtcaggggttcgagaccagcctgaccaacatggtgaaaccccgtctctactaaaaatacaaaaattagctgggtgtggtggcgggtgcctataatcccagctactcaggaggctgaggcaggagaattgcttgaacctgggaggcggaggttgcagtgagctgagattgcgccactgcatgccagcctgggtgacagagcaagactctgtctcaaaaaaaaaaaaacccatctctacaaaaaatacaaaaattagctgagtgtggtggtgtgctcctgaagtcccagctacttgtggaactgagatgggaggattacttgagaacaggagcttgaggctgcagtgagccatgattgcaccactgcactccagcctgggcaatgaccctatatcaaaaaaaaaaaaaaaaaggtaaggacctcctcctcctcccaccaacagcatatgccctatgctcaaggccaaagttagcaccttttgatgtgatgcaccccttgtacaacatggcagatattccactggataatcctctttttgaaataattttaacaaacataaatatctacaaatatgttttgcttagtttaagaatcaaatgcacaatgtaatattatgtcgtgaatctccacctggtttctcacttattccagaccaaaatattatgagaaataattaatgactgttttttccctagttattccttagtctcttatcccttcagtaattcattgtataaactctaatctcccatgcttagtattttggctttgccttttagttggtctttgtgttttagtgatcagagctaggactctgataaaaggtatatattctttagaggtacagtataaatctgtaaggcagaaccactctgtcttctagagagagtctctagaagaattctgttattctagaaattggactgcttctaggggatactatatatatatatacacctagtatacatatatatgtagtaaacatatgtaataaacatatatgtatactgtgtgtatatatatatatatatatatatgtatgctatgttgtactagcaaagtttaactgaatttagaatcaaactgaattatctaataactagtaggatgtagcatgcttgtgaatcaaagtacaagaagactatagagtggatacctgtgtgattaattaaaaattaattcttccaaaaacagctgcatataggcctaagaacataactctcctatggttcaaaggggctgtcaattccattataagtctaggttactgtttattttccaaagtaaaatgaacagctggcaaaaggcaattaaccttataaataatcagaaataatttgtgctatttagtggcatacaaatgccactttagttggcctttcattgctataaaattctcctaaaaatattttgtaccattattaaataagctctaaggggagggaatgactttctcagcacaaactggaagaatatttcaaggtaagaagtgaaaagataatgctaatatatatttgatttttttaagaaaaaagagacttgttaaaagactagatgtgatcataaataggacatataagtgatcctgcttaagacgaatttctatcaatcaaccatagttgcctttttccctccctagtcattctcaagttaattattaactagaatctcagttaagtttgaagttcctttaaattgtgttcagtgactgccttgttattatttcttactagtgcttagagttggaatatgccttagaattcaccattagaaaacaccctcttttataatacaggaaactgagggccaagaaagcaaaatgacttgcagcagctcaaaggaaacaaagaaggctcccaccccacactgcttcagaaccctgaagcacttaatagaatgtgcatatattcattaatcagaaacactttattgtgttcatttactaaagataagtaaatcacaaagcctttactagtttagccctgaaatgtgaccatcttgatgatatgcatgcacggtaggttctcattaacctttgtcagatttaagtatacttaattctaattggctttattttcagttggccgttatttgatttattgagatcgactaatgtaatatatggtttttaggatttcaacacaatttggggatttttttgcaatgcagatattttccttttgcccaaggtaataatagacagggatgaaaacactactttaaagagggtgtctgctgatttacatattttaaaagtattaagatcaaaggtaatgagaatttaatccatatggcatgcagaagataaataagaatattaatactgtatcaaatactaattaaaagaaacacatggatctaattttaagaatgtaacgcaaggatgaaatactctttgtaaagttaaaacacgattctcttgtaaaaaggacagttatggtgagttgtttttcccctctcagggtgaaaactggctggttcatatatacagctttcttagaatcagggtaataattatgagcacagtgattgtgccttaacagttaacaaagtgctttcacatcttttttgatcctcaaagaaaatcttttagttcctagaactcttacccctgtttcactgaagaggaaatatgctcatagaggcaaatgaacttggacctaataaatcagtctcagtcttgatctccttctccctctccctcttctctttcccctttcacttaccctccccactccctttaataataattagaagagtgcagggagatgagcactctcattcactgggaataagcgtgtgtaaactggttttgagagtacctataacttataatcagagatgtagtgaaatatttatgcctagggatgtttgtgacacttctaattgaaaaattttaataaaccaagtgtccaacaaaagaatatttgggttttattgtatcttaaatgatataatcttagggcactattaaaatcatgtttacaaagaatccttacagtttaccagcaagtgtttgtatttaaatgttaggaaagaagtcgaaaataaagtatataatataaatttcatatatgtatttatatattcccatatgtttatatttttttcctctctatcaggggtcagcaaatatttcatgaaagaaaccagagagtcaatagttcaggctttttgggtcttaaggtctctgttgcagttattcagctctgccattgtagggtaaaaaaagcatagacagtagataaataaacatgaatgtggttccagtaaaactttatttctgtgcactgagatttgaacttcatataatttttatgtcccacaaaatattattagtgttttgggctttttttctaaccatttaaaaatgtacaaaccatccttagctcatgggctgtccctaaacagatatgggccaatggtcatatcaacccaattgatattatggacaaacataccctaaaatagtcagttacctctgggtaacaagattataggcagtccttactttcttccttaatacttacctatacttctaatatttcctctaatacatattctatactttaaaaatacaaggaaaaagcattttttaaaagaaaaagtgtgtccaagcttaacaaatcgtaactggcagggacaggttttgaacagaaaacccctttctcccattcgtattgcctcctagactctcgtagctgaaaggattctttagagatttatgaacagtctattcccttattttacaaaagaaataaagactccaaaaacttaaacagcttacccaagatcatgaggcaattagtggcagagtcccagctagccaaagtccccagactccctatgcagtgctctttctttaaagaatttaacaattcaacattttttctagttgttaacctatattagagaactgaaaaagacagaaaggggatgcagcagtatcccagagaataattttaggaagcagctaccactcctaaaggctgaggaacagagagaagatgtgattgttggaacttagacttggatgaggggcctcatatagttgaaactcagacctctgtgtagggttactgtccggctgatgctggtctctgaagggattgctgaggctagttctgggagtatggggaccctgcaaactggaactactgctacagctgaaatcaagcattgctgccagaatgaagatctgttgctgtggtgaccgtggtaggaacaagaagcaaaccggaagaagcaagtccctcttctccctcgtgccttgtagttttcctctagcatcccctgttgggagtccagtggagagtcatatggcaaagaagtatgatttgtggagtcccattccaccgtcacacagagcatgaggctatgagtgatattattaggacgagaaagaaagagaaaagaaattaatgttcttgtgtgtacatacttgcgcattaaaacaagcaagaagaaaatgtatataactgctatagtccttgttactataagtgaaatggtcacaaagcaatagttgatgcttataattttcttattccttactctatgatctcttagcagggacctcagcttgttgagattctttgcctggcaaggtgagcctagcctcattcctgaagggtctgaatcaccagcggttctgcagatttctgcttgctgtagttttctgtaaacctttactattagacatgcaagtactaagaagtactcagagaatatcctgggctccagacatagtcctctttgcccccattgtatagccccaatcctagctaatcaggatcaatacatccaacagagtaatttctttgcctattggttcagttgcataaggaagccaaatgccaagtggcagtgtcagcctctaattcagtggaaccattgttgcatcccttggtagaagcattcccttcttaagtaccaagatcttcgaaccagtagaactcaaagttgtgaggagaaagagcaaaaaattctatgtaaagctattttaattattttaaaagtaattttaaaaatccagagtggatcgattagctctgatttatcatttccctgaaaatatatttttacctttgacattaatctccttgaggacaaaatctgtagctggttcatgttcacatatccagtgggccttattatacatctgttacctggcaggcactcaataaaccctggttgaatgtgtaggttgacaggtagctataaaccagcttatattgactaactggttaaaattagaagactaacaattttaaattttcctttgctaccttgcacgtgaaatctgtttcttccatctctggacttacgaataaactctagtaatttgtgactcagcaattccgttgatcagtattaggctgttgattacaagaatatgaattcctcaggggagacagtgggtctccactccccatcagagaattgtagctttgggtagtgttaatattactgggcactttaaaatgaaatatcttaaattttagaagattcattttcctgtgagtgacttgaagcagagaagcatttcattagctcctcttcccaagtcctgaggaacttctgaaatgtgaaccaaagcagtcttccactgcccggagctccttcacaacatcaaacacttaataaaaatgttttccttaaacctcaagcatttccaaatattaaatgtgaaggggaaagattttgctcaaactgcaaagtgttctagaactggagggtatgtgagaatatgtgtgtactgtatgtgtgtgtgcacgtttacatgcacacacaggtatgtttttcctgtttaatattttggaaattgatttaatattaggcccaaaccctctctaaacaaggttgcataaacaaacatacctgcttatgtttggctggtccccaatgttaacgtcaagggttcattaggaggaggtagaaggggcatatgctctccccacaacccagacaagctgttagcctgagaacaagtgggttctcacagacaaggtcgcagcctgcggctcttggggtcgtgatgtctggagacctgagggacattgtttgtggggaggaggaaggcggggccaaaagggtgaccactcagattaatttggattgtatctatcttactgaagcacaatttaagggatggcctggacttttaaaacagaacagctgttttgcatttgaagtttcactctctactgagtttctatgaagtactttgttttaaacaaaccatatcaaaagtagttcccagtgagtgggtgttggaaacttagtgtacattttctgttgaagtatttcgaaagcatcgaaggtaaacaggtgaaggctgttaattacgactaattttaattactactaaaatttacattttacataatctgtgcgttgttaaaaatgtattcaacgtcctagtgtgttaatgtattcactgcattatccacagtttgtactcatttctctaaactaactgctaaaaaaatatttccgatgttcactgtgaaacttgctttaacaagtagatattgtggtctaagtgaacggacgtccgctgccccgctgcgaggaattgtgctgtcctcagcctgttgtggcattacgcagagggccttgaaacctacccaaggcttggctctttagcagtagctccaaagcgcttagcattttcttagaagaatgacttggtactgaaattttgtatagtctggggagcagcaagttattgtactcaggaagttcacattctgattagtctgtaaatcctgggtaaactcaaagtgatggattgaatataattactcagtatgtttgcagtgcacatcgccatagaaacaactattcatataaagcaatagaagtataattcttggttgtgtaactagttatgtggaaaaactatgactagcaaagaactgcagaatcaggatcatcaaatgtaaagatttgcattctgtaaacaatatgctttgtttgcatgagaccatttcaagcaatttgagcacagtggggcactactagttacaacccaatactcagtcctttgatttttaaaaatataattatgaagtatattataaacgaaatataattagtatattataaataaaatataattatatttcaaacatccagaagagagggaaaataccaaaaaccacccacataataggttttaacattttaccgtatttgcttcaagtcttgttaaattgaaattctgttgcaacccccaccattcctctgtcccagttctatccttcttctcttatctccatagtaattgctatcctgaattttcattttattccctaccatatttttatatttttactaaatgtgtaggcagaagccaatttttcctgaagcaaaggaatactgggcctctgggccagtcactcctaccacttcctccaaggcccagaagttgtcagggccattgtcagggaagcagccacagccacaggctagaaacctggagcaccaccacagcctgggaggcagtgccaggtcttcagtgggtggtcttggagccattggcactacctccagagcctcccagctcccaaggaaaacctgctcttgatggatcccccagtgcctctgatgaccatacgttaccctgtgtgaactgatgaccgtacattatcctgtgtgaaggttctgctccttgttcaggggccacagcccaggctgctctgggaaccctgcccagagaggtcaaacagctactctgctatctaagaacagaaattacagagttgtgatgcttaaagactcttttctaaagtgctatttttcttccttaaatttgttgatcaaccgtgctagagaaaaaaatggcattatcttttcactctttacagaaaaatttattaccatattagagttaaaaagaatgcagctaatgaatataagaaaaacaatattatcaaggtatgtctaatagtaatcataaaggcatgtctaatagttaataatatcacattgtttttctggactttattatttagggtatttgccagcttttgcaattttataacagtatgattttttcttattcaaacttgatattcaattttgtacctaattttatatttataattttatattccttttcttaaaagcaagtgctcaggccaggcacagtggctcatgcctgtaatcccaacgctttaggaggtcgaagtgggcagattgcccaaggtcaggagttcaagaccagcctggccaacatggcaaaaccccgtctctactaaaaatacaaaaatcagctgggtgtggtggcacatgcctgtaatcccagctacttgggaggctgaggcaggagaatcgcttgaacctgggaggcggaggttgcagtgagctgagatcgcaccactgcactccagccagggtgacagagcgagatccgtctcaaaaacaaaaacaaaagaaaacaaaatataaaaaaccactcctcaaattgtataagcttcaggtcccacaaaaccttatatatgtgtgtgtgtgtgtgtgtgtgtgtgtgtgtgtgtgtgtgtatgaaagcgtaaatagtatatgtttttaatctttgtataaatgcagaatatatttatcactctgcagggttttatttttccttgaaatgtttccaatatttatcacgttgatacatatagaactctcattaatttcatgactacaacacaatattctcttttttattgtcattttggttgttcatgatttctcgctattataaatgacgctgtgatggatgttcttgtatatatctcttcatgtagaagcacaagaaaatttctggggtatatatctccctaggaaggaattgctaagccacacaggatgcacatctaccattcagaatattgccaacttgctctccaaacatgtagtacaaatttgcactcataccagcagactgatgaaccttccttttctccatattctcaccaactctttgaatttccagattaaaaaaataaatttcggagtcagaaacacaaatgacatatcgctttttttgcttgtctctgattaataataaagatagtcactttctcatgtgttactttttggtgaactacgtattcatgtcctttgtccatttttcatttttttgtaagaattatttctatattgtggctattaattatttgcagattatatgcattgcaaatatattctcctagcctgtgccttgccttctgtatgtatatgtagcattctttattgaacagatgattttaattttaacagttttattagtttcttttttaatggcttatgtgccttaagaagtctttcctccacaaacttataaagatattaagccttatatctttttaaagttttaatctttttttttcacacataggtaatcactccacctcaaatttatttttatatatgatatatgggatgaacttaattttctttttttctatatggataactaataggtccagctccatttattgaatagtgcatcctttccctattagatcttgctcaaccctcacaattttagctaaacaacctaacctctgatttattataaaagctaatatttactgtatatacaataataacatcacacttttgatgatgatggcatatgttaataagctatcttctcaggcaagattttttcatggcaagtttaccaaagctataaaaaatgtgcaatggaaaggagacaaaagatgtgtgtcattattaacaggtaaaaacacccccaaaagttgaggatcaccttaatgtaatgtgggatatacaccaagattggacaggccaacagttgtaaggcagttgtaaggcagcctattgatttataaattaccttctatccacttttggggaagaaaaaaataaatatctgcaagggcaaagattctttcatgcaacataacttcgtgaagaagtagttttaggaccgtaatcagattaaagttcatgatggctacagacgcactaccagcaggtctgtagaattcccaggaagcaaagggataggagcttctggggtttgatgtcattcagagaagcaaatgaagttagtgtaacaagtgttgcttccctacttctactctggaaagaaaacaggacaataaaggcttcgtggcaaatgtgcgtggggtggagtcaagctttagggaagcagcactgtttgcagggaagatgacctcactgccctcctcttcagttctggtatcatttttgggtgagctgaatccaaccatacatccctggtgaggggtgctctaaatggctgccaagatggcccctccagtgggcagcactgattgacaggtgctcagcaaggccttgttctccaaagcaggaagaaatcccgtttccttcagtggcttgctttttcttccaccttcctttctgccactttgccaccctagccttcctctacttctttcttcctctctcaactttttattaaaaaaagaaagaaaaatcccagcaggagttgttgctcctagttcccctggaaaagcgaaataagtactcagcaacaggcattaaatattcaggccttttgttaagaaaaaaatcgtcattgtggtttttctttcttgaggcccaggggagagaaacaatgggattttctctctccctcttccacagaattccctcctgagcttattctctggaggtcaacagatccttttcagccacagctcacttcaaaggatataaaagcagtagcttggctaggagacacaacccctttgccacaaaaactagccttggactctctggctgctcctgacagctccccctgccctggagtgctgccacactgcagagtctacccgccccaccgcctgacaccccgcacaccccccactgcagcccctccaccccctcccccttgactgagctctgatgattatttgagtgtatttatgtgtgtaactaccccttgtctcccttaccagactgatagattttttagagcagggataaagtctagctcaatataatccacatctgatccctacctagggttgatcacagagaaagtgctcagggagagatctcagcctgcctcacctgctgacatgaggcagaggctctcagtggttcagtcctttctcgctgagccttgcctgcaggcctcgaagaacatggcatcatttctaaatttgcctccaccgttcccttggccacatcaaaatctctagaagaaatgggagtgacaggtcaaggctacgagcttggttttttttgaatttttattttacttagggccactggtctgtattcatatataaacccaagtctttgctcttagggctccacttctataataattgcatttctctgtggaaaaattaagatggatactaggattgtctatgcatagtaaataacaacagcaaatatttcttgagcactttattctgtgcatggaactgggttaagtgtttttcacacaatattgtatttaatcctgacaatatctttttaagtaggctagtatctaaaatatctagtatctaaaaggtactcttccttgatgagcaaacagtttgagagaagtttagctccttgcccaaggtcacacagctggcaaatagtacattgtgacttcagactcagtctcacggtaaggaaaaaatcttttccatcttgaagatgtgattttccatatgtaacagtaaacttaaaaaaaattaaacctcagaaagcaagctaacttacaaaagaccttttttgttttcaagataacctggcaaagagctgtatatttctcctctcctgtccctgtcttgttctctttccttctgtctatagttacatttacacaatgccaaactagtggatcaaaacaaaaatatagtgacacccagatgtagagaatgtcttatgtgcatgccaccaggcttttggccaattaaatgaatctgaattttttatttgattttaaacttttcatccaggattgtggtccccctatggggctctaattctgtggtgtatctccctccaacaaacttggaaaaagttatgaaattgaagagggtgaggtgtgggtatttatatcaaagctatggataaagttttttaattttttttttctttttaagagtaaaacagggtctgtacacccatcaccatttttataaagtatttatttaccaattagtccacactatcaactggttgatttaatgatctctcacatgagttatgcataacttttattacttgagcctgtggagatgaagggcagatataaattaatgtggaaaatgtattgcttgtcattcctttaagaaaatacagttctcttcaactatctttgctgttcatgttttttcccccattaagtgtttcttggattttaggtaaagaattgcataagtgccagagaatactcatagggattaggtgttggattggacctttcgcacttgttaacgtgattaataagaccttttattgatctgtaacttgattcttaatagctacattatttcaaagggagaaggcaataagcttaagttaaaaggcaacttagaatttccaacattgccatcagccacacaagctgctaatgagttatttttaggctgtctgcctttgattctaacccataggagaaaaattgaaataaattttcagtagacagtaggtagttactctagaaatctgggatgcttttaagaggtcagctgaactgagaacctttccacctttgtgttatcagctcgtgaaatgcaggttcatgctattgactgttattcctctcatgcagcagttctcaaccttggctacacattgaaatcaccagaggagctttaaagaatattgatctgctggagtcccacctccagagattctgatgtaattgttctggggtgtggcctggccattgggattattttaaagttctccagatgactctaatgtgcagccaaggttgaaaattactgctctaggggcatgcacaaaaaggaaagctgataaataagtcttacacataaattccagcatgtcctcaggtttctactagcctaaataatgcatcccaggtgagtaatgtagtactcatagtaattctttgtgtcctgagccaagaagagtttcaggagtcacttgagcatgtcttcattttatgcagttggggaggacccaaaaaaagtatcagttcttatacccaactcccctctgaaagcttcagacagaaaaaaaaagcaacatggatgtgctacctgctcacctccacctcccgcctgcattgtagagccttgagctcttgcagaaccatcctcaattttttacacctttttgtagtttttcaggagtggacacactaggcacaggtactttcttggcctggcccccttgtgagatctgtgagatgatcagctagcattaggggtaccgtttgtgggcagtacaacagtccaagtgatcaggacacctatagctctggccttaccagcaacaggctctgaacaagcaataagtaaggaaatcgagtcacagttcttggagttggaaaccacttcaagaaatcacacagtggccaggcgtggtggctcacgcctgtaatcccagcactttaggaggctgaggcgggtggatcacttgaggccaggagttcgagactgacctggctaacatggcgaaaccctgtctctactaaaaatattaagataaaagtttgccgggcatggtggcgcgtgcctgtagtcccagctacttgggaggctgaggcaggccagggggaggttgcattccagcctgggccacagaggagactttgtctcaaaacaaaacaaaaaacaaacaaacaaacaaaaatcacacaagtgtttgttcagggaaagaaggttttattgtcctcagttaggaagcagcacctttggcggagtgaatttactaagcagtggagtgaaaactggaaactagaatgcagatctttttctagtaaacactatattataatccaaaagtatatctctagattcctttgtgtttggtctttgactttgtgggatgtagccatttgttttggttgccttagccctgtgacctaaagttcacaggtccaatcattttgcagttcctctgcactagactcaacagaaacataaggctcagagcagtaattttcacagcagcctggacctcaccaacgtgatttatgtgtttttacttggagaatatactttaatgctgagatttttctgattatctttttgtgtgcacccgctcaccacatgggctcttaatttagaaaatatttagcaattacatgtggagttgatactttacataaaagcaaaaatggtgcctgttatgtatgttactaaaaattttgatgtcttttatttttctggcaacagagatacatgacccaaagaaatggctcattatttttcattttctgtgagatgaaaagttcttaatttaaaagtggatctgcccctggaataaaggtcacatggtagaagttttcgttttagtggtcctgaagcctttgccaggcaccagagatactgctgtgtactcataaattttaattactgatggctgggagccaaatctaagtttgatttgaactaattctaaaattttgtgaaattaattttgatgtcaaaatcagatatcttggcagccttttagaacataattcttccagaacttctactttgacaattgattatccaaatatttaagagtttgtataaacaacactcaactaaaagctttggaactcaattcgtatggattttctccttttaatgaatgaatatgttggttttctctcttgccaagtctacccaatgccaacaaagcaagaatttcagcatttttgctgaagggtcactttgtgataagagaaaaattacataaacatctgtgctaccagttgtgtaaaagtgtagcacatacacatgtatattacataattttagataatgataatactgacttatgtatttactatactgtactttttattattatgccttctacttataaaacaatgtgtgctgtaagacagtatgccatgttatgccagcagcagcctcatacatcttgtgtttaccacatctcttgattgcatcattttctcttgtgcttgatttaatctcatgttgttttgttcattatggcccctaagtgtacaaaacttatggctaatgttgccagtaagaggccacattgagtgactgacctcgaaataaaagtgattaagaaccacttaattacaaaggtagaaagtcagtgatggttattgctcaccagtcaggtacgtcctattccaccatagctatgatcttgaagaacaagagcaaagtgatggaagttgttaagggatcggctttattgaaaataatgagactcacaaaaatgcaagaagggtctgtatcacatatagagaaacttttaatgacctggactgatggccaatcacagaagcacattcttctcagtaccataatgatcacagcccaggcagaaggtttgtttgcagtgtaaaagaaaggccagacctgactacagtgttgaatttactgttagctgtagatgatttaaacaattcaagacttgttattcactacataatgcaaaagtgagcactgaatctgtgagtgctgatatgaaagcagctgaagaatttttggaaactctagataagctgattatggaggaaaattacttgtcagagcaaattttcagtatggatgaaacctccctattctagaaatagatctctacatggacttatacatatggaggccatatggacaagtcaatgtcaggtttcaaggcttttaagaagaggataacagtcttggttggggggagtgttgaaggctacaaattaaaaccctttgtgatctggcactatgagaaccccagggacttcaagtatatcaataaacacacacaagacaggcttggtgactcacttctgtaatcctagccctttgggaggccgaggagggtggatcccttcaggctaagaacttcaagacagcctgggcaacatagtgagacttcatctctatacaaaaaaaagaaaaaaaaaattagccgggtgtagtggcacatacctgtagtcctagctactcaggaggctgaggcaggaggatttcttaagcccaggattttgaggttgtagtaagcaaggatcttgccattgcactccagcctgggtgatagagcaagaccctggctcaaaaaaagggagagggcacacagtgccagtgtactacaggagcaataagaagtcagggttgactcaactcctcttccaggatgccctcctgaattgctatgccagtgaaatgaagtaccgtttggagaataccttccaagattttgcatattgttgatgatgctcccacacagtcttcttttattgacgatctttatcccaacatcaaagtggcatttctccttccaaatatcacccctgacccaaccaatggatcaaggagttatagcagcttttaaggtctactgcctgaagaggacctttgttcaagctattgctgcagctgaggaagacactgagaaaacactgatgcaattctggaaggattataacatctatgactgcatcaggaaccttgcttgggcatggggtaatgtcaccaaagaatctatgaatgtcatctggaagatgacactcaagaggttcatccatgattttaaagaatttgccaacgttgcaaaaatcaacaaggctgtggttgagacggccaacaactttaacctgggtgtgaataagaatgagattgggagcttccagaagtgattcctgaggaattaactaatagttagttactggaactggaacaagaacatgtagctgaagaagaggcaagagaaaaggaaactacaggagaagatgaaaaaaagaagaatccccaagaaaattcagggtttagcagaagttttgcagacctcaagaagctccttaaaaagtttgatatcatggaccccaacactgaaaggttttcgataatacagaggatgttcgtggtgtattatctgcttacaagaaaacctataatgaaaaaaagaaacgaaccaagtaaactactatggacattatttctgaaaagagtgacaccacctcctcaagaagagcctcaggcaggtcctttaggaggtgtttcagaaggcattgttgtcataggagatgacagatccgtgcatattcttgcctctgaagaccttccagtgggacaagatatggaggtagaagacagtgatatagatgatcctgatcttgtgtaggcctaggttaatgtatatgtttttgtcttagtttttaacaaaaaaaagttttaaaagtaaaaaaaattttaaatagaaaaaagcttatagaataaagatataaagaaaatgtttttgtacagctgcacaatgtgtttatgttttgagctaagtgttattatgagtcaaaacatttagaaaatttaagtttataaggttaaaaagttacagtaagctaaggttaatttattattgaagaaagaaacaattttaaataaatttagtgtagtctaagtgtatagtgtttataaactctggcaatgtatagtaatgtccttcgcattcactcactgacgcacccagtgcaacttccaatcctgtaagcatcatttatgtcaagtgccctatacagaggtaccattttttatctttcatatctatttttactgtgccttttctatgtttagatacacaaataccatcgtattgtaattgcctattgtaatatgatgtacaggtttgtagcctaggagcaaaggctgtactgtattaacctaggtatgtagtaggctgtactgtctaggtttgtgtaagtactctatgaagtttacacaataacaaaatcacctaacaacacatttctcagaacattatccccatcatgaagtgatatatgcctgtatatacgtgatatgagaagttactttccaggacaaaattcttgttacagttactttctctaaacagaaccaaaagggataggagagtaaatgttttctatgggtaaaaggacaaagatttttttaaatgaggggtttctttctcaaaagttctatcttaacttttctccttatagtacaagagtagacacctaaggtggttggaagaaatggaaatactccttcatattttggttttacagccagcaaaatttcttattatatccccaccccaccctcacacccctacattaacatatttttttaagttacctgtaatgagggagccagaacccaccaaatgtacctcttctcacaccagctgaggctactttcttcaaacatttccttgcccattaccagaagtagtatactatatatgattgattgattttttttttttttttgcctcaaaactctctgaatctacaaaattcagttacctgaaagatcttcctttttgtattttcctgcatggaactgagctaagaaaaatctggctgaatttggagaagaaaaagtggtctgctgcagagaaacccaaaaggggagagtcggtggtggggtgctacacttggacaccagatttagaattgcctggaccatgggtcgtagtattcacagtggcttctctccctcaggccctctagggtgctgcagggagaaacgtttggccgcaatactctacactcacagtctctcagattttggctttgcagtgggatcttagagtcaattaccttgagagactatgtctcaatattcagaggccacagacttctgctaaaatgggctggagaagaaaaaggacataataacagatttgctctcaacgtttaaaagtgaacattatcaaagtgggcctttggatgcttgattacttctctctcccaacttggagctttatttttcccaattgcctcaggtgtaggtaattttttctttaggaaaatctattgacataattattaatttaggtttttgattgctctcctttgagcatcagcggattcctgtggacttaagagattgtacagtatcaatatgtgtctgcaacttcagaccttcacaaaggctcatctcatttccaggaggcctaaaactcttgggtgtctgtattaaaggttcatagaccctctagtatttctcatgatcatgctaaatgagttcaaactactttctctgagatcaaaaattaaaaatcaaagagatgtcagggttgtaaaccacaccttttcacattcaatggacaaaagagattttctgtgaaaatgtgaggttaatgacaaagaggttagtgacagcaaagggtggctaacacagtcatcagttggcaggtctagtgtagaaagggagggtgcagcagagcaggacaaagacttttttttttcttttgtggaaaattctcccacagattttcagccctgcaatcatagaactttagaattaaaaaggattttagtgattatctattccaaccctcttgtttcaggggttaggaactaaagcccagagcatgtgattggcccaaggccactacctttcctggttaactttcttaatgtctcttcccccatacttctgccaaaagaataatgtatatacagaatgcaccagtattacgtattgaacttaaaaacacattaaacttggtcgtagaaatctagaaccagctgcaaatgtttacttccagaagttcaaccattttgcaataaacatgcagttgcttctcaactcaaggcagtatattccattattaaacacgtactccataccaagcattatcttatacacattatcttattcaattcccacaataattctgttgaagttgattttttaattcccacctacaatgtggaaagtgaggtatgaagaggttaaatcatttgcccaaaatcccatacccagtgctgggattccaaccagatctacctgagccaaagccctcaccataaccatatcactaaaattgttctcgtatgtgccattctgttgatagaggtactttttgaggatgtttcaggcgtggcagggtagaaatatccctaaaaagctttatattattgtgaagttggtggtaaagggccaacctggcaatactaatgaggctgttcttcaaagacataggattcaagtgaaagtttctctttaataagaccattccctacaccctgggtgaagaggaaagagaaataaagatttgcagaattttggggcaagaagaaagattagaaagcctccccaaacacctcaataaacccatgagaaaaccacagcttagagaaattaagagccttgccaccatttctaggttaaaacaaaatgagtgaatgaattggccggcaaagagaagataaggcaattcacatttattgaacacttactgtgtaccaggccctgtccctgggtgctgtttgaatttcctttcctttcatctgtccccttcactgaccataaggttcatgagggcagggcagggatcatgtacattctctttagtgaagtatccttggtgcccatcacatggccatggtagatgctcaataaatatttctgactgttggaatacattaatgaatgaatcactcaccaactctagggggtcttaccatctcttacatctctttctctctgtctatccatatagatagatatagatacatatagatatatagacagatatatctatatctgttttatgagatagatatatatagatatctagatatctagatctatatatagatatatatctatagatagagattatatacctaaataggtagatagatagatggatacatagatacatagatctctagataaatctatttacatctctttctgtacatagatctgtctgtctatagcgagaggaggagatagatttctagaaagagagagagagagtgagccagtcttgctctgttgcccagggtggagtgtagtggcatgatcatagatcactgcaacctcaaattcctgaactcaagcgatccccccacctcagcatcccaagtgactgggactacctgagcttgccaccacacttggctaatttttttaaattattttttgtagggacaaggtctcgctatgttgcccaggctggtcttgaactcctgggctcacgcgatcctcccaccttggctttccaaagtgctggggttgcaggcatgagccagcatgcctggccgcatctccattttataaataagaaaaccaaggtgcagtgacccaaaacaacttacccaggttcatagagtttacctaagtcagttgattgcaaggtgcatagccccttgtatacatcagcacagaaaagctacatcaccaagctgataagcagatctgaatatcagctaacactggctctctcctgcctcttagcaagagctggagaacaaagacccaaatgaggtctgttagtcctaagatgttgttattattcacaatacatactgggatctacttatagtatgctgtgagacatcataagtaattaaaagagaactgcacatcttaaaataaatgagctctatacacttgaacatgaatgcagccttggccttccactgttttgtttccagctctctatgatgtgcaccttagtagtcattagtcaggagcaactgcaagattttcctatatcatgaaacatccaaacatttttcctagagaatctatgttatttcttggggctcgctgatattgtacattctgatattcataaagacactgtcaccaactgttagtggtgtcagcccagcattccttctcatccactttgatcatgttaccttccttcctttggaaaattataccctaacatacacactgtttatggttctgatggggccgtcaggcatattacactaaaccctggccagaactttgggtatgtgacccaagctcatctatccgaatcaactatctccctgatcactgtaattggtccagagtaggacaaatgcctcaagttaggcctctctgagactttatatatggctacctcttgacctccaaatcccatcctcctgccctgtcatttctaccaccaccgccatggccaagtagaggaaggctgtacgaagttaaaaaaaagtatcgtcagtgcatggcgaagctagggagaagagagcggagatgagagatgaggagaggagagactctaggcttgcaggggacagcaggagacagaagatacaggttacatgattttagtccctggaatacctgaagccagctcttctagtaagccagtgtttcctatgttgggtaaacacatttgcagtggtttctgtcatttgcagctaacagacatctaacaaattttctaatagcaaataggaattttaccacaggtttcaagggagagaggaacatgatggctaactttgtactgtgaattcattgcctgaggctggcagggcctgaacatcccacccagtagcagatgtgttgaggtagactgtgcttcaagctaagacttaccctttgtgtgcaaatcccaatcccatctatattccagtcaccacctcctccttgcagcctttcctaccttgcttttctctggttgttccaatctgcccaatgagtatgcactctttcccagcgcgcgcacacacacacacacacacacacacacacacttgttgctatcactttcctctctactttcctgaaggcggcaactaccaggtacagaaggtaatcattaaatcctcattggctgctcttgacccagctgaatttgtggtgtgaagaggatctaaggacagtgtcgtgccccaggcttctgagaaagaacctgtgcaggagagggacatagacatgggctctggagcctgatgatcacatctggctctgacatcgagccatgggatctcaggcaagtaagttacttacccccccacaaacctaagttttgatttctgtaaaataggaacggtaaccatcgttttgcagggttgtggtgaggagtaaaggtagtacatgccaatcacaccaggtagggggtgttccaaaaatgatagttcttgcactactgccttaactaaagacggccagatgattgatgggaatcttgtgggcactggagacataagttgtctggtgcagccttagatgaggaagactgaattacgaggtagaagccattattagcctcatgtctgtgctgcatcttcattttgcccctcttcttgtttactgttattctctaagtgcttgtttttgtttttgttttatgagacagagtctcactctgttactcaggctggagtgcagcggcatgaacatggctcactgcagccttgaacccccagattcaagcaatcctcccacttcagcctcctgagtagctgggaccaggtacacgcaccaccacgactggctaatttttgtacgttttgtagagatggggtctcgtcatgttgcccaggctagtcttgaaccctgggctcaagcagtcctcctgccttggcctcccaaggtgctgggattataggtgtgagccaccatgcctggcttctgagtgctttaagggtattccgagctatccaaggtcctccagctccaaagagcatgccatctgtgccttcgtaggcttctcttctcactgttattccaaccaacctttctccttgctcagccagcctaactaatgaatgaggcttctgtggttgcggttgctaaggaatccaccctcccaaatgtagttgcatcttagtgaggaccttttacagtcaaaatacctgaatccaggtgttttcaacattttcaccatctattacaccttttattattctctctcttgttgatgctatattttgaaatggatgtcttctcccaagggtaggatttgtttaataaaattaactttcccacttcattaattataggaatggttgccattagggcttaacccaagagcatgatacagtcaatgttaccacacagagtaagttaatttctggccaaaaggaaaaaaaatttgaagtactaattagcctgtttgtgattctggctgggtttgttgtaatacaacaaataattcaagtcccatcacaacctttctgaggggcacccctacctgaactcccccaaaagctgtcgcttcaggtagaggccctggagaggactggtccgtgagtcccttacctggtaggtggtccctgtttgactgttaccatttccagcccctctgctttctcctcaccagagctggcttttacctgagtttatctgggcctcagagtacaacgtaaaccgtgcagaacgatgtttctaactgttctacatacctacacattaccacacattcataattggacttgatttggccatgaaattccttaattctgactacatgttttctcccacccatgaggtttatagggggaagaacaactcatttaaataggcatctcttcctctgttctttttccaccctctgcccccaaaccaccactaccctagaaacctcccgctgcccccccagggcctagagaaggccctttaaggggataagaaatggtgcattttgtagaaagcaacctccaagctgaattaggtgaaagaagccattgttcttaacgcacatggtcaccagccacaggcctgtaaaataggcttagattccttcagaaaaggagtctctttgagcagcctagccccttctaactaggtgtactatcttcacctcttcttgaccctcatgaagttggttttctgtctacacatttttctgcttaggcgggaaaatatggctggggtggggaatctccgtttcagggatgtagtgccagaattctgagctgtccaacatttaccttgccctactctcagcatccctgtcttctttgggaaatctcactgtctaggtgggaagtaggctccatgttgtctctctcccactacggagccaccatggaacaaacccttgaaagagaccctgcctcgagagcagcctggccaacgtggtgaaacctcggctctactaaaatacaaacaaaattagccgggcatggtggcacacctgtaatcccagctactcaggaggctgaagcaggagaatcgcttgagcccaggaggcagttgcagtgagccgagattgcgccactgcactccagcttgagcaacaaagggagactccatctcaaaagaaaaaaaaaaaaaaaaaaagaagccctgccgagctggtgctcctcccagactcttcagccaaccaagcaaggagctgtggaggttggagaacaacagcagcaaggcctgtttgtattgcctggccctccagagtacccctggatcctgcctattgtccatgctgggttctcaaccctcccatcaattctatgattccctgacttccttccagtgaatttcctttttgcataagatggtctcagttgttcccaccctgtctagtggttaggggaaaaaaaagaaaagatggtctcagtttctgatgactacagtcatgaaccctaaatgattgtggtattatcctcaaggcgaatgaatcttctggacaagtagatataataatatctattattagtgcctctgttgccaacatttttggctctgtattctgctgtttattgctcacttaactaaaaagcttcacattctaatacaatgaattagaataagatggctagagaaagatcaggacaatatcagagtagggaacaaacaattctaaaagggtcaaagggtctagttgtgcaacctatttctcaacatagcacctaaacatcataattatagcatttggggacagctaaaatgattaattttccagaaaatatctgttgtttaattacaggatcatatgggtcttttggcaacgaacagatcccaaaacagactttaagcaccatcttgagaaacttgtgatttgcttagtgtgcttttaatttaaagcatatggtttcacattcaactgcagtgtccaaaatgaagacattagcaatgaatcactctattggagaaaacgcagtgctcctggaccaggtcttttggtctgtgtattcaaatggttctgtttagaggcataaacacaaagcagctctgcctgcttcagccggctgttcctgggattcatgagacatcaaagggcctcacgaacgaattcccctgcaatgcacagtgcttggcaccatggcctgcctccatctgaataaacagagtgcagtttggtcactggaaactacgattagaatgattagaaggccgaaaagatcatttattttgtgtgcaacttttcctttttgaatctctcagccttccagcttagtctgacacttcatggcccttggggaatccagctatcctgtgtggaaattcagaactgcagcctttatactaagaaccatgctatggctacaggccacagacccgagtccattgagaccacatgtggtctacctgctggtgagggatggcagtaaggacacagagtgtagttgtaaggatgtgggctctggacttacatggcccaaatttgtatgaacaagccatttcctagttatgtgaacttgggttaaggggtcctgggcttcagtttcagaatctataaaatggtaataacagtacaaatctttcagagttgttacgggaattaaatgaaattacccatgtccagagctaagctaagaatctagtacctcgtaagctataaaactatagttaaccattattgtaattctaattacaattattattagaaataggtccttcctctttgcctcaagtcctttcatgcctctgtttaaattcaatgcacatttaatgaagtgcctactgcaggtcaggcccagtgtgttagatacatacttctcagagtgctgtatggcttgaaaaatagcttttgtgtttctctgttcattttcttcagtgtttccacccatcctgtcttcatttcaccctacaagacattctccctcactcctcattgtgttcctagtcattctctatctctgtaccacccagtagtaaggactacatcaagctaaagcatagaatactgttcgtactggtagcacccatttgacaatactccaggcagttacatcaaaggagaggcatttcagaaggtgtatacaatctgttttattttccaaagagagctctgggtagaaaatctattactccccaagatttgtagtagctctttacatattaggcacagtaatctgttgtcaaatatagctgttacaagtattttctttctatttatcatttgtttgtttttaccgttaaaagggtttttttgccgtaatcccagcaatttgggaggccaaggcaggcggatcatttgaggtcaggagttagtgactagcctggccaacatggtgaaaccccatctctactaaaaatacaaaaacttagccaggcatggtggcgggcgcctgtaatcccagctacttgggaggctgaggcaggagaattgcttgaacctgggaggtggaggttgtagtgagccgagattgtgccactgcactctagcctgggtgacagagtgaaactccgtctcagaaaaacaacaaaaaaagttctttttgatgtgttcagctcaatattttagagtgcttgcccttagtctcaggcttagaaaaatctttcccaccttgtgattaaatattcacccatatttgcttttatcattttttaaattttttaatatttagatttaatacaaatatccttaaaatgtttatctttatctaggatttatctagaaaaaattattaaattcataagtcagccataattgttgattattttcccttcctggagatcttgccttgcttcttatggcagtgatggctctgggaaggcactaatgaaggaatgcaaaaatggtccactggatgtaaacaatagagaactctgaagataagcccttccttgttgttgttgtttttttttaactctgcaattattagtttattagtatcttctaggactcagatgttcagtattcctcctgaaattacataaacaaatccaaatggaaataatccaagtcaaaattacataacaaaacaacactccatcacaaaagcacgtaaaattataagaacgctattttagaatactggcacttcaagaaaacaataatctcgaaaaccacaaaattgccaaattgttccctaaactgctaggcagataaacgtgactaatgaatgagtttgggttttgtaaagaaaaatcattcaaataaattgaataattcatactgaaatgcaaagtttaagtgtcttccttcctctgatctacttggatttataaaggggcaaaccataatatgggaaaatataccctattttaaaagctggcccaattaattaaaaatacttttaatggaaagtctcatttcctgagcagtccatatttagataaatgggaaaagacatctatagccagcattttcatagtcttcactgagactaatgtccacaaaaaatttaatttggcagtcttatattctaagctcatgcttttggtgatacattctcaggtcttctttaatgtgggaactgcaaaatatcactgccattacatggtaatgggagttaaagaatagagtcctcatgtaaaggataaagcatacttttctattagtcctttaaggacagactttgaaaatgtttgcttctaataatcccatgctgtgagtagattgattacttatcagtttgtaaatataagtgggctatgcgaaatttcttaactgatcaagattttggattttcagttacagatgaaaactgtctcaacttaactttacccccattatgatatgcagggtgcatagacaaaagctttttattagctaactatatgaaaggataaacactgtaataattcatgtgattcaaaatgggcaaaagcttcccctcaagaagaaaaatttcagacctatgaaaacgacaacaatactaataaaaaaattgtatttacttcgaagcattcagaatgtcaacaaaacagctgccactttttattttgtaattacagagtggtattcagttaacagaacaacaattatttcatataagctgcatcagagacaactaaagatgaaaaactaccatccccatatataactaatttgtgctgtgcaccaacaagaacctgctttaaatttccatgccagtttataacccccatactgtaccaggcaaggttagtggctattgaaaataccaccaggacagggctatctaaagacacatttggtagtgtgttaactgtacaaaaaaagacactgtacagtgtaaaaacaaatcttacacagccttacattttaatttttttatttaaaaggagtgagttgtgtacaggggggttaaatgctttatagacaaggaaaaaaactaggctagaaccaacttattcatcatcatcttcttcatcttcctcctcataatcctcttcatcttctgtcctcctcttccttctttttcttgcttttttcagccttgacaactcccttttttgctgcatcaggctttcctttagctcgatatgtagctgtatcctttttgtatttttccttcagctttgcagccttcttttcacaaagctgcttgtcatctgcaaaagtgttattccacatctctaccagtttctttgcaacatcgctaataggcaggccaggatgctctcctttgatttttgggcaatactcagagcagaacagcaaaaaggccgaaggaggcctcttgggtgcattggaatcctcgaacttcttttttgtctcccctttaggagggatataggttttcatttctctttcataacggtctttgtccacctttgccatatcttcaaattttcctttatctttagcagacatggccttccacctctctgagcacttcttagaaaactctgagaagttgactgaggcatctgggtgcttcttcttacactcctcccgacaagtttgcacaaaaaatgcatatgatgacattttgcctctcggcttcttagggtctcctttgcccatgttgagttatttttcctcagcgaggcacacagtcacccagtgcccgtccggctctcacttgccccggcactgtctctgtggagctcaatgtactgcagtggctgtgagagtgggagccgggcatagcctcctcaccctctccactctgtaacattaaccttccttgtttttatatagtttaatgatttgtagcaatatactttaatagcttagccttttaatttgggttttctgctgcacttataacaaagttttgaatgcagagtgaatcactgttaataggatttgtcttctcaagtgtgctagggcaggaaaaaaagttaaattcactcttaggtcctttttactttttgcttctgctgttcccattccagccaaggctttcctcacctcagttggactattataatgtcctttttgattctcttctttccctctctcctctaaattattctgcatgccactgccaattactatatgtcatcctcctgatcagaagctccagcgtctccccagagcccatgggataaaagacaaaatctttaagaatgacttctgccaggcgcagtgactcacacctgtagtcccagcactttgggaggccaaggcaggtagatcacctgaggtcgggagtttgagaccagcctgatcaacatggagaaaccctgtctctactaaaaatataagattagccaggcatggtggtgcatgtgcgtgtagtcccagctactcaggaggctgaggcaggagaatcacttgaacctgggaggcagaggttgcagtaagccaagatcgcaccattgcactccagcctgggcaacaagagcgaaactctgtctcacaaaaaagaaaaacaaaaaacaaaaaaaaacttctaaaccttcataaactttattttcctaaaatctccacttccctgcccctgaaatcagtggtgatactaggggaaggcctgtgggcactttaagcaccctcagaatacgttacttaggtccatgaaatccacgcccccccaaccccatagaagtcttagtattgtttgaagtggaaaatattaattgtccatataagtgtgaaggaaagcatctttaggaaacattgctattttgaaaaaaatctagtggcatattatctaagaaaatacaaaatactatgcatttgctatataagccatttgatagcccataaaatatttattttattctaaaagattgtttttctaaacgtcttaaaactttcgtatttttttctcttctcattattcctgtggcattgattagtgtcactgatatccccagatttcatagatgaaggagtcacacaaacatcagccaccttttttttactacaaaacaggaaaacagtagttattcccaatccaacagtctttgggatttaggatgacagttgtctacttcatattggttaaaggttttgtgtgtttttaggcaaaggttttgtgtaatcattcaagaaaatttttggtttggttttaaaatgcttaggaaaacataaatattcatcagtagaaacttgttaacataatggcacatccataaaatggaatactatggaaccatgaataagaatgacatagctgtatcatcatggaccacataacaatgttgtgatcaacaatgaaccacatataggatggtggtcccgtaagattataataccatatttttgctgtaccttttctaagtttacatatgtttagatacacaattttttaccactgtgttataattgcctacagtattttgtacaggaacatgctatacaggtttgtagcctaaaaacaacacattataccatatagcttaggtgtctgatagactataccatctatgtttgtgtaagtacactataggttattccaatgaagacaaaattgtctagtggcacatttctcagaacatatccttgttgttaagcgatgcttgactttatgcaaaagcctccatgttatattgaaatatgaaaaaagcaaagcacagagtgtgtaaatatgctcacatttgagggttttgtttttatttttatttttgttttacaggcaggagatgtagccttagaattgtatgtatatagaatagttcacacaaggtagtgatggcaacagtttcctctggagcaagggctagggttctggggaggacttatttattctataatcttttgtgctatttaactttttttctttacctaaagtgtgtgaattttttcaattaaaactgttaattaaacattttaaaaataaaatttataatgaaattttaccctcatttaatgacccttaagctaagagggaagtgaactgtatcaacagatacagaagccaaataggtcagcacttctgagttagagaggaacaataattctttctgaaataaaagaacattcttcagtgactgcatatcattcagaacttaagcaacaaaaaaagacaaagtagggatagaaaagctataataattaaagcaacccaaacaatttccttccagaaatgtgggaaaagaaagaagagaaggtgacccttaaggaacatggtatttcagaaagaggccacacaatgcagttgtgcacatgtatagcaagttagctagttctcaagtctccatttttgctgatggtagaaaacaatctggtagcttccaggtaaactcagtcacttccaggatttttcacagtctctctttaacataaacactcagttaatttaggcttctcctccctcacccttcttctcttatccccttcttagccaaattttaaaacattttttactgtacctgttatctgtatttcccactagagaacccctttgggtcctaccgctctcctgaaacacattatcagggttgccaaagacctccaggttgccagatccagggcatcttctctgtccttttctcattccgcctctcagcagcatttgacaaggctgacccatggttttcttaaaccactctcttctcagcttctgtgaagactcacccttctggctttcccccagcctcatggctgctctttgtttcctcccaaacctctaaatgccaggggttcctcaggcatcagagaaccttttttcttctccctttacatttattctccaagcctgaaattccagtgatgtgttgatgatgccccagttcatatgtccagcccagattgtttctctggatttcagacacacacagagcttcctacttgatatctccactcagatgtttccagggtatcctgtgcttagcatgtccagaactgaactcttgatcccctcatgtcttgaaaaccttagtcctcccttggtatttcctgttttaataagtggcatcatgtttggccgggcacggtggctcacgcctgcaatcccagcactttgggaggcgaggtgggtggatcacctgaggtcaggagttcaaaaccagcctggacaacatggtaaaaccctatctctactaaaaatacaaaaaaaattagccaggcttggtggcgggcgcctgtaatcccagctactcgggaggttgaggcaggagaattgcttgaacccaggaggcagaggttgtagtgagctgagatcatgctactgcactctagcctgggggagagagtgagactccatctaaaaaaaaagaagtggcaccaatgtccacccaaggatccaagccagaagtctggaagccattcttgctggtctcctttccctcattttccacatccagagcatcaacaagttctgttttgaccttctgaatacatcttgattttgtccatttctcttcctcttcactgccacaaccctggtccagataaccatcacctctgacctgtagtagcctcctcactggtcccctcacttcccctttgtgtcagtacgtatatgggactcccagcagagacagtgatcagcgttgaagaaataatctgcttcgtgtctttttcttcacattttccttccatagcttcccattgacttaaaaaaaaaattcaaactgcctccctggccatcaaagctctgtatgacatgtccatactccatttcttcagctttacctcacatcatgatccccttcctcactacattctagctacactgggcagatctgatctgcctccgggacatggagatgccatttgcattatgctgtcccctcagcctagaacacttttctcattcttcaggcctcaaccatcaactcttcagagaggccatcatccaccaccatatccatgagttccttttactctgtaattttgacttaaaacaatctattcatttcctagcctgcaattattgtttatagttgaactccatcactagaatgaatgaaatctccatgaaggtatgggtcatgtctgtcttgcccacctaatacattcctagaaagtgacacatggaggacattcgatcaatgatgagcattgctgtggatttaggaatgcgtaaatatttgcaacattttctctaactctgctatgatgttccttataaaaataaaatacaggccgggcacggtggctcacacctgtaatcccagcactttaggaggccgaggagggcagatcacctgaggttgggagttcaagactagcctgatcaacatggagaaaccgtgtctcgacagaaaatacaaaattagccaggcgtggtggcacatgcctgtaatcccagctactggggaggctgagggaggagaatcgcttgaacccaggaggcggaggttgctgtgagcccagatagcgccattgcactccagcctgggcaaaaaaagcgaaactccgtctcaaaaaataaaataaaacaaaataaaataaaatacaagtaataaatatactcttctcttaataagtaattatcatctgggaggaaaagcattcatgagtagaaacttatattcctattttctcagttataataagtcaaattgtatgagattgttgctattagatagtttgttactaccaaacaacaatttcaaaaggtacaaactaataaagtgtacatatttagtttaagctgtagtatcagttgggatagattagattatgatgcagaaataaacaatccccacaacttcgtggcttacagccacaaaggtttctttcgcatttgtgctatactacatgggtcagctgcggctctgctctgtgtcctcttcactccagaccccaggctgatatagcagttttcatctagatcatcctgggggttatggcagagacttggcaaaccacactctagtttctatctacaaagacacatacccttttggcccacatttcactggccaaaggaagtttcatgaccattcctgaattcagcagtgtagagaagtgaatctttctgctgggagaggcacttcagggataggaacacaaatatttagtgtaaaagtaatacagtctatcacagttagcctgagcagctactgttttcacctggtaatagctagctacattttagttattaatatatatcctagcagtaaataggactaggcttatgccatttagcctattcataaatgcaatattatgtggtaaaaatacctacattagtgttctgacctgtatttagcattttataataatgtaggtttcttttatttagtagacgctctaggtaaaggaacaaagcttgtagaaatcaggaattctaaagtataatagaaatccctctgctttgcttgttgatttgaaagatatgttttgtgaaggagaagtaatataattaggggtcactgactttcgatgttctgttttaagtttgtacacttttaaggatacctatagacaaaatccagaaatgcttatgaagttgcctgaaatttggggacaggtacacttctggaggtttcctattctaagttaattccgtgatgtaaagaatagttacaggcgaggcggaggttgcagtgagccaagattgggccactgcactacagcctaggtgacagcatgagactccgtctcaaaaaagaatagttacagacgtcagaatggtttgggagcatatgggttctggggtaattttattacttacttgctatgtaccttctctttctacaagatacagatatttatatgtaagtgccacagacttctgagtacagttcatgggcaacaaaagaactgataatcaattaatagacattaaaaggatggtgctttgtaagcattactttgacttcccagtgggattatacaagattgaaggatccaaaaggcaaccaagagaagttcccattaatgataaacagcatttctcttatcccctcctttgcttctccagaggtggcacttcagattcttgttaccgtttacatgtcctttgcatagatgtgctcagaacaacatcacccaataggaaaaaaaaaaacatacaactttgctcgtggtcccagtatgcttcagctggcttattcaagcccaaagagagagagagagagacagacagacagacagacagagagtatgtgtgtgtgtgtttcagcacttccagcctctcatgaaattaaccattgatctaaaactgagagatgcaaatccagagaaaactggaagcagtccagggcccacaatataaagttaattacctaaggaaaactacaagaaagacttttgttttccatcaaaatctcctccccaggctgttagctatgtcgtacataggcccaatcgatatattagcgcttgagaaccaaagtcccttggaataaattaatctgtcagggaaagaaataaacaaagaacaagttaacatgttttaagacattgcttaaattttcataaatacagaccttgagatgggatgatgagttcccaggagccaaagctaatatttggttgtaattaagagttgctctttcatgtttcttctgatgtaggtgggaaatcacccacgtgcttgctgatttccttgcccatgttccttcacaaatgccactgtttacttcattaatgagaaatagatgcctcacacattatactggcatacttagcttgtttcacctctagctaacattaacataatggaaaactgtacacaaatatacacactcacacatatacataccacacacacacgtacatgtcatacaagcaggtattccttcaggaatcgccatacatttttagtggctcaaaaggacctaatggcctaatacatgatgtactagacccatccaagatgttcataactcagacctctgttgctaacaatccctatgtgcccttcactgtgtgcaggtgtggagggaaattgctgatgattagcaggaagagagacaactatgtaagttacttatgtgtaaggactcatttaaatacaagaaccagaaaaaaaatctatctcaaactagcgtagaccaaaagacaatttattggggtccaatgatgtcattaggctgctgtttctttctccctatggttcaatgctgcttattctcagcaggtgacattatcagtgctggtaaggtggccactgccagccctgagcctatatccatgaagtagaactcaagatcccgaaagacaaagggctgttcctcttccagtgtccatatctcagatctcctagaggaacttcagccctgcctgggtcctgtgcccactcttgaactaatattaatcactctgggtggggaaaggggggccaggccctggccatgtgttcaaattgatttggaaagaggcagactggggagatcagccacatccaaatgcctgcaaaggaaagagaagactctcaccacagcagaggggtagagatgttagacaggtcaaacaaccaatgcccacctcaagaattttatttccaaggccaggcacagtggctcacgcctgtaatcccagcactttaggaggccaaggcgggtggttcacgaggtcaggagatcaagaccatcctggctaacacagtgaaaccccatctctactaaaaatacaaaaacaaaattagacgggcatggtggcgggcacttgttgtcccagctacttgggaggctgaggcaggagaatggcgtgaaccccggagggtggagcttgcagtgagccgagatcatgccgctgtactccagcctgggtgacagagcaagactttgtctcaaaaaaaaaaaaaattttatttctagtgtattcatcatgttcaattgctgaatgagctgatttacagaagaggccaagatagagatccttatgtttacatagcaagtccaagctctgttaacaaaattgattaccctctatcaggcagtcaagtaattttctatcaagttctaaacaaaaactcactataggcctttaaaagctgacatgagatacctacatatgtttcttttcccagttatggtagctttctcaaatgaatttaaataacttcctacttcccactacatcctgcttgatggaatgtatctgtgctaattatcttattacttactattactaaagcatacccaggaaaaaccaacagagtacagtactttttatcagttgagaacttttaaaatgctaatttctgtgattgcataatttcataactcagcactcttgaggatttcgcatttgggtagtagatgaaatttgaattgtttattttgatgtgagatgcttgttctaattattgagcaatttatatattgtgaagctagtttatataattctcaatacatggacacagagctggaaatatattaatattctccaaagctatactatcatggaaaagagaatagtctctgaaccaagtagttgcagatccatgagaccagaggagccgttgagtctgttcttttcgggaagcaagataagcatggctggtgctttattaacctccatgtaggattcagatttaccccagtgaaaggcatggcaaattcatcaggactacaaacaaaccatgttctgagatggatgggattagcaggtcagccccctcggcaactggaggggcaccacctagatccttatgaagcggagatttggcagattaaaaacactctgcctcaaaattacttacataacatccatcatgtagaagcagtgtgtttaacccatgattggggtaatgtttttaagtaaatattctatcaacaatgattgggcttttttgtttgtttgtttttttaaagggcaagggccagagtcattttggcaaaatagaatccccaaagaccagcccctggaataacacttattgcagcaaagcttcacgtaaaatttgtaaaatgggtatgaaaaaaaatttgcacaaaatgcgggtgttgaggacagtggggacagtggggacagtgggaattctacagattggaaatgaaatcaggagtagttcagtgttttctccttgaaagttatattcctggggatgggagaggaccaggcaggagaattcaaaagcctcctactactgcattcaataaaataaaaagaagacagcatgttaaagagactagcaataacatttcataaatctttgaaaatagcaaccatgggtatagcacaattaatttctatacaccatctctttttcatagggaacttgtcagtttctccctccctagagcttcagtgaggagtttatggctttattttgctttgttacaagtgaatagactgaagcagggtttttcctcctgtgtggacctacatccaaatgtaggaacttcacagatcaatttttgaatcccatttcctccttggcccaaaaatgcttctcaaaaaatagaaaaattatgttgtctgtagtatcctaatggatctccaggccagttctcagggacactgagtcctattcatagaacaacagtggactgcctggccacaccttcccttgatacctgggcatgataggagagcctggactcagccaccccttccctaaaaatctgcactcccaccagttagcataaactaatgcattgtcttgtctgtcacctgttccactctttggtccagctcccatgaacccaaacatttcacaggaaagagcatgacagggcaggccaaccctggtggtgcaagggccattcctagtgtgtgtctgcattaaggggtttatgtgaggtgtcatcagatcttgggaaaggaagcttggcagcgccagtgctcagggccttatggacagcagggctagtcattgtgccctgacctatgattcctttttttgtgtaaataacctctatcactttctaacattctatatgccactcttacttattacccctattgtttattgtgtctgcccctcattaactgctaaactccataagggcagagatctttgttcactaccacatccccagtgtgtagaacaaagccaggcacagaataagcactgaataaaatcaaatgagcaacaaggaacagatttcaccatcagggagaaaaggagtctgacacgctgacccacacgtaacagtggaggcaggagttagagggagtaaggattctgggtgcaacatggcaatggatatttgcgctcattttaccttacctagcctagtgcaggtattgcatggaggaagagaccatgcttgtgaactagagagaggctttgttaaattccctaatacttcaggacaagcaaccttactgtgcagctttcttagcagagcatgacccacggaagatgtctcctttttcactttagaaagactcaagcactgtctttttgaggactataagctctcacagattgggtgcatcagaagcaatctgtccctggtaagtggggaggcctacgcggagcactgggaccaggggcaacactcagcttagggtgtggactggccatcctgagcaggcgactctggtaatgcggaaagcagggccatactccagtctctctcaccacccacctggagctctgcaggaacttcccagctaccctccagctttcacaaactattctgtgtaccaacactagatcatctctattaatctcactcactctcagcaatgacttttcagaagcatgaaaacaacctcccatcaacttctggtttggagtgctgaacacaattcagcctgccagctcttagttcccacccctacctgcaatccaagttcacactggcactgatgggacttcacagaagaggttgttccatttgatatcttaagtctatgttgaactctgacgcacacctcagtccttccatcctctacccagagcatccaagctccacattaatccttccttctctactaccacacctgagattctaagcactactgctaaaaagcatattaatgcagattgatgccactcacaaaatcatcatctctagtcctagctgggcctataacactctcccaagtccgagtcctgtgatggttaatactgagtgtcaacttgactggattgaaggatacaaagtattgatcctgggtatgtctgtgagggtgttgccaaaggagattatcatttgagtcagtgggctgggaaaggcagacccacccttaatgtggatgggcaccatctaatcagctgccagtgtggctagaatataaagcaggcagaaaaatgtgaaaggaagagacgagacaagacgagcctcccagcccacatctttcacccatgctggatgcttcctgtcctcgaacgtgggactccaagttcctcagttttgggactcagctgactctccttgctcctcagcctgtagatggcctattgtgggaccttgtgatcatgtaagttaatacttaataaactcctcttaatatgtatatcctattagttctgtccctctagagaaccctgattaatacaagtcccgaacaagctcccactcccatccccttctgcattctatttcaagatttcatccctctcttcaatcctcgtgctctctctcccacctcccctacccctagggtgtagtagaagcaatggggcataacaaagggggcatggactttggtgccaaatgaatcctggctcaactctctgctgcttagttggataaacctaagtgatttatttttttctgcaaaatgaggataataattctcaccttgtaaggttgctagagtattaagtgagataatttatataaggcatccagaatgccacctgacacaaagcacactactcaacacatagtagctgttatgatggggatcatcattgtctgcagactatctggattcctgggctctctttggagtagagagaggctgcaaggtaggaactccctttacttcctactgggatttccaaatgttaaatccagctgcacccatcatgagctgaccctgccatttccacaaataagttgctcttccttctctcaccagcacttactcctctttgctgtgctcttaaccagagtttctcaaacttaatgcactcacagatcatctggaaccttaatatcagattctgattcagtaggtctggaacagactgagatcccatatttctgacaatctcccaggtgatgttgatgctgctggtccaaagcccagcatctatagcataaggctttctatcaatcacattctgtcctgctgcaccaaggccacaactcccctcagtcctgactctcagagaattcacaggccctatctcttctgtctttagaaagttccctcccagcatgagccctccacctgttgctctcttctccactcttcacagcctcattccttggaaggtaactcttactactggcccttcttcacctccccctccctcccttgctcactaatctagcttttgcctccaacacagtcttgaaactgatgttatttaatgtcacagttactttctgtttcttacattaaatgacctccctgcctctctgtagcattcactactgtggagtccctccctttgtgtttcggtgtcacactttcctctgttttgccccctgctctctgatcctgccttcacatgtgactacacttgaaaatcccacaggtacctaaaacccaacatatctagctctagacgtatcttcctccctcacttcaccacacatgtttactcagtacctaccatgtaccaaacccacttctaggcactgaaggaaaagctgtaaacaaaacaggcaaaaatccctggcctcatggagctgacaatgggaaagtcagacaagaaagaaaatcacttgtatagaaggtgacacctacaagtcaggacggagggatagggtgtgctagaggcacaaagctgtctgagaaaagagctttctaaagagggaatggccagtgccaaggtcctgaagtgagagcaaagctggtatgttccagaaacagcaaggaagtcagtgtagacagagggaagtgagtgaggggaggaggaggaatgtattcattatctattgcttcttacaaattacaccaaaacttagtggcttaaaacggcaaacatttgttatatcacagtttctgtgggtcaggaatctggacgcagattagtattgcaggatctggtcagcagcccacaatgcaatggggctctctctttgttcccaggtgtattggcaggttgagaaataatagacacacacaagatagtgaaagctgggtccagggggttcactgccttccggtcccatggtgccaacaatgcactggatataccagcgtttattattaagtttagtgagggtgggggtaggttagtgagggatttagggtcatttgattatgaggtgagatggtcacatggggatgaagtaattctttcacataacatttgtatgtagaagtacagtacatttgtatgtagaagtacagtatagagagataagaatttacaatatagtgtgtgtgtcagtaatttctaacagagccttaaaacagaaacacaatctttccataacctatgattagcaagatattaatcagcagtaacaattgcaacaaaagctggttacaaacaatccatggaaacaggacgtgaagctagacaaccggttagaccagaaattcccagaagggagtatgccttaaccctaaagaggcctagaagagctgtggcaagatgagggcgtttatagccctatcttatccatacggacagccacctccccatgcatccgtttataggctctccacaagggtcgcattccattcctagagctatgaacatctgcctttctaggataggaatcttggtgatgtgaaacctccctgactgcacgtccattcataggctctctgcagggggaatcacatcacgtgcagttggctcattctggcagtccaacctggcattgtctttacacaatcctgcatgcaactttgtatttacaataatcaggagcatttcatcttttattccatagcaacagtttcagggggtctccttacatctcccccttctctctgatttaaatgaaccatagcaatcatagcttggcactgatcacaattggactgaagaatattttttccaattttacacatgaacaataaaccaatagtacaaattatacacagaacaaaattaacgatagtggatcctcccaaagattttacctattgaatggggttgagattagataatccctcagagataccgtctaaaacttcagcaccgggtaaagcagttaagtgtgcttgagaggcctcaaaaatctgttcttttagtttgcttatgtctaaagctttaaattatcttcacttccttgtaaatggcattttactgattcccaattgtgaacagactcattatattgaaatggagttatacaaaaatcagaagtattccaatcacattgcatttgtaatctatgttctaaactcataattctacctcccatccatataacagtttgtcttagatcattaatttgattagccaatttttgatcaatacctgagaattccacatccgagtagaatttttttgccatttatccacaaaatgaacagtttgaatagatggacgtaatgcaactccagcagtagcagcaatcacagtaacagcaatcaagcccattattattgcaattaatgtaaaaataaattgtttactccttttaagaattttctatagaatattgttaataacatggataaagggggaagattcccaaggcctatgtaaggctacagggagccaaatatcttgtctggctctgactattaaaatactatgatattgattaaaggatgagtcaatacaagtatacaagtaacaattaacacaggtaattatgttggtttttgaactaatatgcaactttcctgctaataacatatatggtggtttaacacaacttttaagtggtatagttttgttggactccatatagagagtatatacattttgaggtgacaaagtggatttacttataacactttctccagcccaaactctcataccagtcatagctattgttaatctccataatttggaatgttcaggtcctatgtggggaacaatgagccttggctttggaggcgcaacccctgcccctttccacttaagaggaaaaaaggagttaaatctacgatataataggggagggctgtcactacgtttttgataagtaatattatagagaaaatgttgacaatctctgtgaccttgagagcaatcattagtaatatgacctttaggagcccaatcaacaatggtgtagtgagaagaattaaataacacggttccttctgagctaacacagtctttccatattaattttgtcagcatttgaagacaagttgagaggacacacaggtctaaaggcttatattgggatgtgtgaatataatcagtgattactgttttgatctgccttagaggttttaatgagagccctgatatcaagtgtcctaaaggagggacagagtgaccagacggtagtgtgacagcccaagtttgaatatctaatgagagacatacattagtgggtcccaggcagaaaggtggatacctaaaacctaaagtgatattgaaaggggttccttcttctgaaggttgtgcaggacaacgatcatctagagaaccaggcatccaaatactatcattaacatagacctcgataggagcatccatccatgtcacggctcgaataagaggaggaaaaggaatataggcccaatatgtatagtttttaacagtctgtggcgtaacagaggtagaaggatcagtgtcatcaggaggaggcagaggttgagccagacctggatcgctggagacaagttgttcaggatggctgtctggattgtctgttgtaaaggagttagcgtggtcttttcttctttttgatgattggatgtgttagttgtttcctgctgtggtgctttttcagcaaatttctctgtctcgttgttgcatgcatcttcaggatctggtcagcagcccacaatgcaatggggctctctctttgttcccaggcagatcagcaggttgggaaataatagacacacacaagatagtgaaagctgggtccaggggggtcaccgccttctggtcccatggtgccaacaatgctctggatataccagcgtttattattaagttaagtgagggtgggggttggttagtgagggatttagggtcatttgattatgaggtgagatggtcacatggggatgaagtaattaacataacatttgtatgtagaagtacagtacatttgtatgtagaagtacagtacatttgtatgtagaagtacagcatagagagataagaatttacaatatagtgtgtgcgtcagtaatttctaacagagccttaaaacagaagcacaatctttccataacctatgattagcaagatattaatcagcagtaacaattgcaacaaaagctggttacaaacaatccacggaaacaggatgtgaagctagacaaccagttagaccagaaattctcagaagggagtatgccttaaccctaaagaggcctagaagagctgtggcaagatgagggcgtttctagccctatcttatccatatggacaggcgccccacccccatgcatccgtttataggctctccacaagggtcgcattccattcctagagctatgaacatctgcctttctaggataggaatcttggtgatgtgaaacctccctgactgcacgtccattcataggctctctgcagggggaatcacatcacgtgcagttggctcattctggcagtccaacctggcattgtctttacacaatcctgcatgcaactttgtatttacaataatcaggagcatttcatcttttattccgtagcaatagtttcagggggtctccctgcagcttagctgggtgcttgtggctcaaggtctgttgtgaggttacagtgaagctgttggccagagctgcagtctcatgtgaagtctcagtttggggacgagggttggggatccacttccaagctcactcccaaccacgtctctcaccacatgggactctttacaggactgcgttaccatgtggcagctgtcttcccctggagagagtgagagaaagcacacaagatagaaaccacagtctttttcaaacctcatctctaaagtgatggcccatcactgctgccatattctttttttttttttttttttttttttttgagacagagtctcgttctgttgcccaagctagagtgcggtggggtgatctcagctcactgcaacctctgcctcccaggttcaagcaattctcctgcctcagcctcctgagtagctgggattacaggcatgcgccaccatgcctggctaatttttgtatttttagtagagacagggtttcaccatgttggccaggctggcttgctgccatattctgtttattagaagcaagtcactaagcccaaagagaggtaattaaacagaatgtgaataccaagaagtggggatcattaaaggaccaccttagaggctgtccaccataatatgaggtaaggcttataaggactttggcttttactccaagtgagatgataaatctttggagggtttcaaacaaacaaacaacatgatttctttgctttttccaaaccaaaaaaaaaacacttcttccttaagaatttcatacaaatacctcagtctaacattccaggcaaaactccactttgcttttacagactgtacttccatgacacataacaggctgaggccaattaataagagtttactgtactggttaagagttcaattctagagacagagtgcctgagctggaatgtcagctcctcttccatttattaactatattaggcaagtcatcaaatctctctgcctctttctctatagatagtgacaataattgtacttttgtcaagaactgcaaagggtctgagattttaccctgcttgtaggctaacaagttagcctgccccatcttcacagaaactagcagaaggcatgagattcccatgtcagagacaaaagacttgattattcacaagacagtaggcagcatgagcttcatgttcccattggttacccttgtccccaaatcccatggggtagatggaaaatggcccgggtagatctgtgcacacagtggatttgtgtcactgttgaagaaccctgagcttaggaacctttcagtctcgtaacaggctgcagcaaggctgcccaccctttggcctagagggagacattttctttattatcctagtcaggaagcgactctgtcctctgcattggagaaagacatgatctctagcctctcagggtgtttgccatacaaatttttttttcttttttttagttggagtcttgctctgtcacccaggttagagtgcagtggcgggatctcggctcactgcagcctccgcctcccgggttcaagcgcttctcctgcctcagcctcccgagtagctgggattacaggcacccgccactgtgcctggctaatttttgtatttttagcagagacagggtttcaccatctcggccaggctggtctcgaactcctgacctcaagcaatccacccgcctcggcctcccaaagtgctgggattacatgcatgagccaccgcacccggccaaccatagaaatatttttgaaaagatagtccaggacaacagttgtcacatatgtatagaaacacttggagaactgctccccaggaggttacttcataggtttattttatgttttattcaatgagttagttcatatggagtatctggtacatagtaagggctcaataaattattatgacacccttctaatataacacctttcttcaggcaagttacaagatgctcttccttcccacctttcacacatattttaagctccatattaaatactacaacttatatgaagccttttcttactaccaactggaaatgtttttttgtttttttgtttttttgtttttgagacagagtctcactctgtgcccaggctggagtgcagtggtgtgatcttggctcagtgcaacctccgcctcccaggttcaagtgattcttctgcctcagcctcccgggtagttgggactacagatgtgcaccaccaggcccagctaatttttttgtatttttagtagagatgttatttcgtcatgttggtcaggccggtctcaaactcctgacctcaaatgatccacccgcctcggcctcccaaagtactggggccaccgtgagccaccaggcattagccaccatgcccggctagaaatgacctttataatctgaattgtgtacctgttttggagcacatgtcacattctgccatgtattaccatgtacctgtttttcccacctgtcccctagattttaaaccctttgaatgtaggagctgatcttacccttgtatttgctttgcatacaactgaccctcaggaagtaatcttgcaacttggcagttgttctcaaccttcatttcaaaagccaaaagccaactatttctacctttaaatcggctccacccttctaaatactgagaatctaaatcttacatcctttacttatatagttctaaaaagaaaaatgctcaagtttcaactttcatgtaagaaagcctgaactacttaatgttcagaaaatcagtaatttccaatgttgcagtgtggctaattgttaaggttcctaaccctagcctactgtacagttttgaagctagaaattgtgccttaatcctttcacaatgtgaggatatattaaaatatcctcaattagtgcttatttgaattagaaatgaatcaaaatgattttctgtcctgagaagagcaacttttaaatatcatataaagtgatacatgcttgcttaaaaaacaagtaaaaacttaaaacaatacaaaaggaatacagtgaaaactaccttcctcccacaagccttaccccaagtccctgttaacagtttcttatgccattaatatgcaaggaaataaatatgcacattcttacattcttttataatatacatttttttttattattatactttaagttctagggtacatgtgcacaacgtgcaggtttgttacatatgtatacatgtgccatgttggtttgctgcacccattaactcatcatttacattaggtatatctcctaatgctatccctcacccctccccccaccccacaacaggccccggtgtgtgatgttccccttcctgtgtcctggtgttctcattgttcaattcccacctatgagtgagaacatgcggtgtttggttttttgtccttgtgagggtttgctcagaatgatggtttccagcttcatccatgtccctacaaaggacaggaactcatcattttttatggctgcatagtattccatggtgtatatatgccacattttcttaatccagtctatcattgttggacatttgggttggtcccaagtctttactattgtgagtagtgccgcagtaaacatacgtgtgcatgtgtctttatagcagtatgatttatattcctttgggtatatacccagtaatgggatagctgggtcaaatggtatttctagttctagatccctgaggaatcgccacactgtcttccacaatggttgaactagtgtacagtcccaccaacagtgtaaaactgttcctatttctccacatcctctccagcacctgttgtttcctgactttttaatgattgccattctaactggtgtgagatggtatctcactgtggttttgatttgcatttctctgatggccagtgatgatgagcattttttcatatgtttgttggctgcataaatgtcttcttttgaaaagtgtctgttcatatactttgcacattttttgatggggttgtttgattttttcttgtaaatttgtttgagttctttgtcgattctggattttagccctttgtcagatgggtagactgcaaaaattttctcctattctgtaggttgcctgttcactctgatggtagtttcttttgctgtgcagaagctctttagtttaattagatcccatttgtcaattttggcttttgttgccattgcttttggtgttttagacatgaagtctttgcccatgcctctatcctgaatggtattgcctaggttttcttctagagtttttatggttttaggtctaacatttaagtttttaatccatcttgaattaatttttgtataatgtgtaacaaagggatccagtttcatctttctacatatggctagccagttttcccagcaccatttgttaaatagggaatccttttcccatttcttgtttttgtcaggtttgtcaaagatcaggtagtgtagatgtgtggtattatttctgaggcctctgttctgttccattggtctatatttctgttttggtaccagtaccatgctattttggttactgtagcctcgtagtatagtttgaagtcaggtagtgtgatgcctccagctttgttcttttggcttcagattgacttggcaatgtgggctcttttttggttccatatgaactttaaagtagttttttccaattctgtgaagaaagtcattggtagcttgatggggatggcattgcatctataaattacctagggcagtatggtcattttcacaatattgattcttcctatccatgagcatggaatgttcttccatttgtttgtgtcctcttttatttcgtagagcagtggtttgtagttctccttgaagagatccttcacatcccttttaagttgcattccgaggcattttattctctttgtaggaattgtgaatgggagttcactcatgatttgtctgtctgttattggtgtataagactgcttgtgatttttgcacgttgattttgtatcctgagactttgctgaggttgcttatcagcataaggagattttgggctgagacgatgggactttctagatatacaatcatgtcatctgcaaacagggacgatttgacttcctcttttcctaattgagtaccctttctttctttctcctgcctgattgccctggccagaacttccaacactatgttggataggagtggtgagagagggcatccttgtcttgtgccagctttcagagggaatgcttccagtttttgcccattcagtatgatattggctgtgggtttgtcataaatagctcttattattttgatatacatctcatcaatacctaatttattgagagtttttagcataaaaggctgttgaattttgtcaaaggccttttctgcatctattgagataatcatgtggtttttctctttggttctgtttatatgatggattaagtttattgattttcatatgttgaaccagccttgcatcccaggaatgaagcccacttgatcatggtggataagctttttgatgtgctgctggattcggtttgccagtattttattgaggatttttgcatcgatgttcatcagggatattggtctaaaattctcttgttttgttgtgtctctgccaggctttggtatcaggatgatgctggcctcataaaatgaattagggaggatttcgtctttttccattgattggaatagtttcagaaggaatggtaccagctcctccttgtacctctggtagaatttggctgtgaatccgtctggtcctggactttttttggttggtaagcagttaattattgcctcaatttcagagcctgttattggtctattcagagattcagcttcttcctggtttagtcttgggagggtatatgtgtggaggtatttatccatttcttctagattttctagtttatttgcatagaggtgtttatagtattctctgatggtagtttgtatttctgtgggatccgtggtgatatgccctttatcacatctatttgattcttctctcttttcttcattagtcttgctagcagtctatcaattttgttgatcttttcaaaaaaccagctcctggattcattgatttttcaaagggttttttgtgtctctatctccctcatttctgctctgatcttagttatttcttgctttctgctagcttttgaatgtgtttgctcttgcctcgctagttcttttaattgtgatgttagggtgtcaattttagatctttcctgctttctcttgtgggcatttagtgctataagtttccctctacacactgctttaaatgtgtcccagagattctggtatgttgtgtctttgttctcattggtttcaaagaacatctttatttctgccttcatttcgttatgtacccagtagtcattcaggagcaggttgttcagttcccacgtagttgagcggttttgagtgagtttcttaatcctgagttctagtttgattgcactgtggtctgagagacagtttgttataatttctgttcttttacctctgctgaggagtgctttacttccaactatgtggtcaattttggaataggtttggtgtggtgctgagaagaatgtatattctgttgatttggggtggaaagttctgtagatgtctattatgtctgcttggagcagagctaaattcatttcctggatatccttgttaactttctgtctcgttgatctgtttaatgttgaccgtggggtgttgaagtctcccattattattgtgtgggagtctaagtctctttgtaggtctctaaggacttgctttatgaatctgggtgctcctgtactgggtgcatatatatttaggatagttagctcttcttgttgaattgatccctttacgattatgtaatggccttctttatctcttttgatctttgttggtttaaagtctgttttatcagagactaggattgcaacccctgccttttgttttccatttgctcggtagatctgtctccatccctttattttgagcctatgtgtgtctctgcacgtgagatgggtttcctgaatacagcacactgatgggtcttgacttttcatccaatttgccagtctgtgtcaattggagcatttagcccatttacatttaaggttaatattgttatgtgtgaatttgatcctgtcattatgatgttagctggctattttgctcattagttgatgcagtttcttccgaggatagatggtctttacaatttggcaagtttttgcagtggctggtaccagttgttcctttccatgtttagtgcatccttcaggagctcttgtagggcaggcctggtggtgacagaatctctcagcatttgcttgtctgtaaaggattttatttctccttcacttatgaagcttagtttggctggatatgaaattctgggttgaaaattcatttctttaggaatgttgaatatgggcccccactctcttctggcttgtagagtttctgctgagagatccactgttagtctgatgggcttccctttgtgggtaacccgacctttctctctggctgcccttaacattttttccttcatttcaactttggtgtatctgacaattatgtgtcttggagttgctcttctccaggagtatctatctttgtggtgttctctgtatttcctgaatttgaatgttggcctgccttgctaggttggggaagttctcctgggtaatatcctgaagagggttttccagcttggttccattctccccatcacttcaggtacaccaatcagatgtagatttggtcttttcacatagtcccctatttcttggaggctttgttcgtttctttttattcttttttctctaaacttctcttctcacttcatttcattcatttgatcttccatcattgataccctttcttccagttgatagaatcggctactgaagcttgtgcattcatcacgtagttctcttgccatggttttcagctccatcaggtcctttaaggacttctctgcattggttattctagttagccattcatctaatcttttttcaaggtttttaacttctttgcgatgggttcgaacttcctcctttagctcggagaagtttggtcatctgaagccttcttctctcaattcgtcaaagtcattctccgtccagctttgttctgttgctggtgaggagctgtgttcctttggaagaggagaggcgctctgatttttagaattttctgtttttctgttctgttttttccccatctttgtggtttatctacctttggtctttgatgatggtgacctacagatggggttttggtgtggatgtcctttctgtttgttagttttccttctaacagtcaggaccttcagctgcaggtctgttggagtttgttggaggtccactccagaccctgtttgcctgggtatcaccagcggagggtgtagatcagcgaatattgctgaacagcaaatattgctgtctgatcgtttttctggaggtttcgtctcagaggggtacctcgccatgtgacatgtcagtctgcccctactggggggtgcctcccagttaggctactcgggggtcagggacccacttgaggcagtctgtctgttctcagatctcaaactctgtgctgggagaaccactactctcttcaaagctgtcagacagggacatttaagtcttcagaggtttctgctgccttttgtttggctatgacctgcctccagagatggagtctacagaggcaggcaggcctccttgagctgcattgggctccacccagttcgagcttcctggctgctttgtttacctactcaagcctcagcagtggcaggcgccccacccccagcctcactgctgccttgcagttcgatctcagactgctgtgctagcaatgagcgaggctccgtgggcatgggaccctctgagccaggcgcaggatataatctcctggtgtgctgtttgctaagaccgttggaaaagcacagtattagggtgggagtgacccgattttccaggtgccatctgtcacagctttgcttggctgtgaaagggaattccctgaccccttgtgcttcctggatgaggcaatgccttgccctgctttggctcacgctcagtgcgctgcacccaccgtccgacaagcccctgtgagatgaacccggtacctcagttggaaatgcagaaatcacccgtcttctgcatcgttcacgctgggagctgtagactggagctgtgcctattcggccatcttggaactgtcctcttatattcttataaatcaaactctgatattacaaaacctacagccactgaaggcatcaaagcccccctagaagttcactttaccaacaatggtccatacagcatcttttgtgaagctttagtataggattggatagtaggcttcaagtttggatatttttaccaaacaattttttttaaaagaatcttcccatagtctttcccaggaaccctataactctgatcaggtctgggttttcatgactcaagtgtcatgtttatgtaggcacacttacatcctatgaaaaccaaaagtctccatgagaacagtgagaaaagtcaaaatcagagtgagcccaaccgaagaacgttaaggacaggattcatccatacccacagtgttctgtctctgggacttgcttgtctgtttttaaacaaactctgttctgtgtaattggacctccgattaatacactgtctcagacaggctggccagtatgggcataaactgtcaaaagtttaggattggatgatttaaaatgatccagattcaatccccagaatcttgcatttctgctggacttctgctggactgccagccaccctgattacccctccaaatgatgcccacttcctggattagcagccagtatcacctgactcaccctctggtgaggctgtatctgaggctacagagtcttagatcttccctgttatttttcccccatcccaagcatctataaactggccagaagcttcatgagggtgattttagcagagggtaaaattatcataaaagtaccatcaccatctaaaaacaaatataccctgaatcctttttcttgtaataccttttttatatcagaactaagggtatactgaagactaatgttaaaagccacacaacgggctgggtgcggtggctcacacctgtaatcctaacactttgggaggccaaggcaggtggattgcctgagcttaggagttcaagaccagcctgggcaacatggtgaaactccatctctactaaaatacaaaaaattagctgggcatggtggcacatgcctataatcccagctactcacgaggctgagacaggagaatcacttgaaccttggaggcagacattgcagttagccaagattgtgccactgcactccagcctgcgcaacagagcgagactctatctaaaaacaaacaaacaaaacccacacaataatgaactagaatgtaattcctctaatgaactcagctataatattaatgatctgatttccattccaagacggccaaataggaacagctccattctacacctcccagcatgatcaacacagaagatgggtgatttctgcatttccagctgaggtacctgcttcatctcattgagactggtcagaaagtgggtgcagcccatggagggcgagctgaagcagggcggggcattgcctcacctgagaagcacaagggatcgggggatttccctttcctagccaagggaaaccgtgacagactgtaccaggaaaatcgggacactccacctaaacgtggcacttttctgaaggtcttagcatgcagcacaccaggagattatatcctgcacttggcgcagtgggtcccacccccatggatccttgctcattgctagtccgagatcaaattgcaaggcggcaagcctggctggtggaggggtgtccaccattgctgaggcttgagtaggtaaacaaagctgccaggaagctcgaactgagtggggcccaccgcagctcaacgaggcctgcctgcctctgtagactccacctctggaggcagggcatagctaaacaaaaggcacagaaatttctgcagatttaaacgtccctgtgtgacagctctgaagagagcagtggttctcccagcacagtgtttgagctctgagaacagatagcctgcctcctcaagtgggtccctgacccccgtgtagcctaactaggagacacctcccagtagaggccgactgacacctcatacagctgggtgcccctctgagacgaagcttcagaggaaggatcaggcagcaacatttgctgttctgcagcctccgctgcttatacccaggcaaacagggtctggagtggacctccaacaaactccaacagacctgcaactgagggacctgactgttagaaggaaaactaacaaacacaaaggagtagcatcaatatcaacaaaaaggacatccacaccaaaaccccatctgtaggtcaccatcatcaaagaccaaaggtagataaaaccacaaagatgggaagataccagagtagaaaagctgaaaattctaaaaaccagagtgccccttctcctccaaaggaacgcagctccttgccagcaacagaacaaagctggacggagaatgactttgacgagttgagagaagaaggcttcagatgaccaaacttctccgagctaaaggaggaagttcgaacccatcgcaaagaagttaaaaaccttgaaaaaagattagatgaatggctaactagaataaccaatgcagagaagtccttaaaggacctgatggagctgaaaaccatggcaagagaactacgtgatgaatgcacaagcttcagtagccgactctatcaactggaagaaagggtatcaatgatggaagatcaaatgaatgaaatgaagtgagaagagaagtttagagaaaaaagaataaaaagaaatgaacaaagcctccaagaaataggggactatgtgaaaagaccaaatctacatctgattggtgtacctgaaagtgatggggagaatggaaccaagctggaaaaccctcttcaggatattacccaggagaacttccccaacctagcaaggcaggccaacattcaaattcaggaaatacagagaacaccacaaagatagatactcctggagaagagcaactccaagacacataattgtcagatacaccaaagttgaaatgaaggaaaaaatgttaagggcagccagagagaaaggtcgggttacccacaaagggaagcccatcagactaacagtggatctctcagcagaaactctacaagccagaagagagtgggggccaatattcaacattcaatgtgcagagacacacacaggctcaaaataaagggatggaggaagatctaccaagcaaacggaaaacaaaaaaaggcaggggttgcaatgctactctctgataaaacagagtttaaaccaacaaagatcaaaagagacaaggaaaaccattacataacggtaaagagatgattccaacaagaagagctaactatcctaaatatatacaggagcacccagattcataaagcaagtctgagagacccacaaggagacttagactcccacacaataatagtgggagactttaacaccccactgtcaatattagatcaacgagacagaagattaacacggatatccaggacttgaactcagctctgcaccaagcagacctaatagacatctacagaactctccaccccaaatcaacagaatatacattcttttcagcaccacatcgcacttgttccaaaattgaccacatagttggaagtaaagcactcctcagcaaatgtaaaacaacagaaatcataacaaactgtctctcagaccacagtcaaattagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacatttaaagcagtgtgtagagggaaacttacttatagcactaaatgcccacaagagaaagcaggaaagatctaaaattgacaccctaacatcacaattaaaagaactagagaggcaagagcaaacacattcaaaagctagcggaagccaagaaataactaagatcagaggagaactgaaagagatagagacacaaaaaacccttcaaaaaaaccaacgaatccaggagctggttttttgaaaagatcaataagattgatagactgctagcaagactaataaagaagaaaagagagaagaatcaaatagacataataaaaaatgataaacggcatatcaccactgatcccacagaaatacaaactaccatcagagaatactataaacacctctatgcaaataaactagaaaatctagaagaaatggataaattcctcgacacttataccctccaaagacagctgaattgctgaatagaccaataacaggctctgaaattgaggcaataactaacagcctaccaaccaaaaaaagtccagggtcagacagattcacagccgaattctaccagaggtacaaggaggagctggtaccattccttttgaaactattccaatcaatagaaaaagagggaatcctccctaactcattttatgaggccagcatcatcctgataccaaagcctggcagagacacaacaaaacaagagaattttagaccaatatccctgacgaacatcgatgcagaaatcctcaataaaatactggcaaaccaaatccagcagcacatcaaaaagcttatccaccaaaatcaatttggattcatccctggatgcaaggctggttcaacatacgcaaatcaataaacttaatccatcatataaacagaaccaaagaagaaaaccacatgattatctcaacagatgcagaaaaggccttggatataattcaacagcgcttcatgctaaaaactctcaataaactaggtattcaaggaacatatctcaaaatagtaagagctatttatgataaacccacagccagtatcatactgaatgggcaaaaactggaagcattccctttgaaaactggcacaagacagggatgccctctctcaccactcctatccaacatagtgttggaagttctggccagggcaatcaggcaagagaaagaaagaaacggtattcagttaggaaaaaaggaagtcaaattgtccctgtttgcagatgattgtatatttagaaaaccccattgtctcagcccaaaatctccttaagctaataaggaacttcagcaaagtctcaggatacaaaatcaatgtgcaaaaatcacaggcattcttatacaccagtaacagacaaacagagagccaaatcatgagtgaactcccattcacaattcctacaaagagaataaaatacctcggaatgcaacttacaagggttgtgaaggacctcttcaaggagaactacaaaccactgatcaacgaaataaaagaggacacaaacaaatggaagaacattccatgctcatggataggaagaatcaatattgtgaaaatggccatactgccctaggtaatttatagatgcaatgccatccccatcaagctaccaatgactttcttcacagaattggaaaaaaactactttaaagttcatatggaaacaaaaaagagcccacattgccaagacaatcctaagccaaaaaaacaaagctggaagaatcacgctaccggacttcaaacaatactacaaggctacagtaaccaaaacagcatggtactggtaccaaaacagagatatagaccaatggaacagaacagaggcctcagaaataacaccacacatctacaaccatctgatctttgataaacctaacaaaaaacaagcaatggggaaaggattccctatttaataaatggtgctgggaaaactggctagccatatgtagaaagcggaaactggatcccttccttacaccttatacaaaaattaattcaagatggattaaagacttacatgttagacctaaaaccataaaaactgtagaagaaaacctaggcaataccattcaggacataggcatgggcaaggacttcatgactaaaacagcaaaagcaatggcaacaaaagccaaaattgacaaatgggatctaattaaactaaagagcttctgcacagcaaaagaaactaccatcagagtgaacaggcaacctacagaatgggaggaaatttttgcaatctacccatctgacaaagggctgaaatccagaatctacaaagaactcaaacaaatttacaagaaaaaatcaaccccatcaaaaagtgggcaaaggatatgaacagacacttttcaaaagaagacatttatgcagccaacagacacatgaaaaaatgctgatcatcactggtcatcagtgaaatgcaaatcaaaaccacaatgagataccatctcacaccagttagaatggcgataattaaaaaggaaacaacaggtgctggagaggatgtggagaaataggaacacttttacactgttggtgggagtgcaaactagttcaaccattgtggaagacagtgtggcgattcctcaaggatccagaactagaaataccatttgacccagggatcccattactgggtatataccaaaaggattataaatcatgctactataaagacacatgcacatgtatgtttattgtggcattattcacagtatcaaagacttgcaaccaatccaaatgtccaacaatgatagactggattaagaaaatgtggcacatatacaccatggaatactatgcagccataaaaaatgatgggttcatgtcctttgtagtgacatggatgaagctggaaaccatcattctgagcaaactatctcaaggacagaaaaccaaacactgcgtgttctcactcataggtgggaattgaacagtgagtacactcggacacagtaagaggaacatcacacaccaggggcctgtcgtggggtggggggagcgggggagggatagcattaggagatatacctaatgtaaatgacaagttaatgggtgcagcaaaccaacacaacacatgtatacatatgtaacaaacctgcacattgtgtacatgtaccctagaacttaaagtataataaaatatatgtatatattaacgatcctcacagtgagattggaagctttgtaatatctcttaaagatcacattatagggcatctctgttctttaagtctaatctgtgatcaaaagaaataaaatattgtattttaaacatgttttctttcttacatatttatagataaggggaaggaggaggagatatccaaaggtctaaaaaagagaaagagaaaatgaatttaatcaataatgtaaaccaagttcgtaaccacatgtatgtaatatgcaacacccctgactgacatttccttgtacaaattaccttagaaagtgaacccaggcttgttttagaattatttaagttgtgtcaaaaatcacaacttagatgatcagcttgaacacaggttttctaagcaaagctgtctgtttttttctttttagtcacagatcgtattatatagtgtgtggaatatgattaatgcattattggatatgagctgtgccccatactttagatctgacatattccagttaccttattatgaagcatgtgtgttacgatctctcgccactatcaaagtataagagtttgttggccatacacttggtcttgggctggtcccaacccaggtgccaataactggttcatcatggccagaaacaggcctagaaatgtgactgcctggccctactctcaaaaacagagcactttgaagataacctaacttccaaggaaggagccacgctggaaataacataactgtttgtgttatgttattgaaaagaaaagatctccatgaatttctttttttttttttttaagccaactttgacagcctctttccttccagatggtgcctggagccaagcctgtcagagaaccttagtctcctgctgccttttaatgctggtccttgattgctaatgacccctggctggactggcttctcaacccatttaacccctctctgctgggtccccatctcatgcaggatgagcggccacgagagctggaagtgggaaggtgccaagtcagccagagcctcccacccttccagagctggtggcgcgtttcccggtgccatcatggatgtccaagatcattccagtgaagagctcatgttaatatgattttctctatattgtcagataaatgctgccaggtttctgattgttaatattttatttgactaaaccaagacaaccaagtccctgaaagaatgtttccttcaggggtcaagagctgaggaccactgatatgagcctcctggaatatgttcatttggaaacttaaaattacattgcactggaactatcttttagtttggtcgaacttcatggacaaagcatttgcttttgtgcgtgtgtgtgtgtgtgtgtgtgtgtgtgtgtgtaggcaataatttccttgtcaaggctgaaatatcacttgtataacacaggagatacccatttctcagctttgttagcaacaactgtaaccatttactttttggttaagcttggtttgttttttatgacatataggaaggtgcttatagctatactgatcaggtaggtcactcagagtgtagggtttttttttttttttttttagatggagtatcactctgccgtccaggctggagtgcagtggcctgatcttggctcactgcaacctctgcctcccgggttcaagcgattctcctgcctcaccctcccgagtagctgggattacaggcatacgccaccaggcccggctaattttttgtatttttagtagagacagggttttgctatgttggacaggctggtcttaaactcctggcctcaagtgatccacccccctcagcctcccaaagtgctgggattacaggtgtgagccaccacgccccacctgagtatagggatatttaaaaggggtgggggcaggaagctgctgatgctaatttgttgagaaatcttgagtccagtggagaaattcagatctcttgcaacctcctcaggtcagggagggcatgagaagtcatcattttatgcattatttccgtaacggatttttactaatctcatattggattgtaaaacaaggcaaagaaatttggtagttctctgtgaccctgaagaactgaaatttaaattcttgattagagcagagaactgaaagctttgtgctgccctacttgtacaaacgtcttaatgtttactggatagttggaccaaattgattttataatgtaatgtacttaagaaatttgttccaaaattcggcacaaattaggaaaataaccaaaccatacctttctatttaatctttgcttctctcagatacttactattttcttggcttttttgaagattaagactgaaagatcacaactgcatttctcaccactaacacttcattgatttcatttttacatcttattaattaaatgcaagaaaaaaattatatttgtgattttattttggtctactactgacattcttttctatttccactcaatctctctctccctctctctctctctctctcacacacacacacacctgccagacatttgtagatataacctcccccaaatcatgtcattcatactaatgactgccctctctatgtgtaaaaatattttataatttatggacctgggtggggatttgtacagctgtgcaatattaatctatacactgcaggttttgctaacagctgggcaaaggctgaggtgaggttttaatgatgtcctttagcccatcagtaaccaaatgacccagaaagtggttcaggggaacctaccttgtgcagctgtgctctttgaatgaatgaatcatgttagaatgaaattctggtgtatttatggagaactttttcctttgaagcctaaacacattttgattggtcgtatttaaattccaacaagctgaaaagcaaaagcatttatgtcagtttcacagatgaggctccaagaggttaactggcgattactctggagttacagcatcttaaagttggaagggactttaaagggcctctgggctaatggttcttacccttttcctgccttcacactggcttcaggcaacagatccccatcaggcatgtctctcactgcacacagatgttcacacactgggaaagaatgtgactccaaggagagcagctcagaatcttcaggccagaacatgtgtaatttgccacaccaatgttctccattaaaaattactacctcagtccacccctctctttatcattttacacataaaacatggcagcagaggggtaagggattcacttaaggtcacataccaatatgtgtcacaacttgaactatgtgtgccggggtcttctgatcccccatgtccagtgctggttttgctacagctgaccagccccttgcacactcacagtagaactggaactagctcctcaaagagtgaggcagagctggagacgagtgccccagggtcccctgctgcagggaatcaaagaccccgtcacaattagcttagtaaaaccaacactatctggtgtcccatatccgcaagcacttaaaatgtcgttccaatcttcaaagaaattctttcattccatttttatctgcttttacccaggacattgtttcccagctccccagtagttcactaggtgatttgcatctcattagaagctccagaagtgacatctcccagactgctgcctggcattgtgggtccctaagcatcagatctaggtcttggattttccaagttgacacttttttaaaagctgagttaatgctgttttcccactgggtgcagtttgggtggccattttcgccataattcctgctcccgtgctggatcaaggttagggaactgccattgtcaaagatgaagtcagtcatctccacgtgaaagtacgtggtggatgagaatattctggggcctcagaataaaggagtttaaagactcctaaaaatagaaagatgctacatgatgcagatattctgaacactacacaaagcaaaacaaaaagacagcaagacaatagcaaaccattgctgaagctgtataattgattctaaacgtttgccttttaaacattttcccctggatccaatcctcctgagaccgcagagtttttgccctacatttatattttgctttaaagatagtctccctaggtcagaatgcctttttggctttgtcatttcttcatactacaacctccagaagagcactgaacagcactgtacctctggaaaccagagatagtatttccatggtcagcaaaattgttctcttggaataagagaaatgattttcccagtgtccagggaaataaggagcccttatgtctactttgggctcaagccatttgatgcagcttccagcacaaagcaagtgcctgatggtgcctagagcttccgccatccagaattccttttgtccagtgaatacttccctgagcttatgccaccttttcaaaatggcagatagctaatctgcagaattgatctaagctcttaggaaagggttaagtccatggtttttccaacactggctacaaattaaaatcactgggaaggaggaggaactttgttttaaacaagtaacaatgccagaaccctacccctgaccaattaaattaggatctccaggggtgaggtcatgatatctgtatttttaaaaagcccttcagatgattctaatatgcatccagggtggagaaccactccagtataacaagaaatacaacagccccttcgcagcacctgctaatgcctctggcaccatgttttatcttttcatatattatctgtcattctcactacaaccctacaaggaagggtcatcattcccaagtgaaggcctctaataagtgctgaggtggttatcatactccagtttttctgacttcagattcccaccccaacacacgtttctcaaagtgtgggacatgggccactagtggtcaccaagttgactcttgatgacgtatggatgtggcattaaataacataattcttttacataatttcttatgtaaaataaagttacttttttcaattctcaatttaaatcctccagattactttaaggagaaagtcttaatggtgctagtatgtcttaaattcctctcacatttactcatctctctttttaacaagccttttaagaaacccagaaccttctataggaaatggaatctagcacaagtgtgatgataccatttcactttcaccgtatttactatatagttcacttctatatatggcaaatgacactggttttccatttacagtggcgaataaagttccagttttaaagacatgtatttaagcaaaaaaaaaaatcagttgaattttaaaaatattaaatagtagtacaggtgaataaagtaaaaaatgcctaagaggtagatacgtgacaaaagtttgagaaatattcccctacaacatgctaatttttaaaacaggcatacccacacctgttagccaacgggactgctcatctaccatcctactccaatagactggcaacaacctgttccgtccactttacatccactcacgacctgtgaactttgctgctgtttccaactgaagaggaatcctgaaacacaaatggtgaataaactgggagggtagggaacattcagccttttcaaataatcaatggcatgcaaatagaaacacaaatgaggtgttatttttgcacctattaaattgtcagactttttcttaagaaccatctcatgctggtgaggacctgcttaaatgggtaatataggtataggtggcagaagtgtattttgctgcacaatttctggatggcgattgaaaaaaacaaatcataagtttttaaaatatgcatacctttggccagtaattcttcttttagaaatttatcctaaggaataaggaacatttgtcaaacaccaaactatgagtatgttcctcaaagcactgttattatagaaaaacattggaaacaacttctgtgaccaaaataggaaattatataaattaatcatgattcatccataaaatgaaataccatgcaagcattagaagtgataccatttaagctatctctggaagacagatatctctggaaacttgtctcagcagttactactattgtgggaatgagattgggtgtggaaaaaagacaaacttttcactgcttaacttatttgaacattaggttcatttattaccttttcaaaaagtaactctaaaagaaacatactattttaaaagttgcctaatagaatggaaatatttatgactttattgttaagtggggggggggggggaggggcggggagccataacccaaattaaatgaatgaatgaattttttagttaaaaaaaaaagaatacatattcctgtaaagatattgaaaggacagtaataaaaaatactaaggaactttgtttttagagactgatttcatctacctctttgaaacgcctctggacagtttccccagaggtatcccaggatacgaaagaccctcttcctattggaagcctggacaaaaacatcccaattaaccgtctgagaaccaaagaataggccacatagatggaagagatcttaataagaatggtgaatagtcagtattcactcattcactcattcattcattcattcttcattcattcgtcatttgttgagagtgtgccaggctctgagctattggtttcaggggaagttattgccacctccttaactaataagtagaaaattccacatagacaatttataactccagcatcttccacaggcactaatttagctcagggatgttttctttgtagcagttttgcaattttgaagaagattgttcatgacataacatggcaagtgggaaaatttgtagctttcctttcatcttaaaaagcaggatctgaattacatgcaccccaggagaaaatctctctttctggttgtgtgtgtatgtgttttacaaaagcccactgaattccttagttcctcctgaagttagacttggtgaagtgaaaacttatgaaaatgtctcagcaaaagtacaagcatcataatagaggccatgacctaggccctgggattttgaatcaagaatcttgagttatagcttagggacctaagctccttgagcctcagacctctcagatataaaagcaaggagccagaccacagagaattttcctccatgacatgacttaaatttggaaatctgagctaccagggcatacttccctgtctccaataacctgaggatctgttaggctctgagcattcctgaaatagtccatgcctcaaggcatattagggacaaggggattacaatacatttcttcatttttaaggtgatgtagattattggtagactttctgctgatatggttcttattgggaaggaaagatttaatatggtcaagcacaatggttcttaaccttgactacacagtagaaccacccaaagagatttgaaaaaaaaaaaaatccatgtccaggctttgacccgggcattagtattttaaaagttgaacaactggtatcatgttaaaaaatactctcagttggacttcaaaaacctgaattctcatttgggctttgcctctaactgtataatctcttagtctcactatgcctctgttatctctttagggttatttggccttgctaaaatgagatgaagtaaacaaaaagtactttgcaaaacaagagttgctatataaaaatgaaatggttaggggaagagacagagagccagaaaagacaggtcatgtcttcagaagctatttcatgggagtatccactggagtaccatgtgcatggtcaaccctcattgagaagaaagattgtctagctgacagctgggttattgtcacctgcaaatgccctgagaaccttggtcagaggagtgatgcacctttctttatgcacagagttggcagagctctgtaaattaattgcacaactctaatcctatttaaatgccccaggggtatagcttataacctcatataggatttgccatctgtaaatctagaacactgaacactctgtttgcttaaaggggatgtttcatttggcaaatgaacctgagaacgcctcatccacaaaatggcaatcagatcagcaatcacacagctcagaaagtatccgtacctgatgaaggaccacaggagggtgccagggtctatggctctcccaggatattctctccctttcttcccaggacccctgtgcgttgcctgcccattcctcaggagccaagaacgcattctgccccaccaagctggggaatacgtgggctgcatgctccatcctgcccttccttgcagttgtccttcacttccttcaagcttgctaggaaatttaccagaactggcacatctgtagcaggtgatgaaaatggaaacattaagttttagaggacagcgtaggagggggcatgtgtagccaaaatagctgcaactcagcaagtcaaatggagtagaagaagacattttcttcttcatctctgaaaccttggaagacgacaaaagcctcatttgtgacttacaactgtgcatgaattagggttgccagatttaacaaatagaaatgcagtacactcagctagatttgaatctcaaataaccaatcattttttaatatgtcttaaatatttcatggatgtaataaagaattattggttgtttatctgaaattcaaatctatctaactgtgtgtcttttttttttttcttttttgagatgaagtctcactcttgtcacccaggctggagtgcaatgatgcgatctcagcttactgcaaccttcacctcccaggttcaaatgattctcctgcttcagcctccccaatagctggaattacaggtgcacaccaccacacacagctaatttttgtattttaagtcaagacagggtttcaccttgttggccacgctggttttgaactcctgacctcaggccatcagcccacctcggcctcccaaagtgctgggattacaggcgtgagccactgctccgagctgagccaccgcacccagccatgtcctccatttcatctggcaactctagcttgagtatactggcatgttcaataaagagaaaagaaaaattaaatttacaaaccagttgtttgaatttatgtgacagattgactgaattcagctatttgtctctcaccaagggcttgggcacatgtgcagccacagtgtgacagtttgggattaggaagtaaggagtaggcatttgccagtgctcctgaaatgctatccagatttcttccattttctgacagatttagctccagtttattataaagttctataacaattcagaagagaaagatgtgttaaagttctcaaatatgaaatcagaaggtgcagggcagggggttggggggaggtgcaaagattcttgaaaaggaaagagacctatgttaaatgcaaactggtattcataacataatatacctttaaaagcccagtaaggaggtagttgccaatgtacgacaaagtggggagtttggtttgtctcatgggcatctatgcgaggtagaaataagccactttgagaatatgagcattatggtcctcaaagtaaaaactcacattctaatgtgaatattcaggccgggggcagtggctcacgcctgtaatcccaacactttaggaagccaaggcaggtggattgcttgaggtcaggagttcgagaccagcctggccaacatggtgaaaccccatctctactaaaaatacaaaaaattagccaggcacagtggtgggtgcctgtaatcccagctactcaagagactgagggaggagaatcgcttgaaccccggtggaggttgcagtgaactgagatcgtgccactgcactccagcctgggtgacagagcaaggctccgtctcaaaaaaaaaaaaaaaaaaaaaaagtgaatgttcaaacttgagttgcccagtttctctacataaactaatcaaacgaactaggtaactatccgataaccatactgttttatatcttaatgcaaactgactggcccaaaatccaaaagacagggttcaagttttcactctgccgcttacaaatttagccttttctggttatactttcttcatatatgcaaagaactaacaattttggtactatgtgccttattgattttttagtatttaaattttcaagggaaaaatcatgataaacttcttaatgcatgtacaagcatagatttagtcaatgtgctatatgttattttgtattttacttctttttccaagttttgaattttcttctgtcaacatcatacacatttatcgccgctttgtcagtgactcaagatatgaaacaatttttatatctgagttaatttcttctcgattattaaatatgtatcatgtttctagcttttttactgctataaaagtgttatggctgggcacggtggctcatgcctgtaatcccagcaattagggaggctgaggcaggtggatcacctgaggtcgggagttcgagaccagcctgaccaacatggagaaaccccatctctactaaaaatacaaaattagccgggcgtggcggcacatgcctgtaatcccagctactagggaggctgaggaaggagaatcgcttgaacctgggaggcggaggttgcggtgagccgagatcacgccatcgcactccagcctgggcaagaagagcgaaactctgtctcaaaaaaaaaaaaaaagtgttatgtctgtctgtcttcatacaaattgggttttttttcttttggtttacttcattgcaacgtattccttggaacaagttgcttagttctgggggtttttttctgggtttttttctttttttggagaccaagcgtcactctattacccaggctggagtacagaggcgcgatctcggctcactgcaacccctgcctcctgaactcaagggatcctcctttctcagcctccggagtagttgggaccataggtgcatgccaacatgcctggctaattttttgtattttttgtagagatggcacttcgccatgttgcctgggctgctctcgaactcctgagctcaagcaatctgcccgcctaggcctcccaaagtgttgggattacaggcgtgagccaccgtgcccagccagctctgtttattgccaagttgcacttcaggaggcagggaacctgtggattgtcctgtttctctggggcccctcccacattgtcttttaaccttatggtgtatgaattaatagagaagcagtaacaattgttaaattgaagctgttcgtcaggatagttcaacatttttcagtatctcgttttctaactatatttctctgtctctcgcctcagcctttccacattacggatgtaacttttatgggtatatatctttcaattgtttttatctttctgttgtacttcctttcatcttagttttgttactgtccatcatatggaacgttttactttaatataattaaacgcatgcatgtcactaacgtcttcttatacagctgagatactccatttctttctaaagttttttggagaatgtttaaaattctcaatatataactcatctcgaatttattgtggcctgtgagaatcaagaaatgtattgagaagagtaaaggatttagaattttaaaaactaaacaatttgagtccaacagcactagcttaaacggctttaaagaagtcacttaacatcttaaaacagtgtcctctactagattgaaaacagggactttgtcttatttctcttcgtattttccacaaaatccagcaaagtacactgtgtataggataaatgttaatatgtctgtatttaagttatatttttgcatattgccattaaattgttccagtagcatttattaaataatggtctacttcccaactatttattcggttgcttacaatggatcattgtatcagtgacactcagatttcttccaatggcaaagcacctggaagttacagcattctttgcagaacattgtgaaatatggaaaaattaaacttaaaataatgaaaattaaaatctgatgctaaatcagataactagcttataccagattctagtatagtgtagaaaccataagattagacaccaacagttgtttttaagtaatgggagaaatattaaaattaagaacattctatccaataacttaattccttataagaatcaggaaaaaaataaaagccaatgaaacagcaagttcgtcaagaacaaaagttgaaaatcatatcgtatataaagcattaccagttgagacaatataaataaaaacctctgataaaatgtaaacactatataaatatgaagtccagctgaactaggctgaactctagttgaacccaaaaacttcttaagatcagtcttttgagttaccatggacggaattcctgccgtattagaaagtctgagggagagtggatgtcagacctccagagcatacttcacaccagcagccggacctaaggacacttctcttcattgatctataaatcagaaaggagatgacacaaaagggactcacagcttcacattctaccatattgcagagtatggacttcacaaagcaaacaaggaggaggtatgttggaaccgtcagaaagaaccgctgtgttctttgtgttctgaggactttgccagcacaacaggctagattcctgtgctctgcacagtgatcatgaagaggtggatgaaaatgtctgttaaggctgttggaccttctgcaagcaacattgttttgctatgctaattaatatgttttcattgaggccagacatggtggctcatgcctgtaatctcagcactttgggaggctgagctgggcagatgacttgaggtcaggagttcgagaccaggctgggcaacatgatgaaaccccatctctattaaaaatacaaaaacttagctgggtgtagtggtatctgcctgtaatcttagctacctgggaggctaaggcaggagcatcgcttgaggcggaggctacagtgagctgagatcgtgccactgcactctagcctgggtgacagaatgagactctgtctcaaaaaatatgtatatatattatattctatataatatatattatattctatataatatatattatattctatataatatatattatattctatataatatgtaaaatatatattatattctatataatgtattatatatagaatataatatattctatgtattctataatctatataatacatattatatattatatagaatattataaataatatattctatattatatatagaatatattctatatgtttatattctatatattatatatgaaatagtatataaaatatatataatatatataaaatatgatatataatatatataaaataatatataatgtataatatataaaataatatataatgtataatatataaaataatatataatgtataatatataaaataatatataatgtatattatataaaataatatataatgtatattatatataaaataatatataatgtatattatatataaaataatatataatgtatataaaataatatataatatattatatataaaataatatataatatattatatataaaataatatatattatatataaaataatatataatatattatatataaaataatatatattatatataaaataatatataatatattatatataaaataatatatattatatataaaataatatatattatatataaaataatataatatatattatatataaaataatatataatatattatataaaaatataaatatattatataaaaatataaaatataaaatattacatataaaatatatataatatattacatataaaatatataatatataatacatatttttttcatcgaacttacttttacttaaacctttgactttaaaaaacatttcttcttaagaaaggcaatatcttataagctgggcacggtggctcatgcctgtaatcccagcactttaggaggccgaggagggcagatcacttgaggctaggagttcgagaccagcctggccaacatgatgaaaccccatctctacaaaaaatacaaaaatttgctgggtgtggtggtgcacacctgtaatcccagctacttgggaggctgaggcaggagaatagcttgaacctgggaggtagaaattgcagtgagccaagatcacaccactacactccagcctgggcaacagtgagactatctcaaaaaaaaaaaaaaaggaccatatgctatagtgtaaaaaaaaaaaaaaacaaaacacctattggaacaagaagtaagaaatctagggttgggtacccacctggccacttgatctgagatgagccattcaattttatgggcctcagtttctcttctgaaaaaaaaaatgggtatttagaatggatggatgtgatagtctttttttttttttttttttttttttttttgtgagacagagtctcactctgtcacccagactggagtgcagtggcgcaatcttggcttactgcaacctctgcctcccaggttcaagtgattctcctgcctcagcctctcaagcagctgggactacaggcgcccgccaccacgcccagctaatttttgtatttttagtagagatggggtttcaccatgttggccaggctgggttctgatagtcttgtccaaatatagatttgtcccaattcaagaaaaatcaagatacaaaactttatacttagggaacaaatattttggtattaataatggaccttgctaagtcactctctactttaaaaattcccccagaatttttttaaatcgtggaaatctctggtgaagttaaaatatgataccaagtaaaatctccaactctttttaatgaatagtttataataaacactctgtcctccaggatagtgatagcttttctctaaacaacaacattcatggacaatattctatgacagaggtgtgtgtgtctgtgtgtgtgttgccaagaaattagaactgctgaatcctgattcagatatagagccaaaaggacagtagatccaaaaaatcatttgcttggaagggaaatgaattatgactttttttttttttttttttttttttttttgagatggagtcttgccctgttgcccaggctggagtgcagtggcacgatcttggctcactgcaacttccacctcccgggttcaagctattctcctgtctcagcctcccgagtagctgggatcacaggtgtgcacctccacacccagctaatttttgtatttttagtagagacggggtttcaccatgttggctaggctggtctcgaactcctgacctcatgatccacccgcctcagcctcccactgcgcccagccatgaattatgacttcttctgactcgtggtttcttaatctccagggcactcttggtccagggttctgaaatcaggacaaacagggagagactgcttcatgtaatcgtgcaatcatcctttctccttctcttttacactacctccaaagactgcatgcatcagtggtattgttcaaagcatttcagtaaattttagctcaagccatttcccccccgacaaaatgtatcccaccaaaaggtttgcttctcacctccccaagagtatgtgtgctccagatgtttttgaactctcattgcaggatgtggtgcaaacaatcccagattactttggttgtcctaacatagtcatgccactaagggcaccctactctataaatgctgaccaccaacttatacttcaccaatgtggaaacaacaacttgctttctgtcaccctggactgctgattcagatcagaaagctgaatgcaaagttacagacagtggcccttgtttacacttagcaatctgtgtgtattttttaggatggcatttctcctaatattagtaaagcttttaatatgcccattaaaataggacacagtttctactaagtgcatttatgtgaagagccatttttcacttaattttcccaacacctcggacagtttacagcaaagttttgctcttttttcaggttcagaaaatggtcttgcacagaagcatcgaacacctcgccgacgatgtcagcagcccaaaatgctgagtagccctgaggacaccatgtactataaccagttaaatgtgagttcaaagtggccgtaaagctgtttcactggctttgtttccagttaataattctgttattactacctgttccagcccctgcagccccacccccaccctcatgctctcgtcttgaacatgtgcttaggctctttatctgttgctttcatgtcaggatgtctgccttcacggtgaataattgatgtggtttatcaaagacgagcaagatgcatgcttcatcaggctcacttgagccctttgatcaaaaaaaattatgctgtgacttctgatattatcagcatctgcttgcattcaacacaaaatcactttgaattaaaaattaacgacttgctgctttgctttgactgtgtgttcttggccctctccacagggaactctagaatatcaagggagcaagaggaagccaagaaaacttgggtaaatatctgtcttcttagttctaagcaactgtaaacagaaggggtcctttgtgatattacagaaaatgcaaaactttccagagaggcttctaaaaatatgcaatccagatattgccactcttattgacattggaaattacttttcacagtagcaagtatacaaaacttgaatctattctgtccaaaaaggttgaaattgtcacctaagggcaaatgttatttctcataattattccagggaattgtactttcttcataattagagacatgtagtgggttatataaaattctccttccacaaataagagcactctacgaagtacaaataggccacttcctccacattatcctacccctgggccttaaaaacatggacaaggagaaacatgcccaactggttagatagaggatagtaaggaatttgtcgttcatttgatagttagcatctcaattgagaacagcaatgaagtacataatggtaataattagagaattgggggaggtcaggaggaaaactttctcatctagagggaaccagatggagacagagttcaatcccataaagcaagttgcaatacgaccacaacttccagacaccacaaaactggacccactatcagtgcacgacccaaaggtgaagggctttgtagatcagaccctggtacctctgtactgggagaccctgagctacctaggagctgtccttcccctccagtgttggagcccaaccctgttccagctactcacatgactttagctgccccagtgatgattgtaacatttgttttattttttgttgaaaatcctgttgttttctttgttgcagccaaatcaaagtacttgatggggaagatgaatattacaaatctctgtcaccagtggactgtatccctgaggagaacaactcagcccacccttcctttttttcttcatcctcaaaaggagactcttttgctcaacattaaattgtgcttcctaaccctaaatctgtccagagtaggaacattcatggtaatcgactgtctgtcattgcgtaagaaagcactgatatggggtcagcttctttggacatatggtccatgcctgaaccttactgaaccacttgcagattccaaaacatcttatcctatcctctaccactctcccacatgtgttgtgcagcctgagctgggcgctgccttcctttctcatcccatggggccctgtgggacactgagaacacctttacaatagtttaaacagtcattcatgcccccagtgtctaggaagataacagccagtctcaccccagtctaatcatggaccctgataatattgcttgatttttcctatcaagttacttttcaatccattcagaatctgccccagtggagacccaggagttcctttcctgcactcttctccatcctcccacctttgctgggcttttctatcactcccacctcccccagagtcagggctccattgctgagtgccccatcctggaggattggccccaagatctcctagaacaggataattgcctgtgtttaggcagataggcctaaatctttcagattctttctacaaggcaaataacccctctcttgttaattatgatgctgagaaagcctctgtctctttatttcaccttgccaagacacccacactactttggtgatgaaaagaaaggaatgagagggaaagtttggacctgtcactttggtgacagggaaagtccaggtcactttattctgtaactctccattcactggtcaaataactccatgaggctatcagtggctacagtggaaggacctgatcttgtccatctttgtgtgcacagagcctagcacagggcttggtagagggtatatctagtgaatggagaatacatggagaaacttaactaagttacacaagcatatctgacaggaatgttaccttcaattgtatgttacatatgattagtcacttttcatacactataacctctgatttttcactcaagtttgggctgattatattgtaatgatgttagataatactcaacatgattcagtatgacaaacttttttgagcacctactttatataaaacatgacaaattgcagtgtgatgtaatcaaaaacaaagaagccctataagaccatttctctagaacagatgttcttaatatttttcttactctaaaatatgtggtagatagtatgcaagaaaagccgggtgcggtggctcaggcctgtaatcccagcactttgggaggccaagatgggcggatcatgaagtcaggagttcgagaccagcctgaccaacatggtgaaaccccgtctctactaaaaaaaataatgataatacaaaaattagcccagcatggtggtgcatacctgtaatcccagctactcaggaggctgacgcaggagaatcacttgaacccgggaagcaaaggttgcagtcagctgagagcgcaccactgcactccagcctgggcgacagggcaagactctgtctcaaaaaaaaaaaaaaaaaaaaaaaaaagagatagtatgcaagaagacacctaaattttgagagaaataaccttgaagaaaatcttgttatcagagttttgaaagggagcacattaataggccttttatgaagataaataatgaaatgaggtatttaaagatctcagaaattgtaattttacaagtaaaataaatatagccaatttttcaatagctgaacttcacccaaaaggtaatgtttataagtagagcagaaaaaatgcagataaattttattttattgtttaaaaaataatgtgtagaatatataaattttttatgttactgttaatatacgagtgcttttggaagtttcacttttgtcactgattgtctacttttggtttgataatatgagctgcttttcaaattgttgaatggaaatgttcataactccctgcttgtccgtgcacaatgtaattctaaacctggcttgtttctcatttaaatatatctataaataaacttaaaaagaaaaca

SEQ ID NO: 2558 - DNA, 477021 bp, Homo sapiens; identical to SEQ ID NO: 2557

SEQ ID NO: 2559 - DNA, 477021 bp, Homo sapiens; identical to SEQ ID NO: 2557

SEQ ID NO: 2560 - DNA, 477021 bp, Homo sapiens; identical to SEQ ID NO: 2557

SEQ ID NO: 2561 - DNA, 477021 bp, Homo sapiens; identical to SEQ ID NO: 2557

SEQ ID NO: 2562 - DNA, 11755 bp, Homo sapiens
ctcaagacttacaaactgtcctttattcagagtgagactgcggaacattaataatttatcacgcggggagtccccagaagccctgtgcccacgaacccctgtgggcggaggagagaggcggggactccgggagcttcctgagagggccgtgtcttgggagcaaggtgacatattcagttcaggcacgcggaacatgaactcaggaagtggggagacagagagacccatcccccaactcccaggacgggggccaggccccctaaaaaggcacaatggcagggcaggtttggcagagtggttgagtgtcaggggtcgacaaaggacaccatgatgtagcgtgtgccccaggtcgttggcagcccctcgtggtagtgggtgaggcggccggggtgcaggagtgcccagcccttcctcggggaggagatcacacagtcgtagcgcaggaagcggcagccacctccctggaaagagaagggaaaggaaacatggagtgagcagacgtggggcctggggagcaggcagatacacggggcagggcggccagaccggggggcacggtgcagcagaccggggtgacaagggagatggcagatatggcagacaccggaggctggggtgcctgcagacaggaagatccaggaggaagcagaggccgcctgcccagaagcgatccaggagctgatacccacaaagtcactgggaaatgggcagggaggggagctgggggatgcacgcaggggctctaggtggggacccgagggtcctgaggtgaagcgtgggtgggtagtgtgactggggcgcacctcatagtccaggcccttgtggttgagggcaacgttgagggtgaaggtggatgagtcgtggtgtggccgcagagacggctgctcgtctggccggtagcgaaccacaaagttcatcaccgcccgcgcctgggggagaggagggaagaggctgcagggacagctgcgggcgcagggggtcttttattttgtattattattattcttttgagatagtctcgctctgtcactcaggctggagtgcagtggtgcgatcttggctcgatcttggctcactgcaacctctgcctcccggtttcaagcaattctcatgcctcagcctcccgagtagctgggattataggcacctgccaccacacccggctaatttttgtatttttagtagagacgaggtttcaccatcttggccaggctggtcttgaactcctgacctcaggtgatccacccacctcagcctcgcaaagtgctgggattacatgtgtgagccaccacgcccggccatcgcagggtgtcttcagggagatgacggtccctgtccagggaggggaggggaggggcggcgggacccctgcgtaggaggctctcgctgctcactggcattaaattagggccaagcctcaccttgggtctcagcctggcgccctccctcccctggggtgcctcctgcagcgtctcattcccctgggaactaaaatgcatggagcccaaatgctgccggggccgaaaggggtctgcgtggagacttcctgtccgggactggggtggggaaggtggggaggcagctggcaggtgggcagcgcaccttggtgtggtaaccgggaaacaggctctcggtcatggggcccacatacgtccgcagcagctgcagccactggtcctcgtaccccacctgcttcatgtggatgtccacggtgggcacattctcgtagcctccagccagccttgaatcctgggggcggcgggcactgagccacccgcccctccagccatggcgctccccaccccagggcagtccagcctccttcctcccgtcctccagccttcacacctgtgttcctctgtgcagaacagtcttctttgctacttctcggcctgactcactgctcccggcccttcaagtctcagctaagatgtcacctgtcctgtgaagctccctactcctcccaagtctgggtcaaggcttccccgtggcttctattgcacccaggctgctcatcgcagccttagaagctgtgtggtggctgctgctcacagcagggcagagctcgaccggcatgaggcattcctgcagtgcagtctaggacagtggcccaggaatgatttccttttctctttttttagagacagagtcttgctctgtcacccaggctggagtactgcggcatgatcatagctcactgcagcctctaactctggggctcaagtgatccttctgcctcagcctcctgaatagctgggacatgccaccatgcccggctaatttgttggtttttctgagatggagtttcactcttgttgcccagcctggagttcaatcttggctcactgcaacctctgcctcccgggttcaagcaattctacctcagctcccgagtagctgggactacaggcgcccgccaccatgcccggctaattttgtgtttttagtagagatggggtttctccatgttggtcaggctggtctcgaactcctgaccccaggtgatccacctgcctcggcctcccaaagtgctgggattacaggcgtgagccaccgcacctggcccaaactcggctaatttttaaattttttgtagagacagggtctcgctatgttgcccaggctggcctcaaactccccctgctcgagcaatcctcccgcctcagcctcccaaagtgctaggattacaggcatgagccactgtgcccagcagtaaatatttcttgaatacatgaatgaatgcagttgtgaccccagggtctgcctcccccctgggaacccctctttgctcccattttcctgattccattgtttgtttaccagatcctgcacctcctcctctgggaaggcctctgccctcctcgcccaggcccttacctcatgccggccgcctgaccactggccgtagtgctccatctctgccaccagctcatcacacatttgttctgacagcagtgggaaccagtacacgtccgggcatggctgaggatggggcgagggagaacagggctagctgacgccgcagaacggggaaggggacaggcagcaggcagaatgggaaggggcagggaggagcagggaaggctttgtgagagcagccggggacccgccaggtaggggctgagggagtggcaaggctgaggaccggtttctggcacaggagaggtggcagagggtcctggagcccctcgtgctgggacagtggtttccaaacttccgtaacagtgcatacctcttttttttttttttgagatagggtattgctctgtcaaccaggctggagtgcagtggcacaatcatagctcactacagcctcgaccttctgggctcaagcgatcctcccgcctcagactcccaagtagctggaactacaggcacatgccaccatgccaagctaattttttcttttcttttttttttgagacagggtctcgctgtgtcacccaaggtggagtgcagtggcgtgatcttggctcactgcaacctctgcctcccaggttcaagcgattctcccacctcagcctcccgagtagctgggactacaggtgcacgccatcacacctgactaatttttgtgttttttttttttttttttttggtagagacaggatttgccatgttggccaggctggtctcgaactcctgacctcaggtgatctgcctgcctcggcctctcaatgtactgggattacaagcatgagcaccactcctggcctcatttcttatttaatttttttgttgttgttgtagagacagattctcgctatgttgcccaggctggtcttggacttctggcctcaaccgatccacccaccttggcctcccaaagtgctgggattacaggcatgagccactgagcccagccccattcttcttttaagatgtgatttcaagcataacaccagtatacccaatatacaggagaagaggctgtctgatcaatgctggctttgggggcaagagtcctttctgttcggcctctgccttcatcttgtctgaacagaaaaccctcagatctctggggaactcagtgtgaaaactttgaatccaggcgggggcccccaagaggcgatggccatgagggcagggggtgggtggggaggctgcgtgggctcacctgctccacgattccttccccttccagggcccggctgtagttctcgtggatgtactgctccttccagtcctgtgagagggtggggggcacatcagatctgtgcccccctcgctcccagcccccaggggaccgccccctcccactcagtgtcctgcgctggcagcagccatcacgtttggtgtcttccttagcacaaggcggggaacctgtgtgctctgggcgtggggtccccactcacgacggggttgtcgaagatctgccagaggtcggggtgcaggtgctccgtgtcgtatctggaagtggccaggagccggccaaattcatgctgattgctcagatggaggaagatgccctgtagtggggtgggggtgtccgtgatgcaggcgatgcctggagtctgggggactgcccccaggccagaccgtgcacccgcgctcaccttgtctcgaaagctcttacagaaggccatgtccgggtctgtgtcactgcccgagaacacatccctctggggcagctccatccgcagggtatcaccccggatcacataggcctgggagatgtatggtacattccacacacccctggaggcaccgacaccgcggtcagctgggaggacagccccccaaattctgcccagctcatcccgggaagtccttcttccctcagggtatcccagtccctgaacataaggcccctgcatgtcccttgtcaagcactgctggtcccaaccaccccacctcccaaaatgcggtcagttcctaccccaagctgtggcacttcttttttgtttcttgtttttggtttttgagacggagtcttgctctgtcacccaggctggaatgcagtggtgtgatcttggctcactgcaacctccacctcccaggttcaagcaattctcccaccttagcctcccaaatagctgggattagaggtgccagccaccatgcccggctgatttttgtatttttggtagagatggggtttcaccatgttggccaggctggtctcgaactcctgacctcgagtaatccacctgcctctgccttccaaagtgctgggattacaggcgtcagccaccgcggccggcccttgttttttattttcttgagaaagggtctccctctgtttccaggctggagtgcagtggtggaaacatggctcactgcagcctcaacctcccaagttcaagtgattctcccacctcagcctccgtagtagctgggaccacaggcacgcaccaccgtgcccagctaatattttaagttttttgtagagataggctcttgctacgttgctcaggctgatcttaaactcccaggctcaagcagtcctcctacctcagcctcccaaagtggtggcatcaaaagtgtgagccactgcagccagcctcatggcacctctgactggtgaccactccaaacccctgagagtagggggcttgggtctacctgggccccgggtcggaggaggcggggggctgcaggctggcgggactcacactcgcttccgctgcaccagctccacgtagtcctcggagcgggcgtagtactcatcggggctcagggcgccccagaagttggaccacagcttgccgtggcgggacagcatgggggcgatcaccttcctgcggacaggtgggggtgagggctgggcagacgggagcaggcctggggagcccggtgcccagggcaggagtggggttcccggggcctgttggggtgccctccggctgcggggagagggggtaagccacctgttctcctcaatgaggatacgcagggtctgcaggttggtgaggacagcgtcggcgtccaggctgaagtagaactcacactcggggtcctgccgacacaggtccctggaggtgagaggcgagctgagacggcggcaggtggggaggcggtgtggatggggtaactggcccatgcccccaggagaagaggagggaggcagtgtctatccttccttccccaggctctctgctgtctgggtgagctggcaagggcaggagtgacagcatgggggctgcaaggatgcgaatggggaggcccaggaggggctggatgggtgacaggtgaggcaagggccaggcagcaggtggcagcacccctgaccctacagcctcatcccaccctctcctccccgcaagcacccgctcacatggccatgtccctggcctcgcctgggctcagagcctcctccggccccacgagcttcacagctgagaagtggtcctggagctgcggccaggagtcagcgatgtggggttcatggaagacctcctgggaggggaagacatagggggatgggctcagagggcagggaggcggcacctgagggatgggggtgcaggaaggagatgggggtgggggcacgagagttctgatcagggcagggaaagggtccctcaggagaggctccaacaggggagtctcacgttgttgtgcaggaaaagggtgaccctgtcggggggatagtccaggagtagcagccgctgcaggaagcggggcagaaacggagtaggctgttccacaaacacggccagaaacacccgggggggaggctggaagatgcaacacgcagggactcagagagaagcccggacttccctgctgcccccacccaacctccaccctgacaggtgcagggacccaggagcgatgcccccaccgccccccagtccgctgtccttgtacctcctgctcagcacgctgccctctcgtgcccctccctggcacccccacctcacctgcccccccgggagtgtcctccggtcctggttgcagaagccacagcctccctcaggagtccagccattggggacgtagtttcccaggtagttgagctgcagctgttggggacagactgaggctgagtggctgaggcctccaggggtggaggtgggggtcaggcacctctgatatgggggctgggaagggccagcttctcagaagggttggaggtgcctgggggttggggcagggcggggcgggggttgagaccactggtggcaccttagtgggaccgtttccatggaccacaatggggagcgtgtcgtaggccacgttccggatacgcacacggttccgatcaaactttaaaaccacttcatctggggaagaaaaaggccaggcttcagaccccctttctctgggagctaccaagcaacacattcttctaaatatggggtcccaaattctccagggaataaagggacaccagggctatcctggagtgtggctcgttgtgggcaggaacctttgggttctgaccaggctgctggcccagagagctccactgcctactacctgcgtgatcacaccgcagctgggcgaggaaggggagggtgagctgagcgggaggccagtaggagcctcagcatccctacccctcctcatattctctctctccttgtttttttttttttttatttttattttttgagatggagtctcactctgtcacccaggctggagtgcaatggcgtggtctcggctcactgcaacctctgcctcctgagttcaaaagattctcttgcctcagcctttcaggtagctgagactatgggcacatgccactacacctggctaatttttgtatttgtattttttgttttttatgctgagatggagtctcactcccaacacgcaggctggagtgcagtggcacgatcttggctcattgcaacttccacctccagggttcaagcgattctccttcctcagcctcccgggtagccaggattacaggcgcgcaccaccatgcccggctaatttttgtgtttttagtagagacagggtttcaccatgtcgaccaggctggccttgaactcctgacctcaggtgatccacctgcctcggcctcccaaagtgctaggattacaagcatgagccaccacacccagcctaatttttgtatatttagtagagactgggtttcactatgtcagccaggctggtctcaaacttctgacttcatgatctgcccgcctcagccttccaaagtgctgggattacagatgtgagctgtcgcacctggccttttttttttttgagaaggaatctcactctgtcacccaggcaggagtgcagtggcgcaatctcggctcactgcaagctctgcctcccgggttccagtgattctcctgcctcagccttctgaatagctgggattacaggcacccgccaccacgcccagctcatttttgtacttttttttagtagagacgggttttcgccatgttggccaggctggtctcaaactcctgacctcaagtgatcctcctgcctgggcctcccaaaatgttgggattacaggcgtgaggcaccgtgcctggcctctctctctccccgttctccccatcccctgaggcaagtcaccaacccctccacaagctgttttcctcatctgtacaagaaggataaccagggaccttccctttgttaaatggaatcacagaagtagaccgggcacagtggctcatgcctgtaatcccagcactttgggaggttgaggcaggcggatcacctgaggttgggagttcgagactagcctggccaccatggtgaaaccctgtctctactaaaaatacaaaatgagctgggcgtggtggcgcatgcctgtaatcccagctactcgggaggctgaggcagaagaatcacttgaacccgggaggtggaggctgcagtgagccaagattggaccactgcactccggcccgggcaacagagcgaaactctgtctcaaaaaaaaaagtccctggcccggtgcccaggcacagcatgtgtgcaacagatgccagacacgtttttgcttcccttgcttctggtagtaccatcagcacagtgcaacttacacaaccagccactcagacgcctgacaaaaccacatagaggtgggcttggatcagcccagctcctccagaagcctctcccagctcaagacccctagctgcagaggctgcgcatcgcccacctgcggctgtcttcctcctcacctaaagccccgttgaggttctgaaagatccgagacttatgatccagattaaggctgagtttctcctaaatggaatgagatgcgatggagtggttaaaatggaaggagtggaaaggacatcatttctcacttttctctctctttttttcttctcttgcttttgttgcttaggctggagtgcaatggcacgatctcagctcactgcaacctctgcctcccggtttaattgattctcttgcttcagccttccaagtaactgggactacaggagagtgtcaccacgcctggctaatttttgtatttttagtagagacggggtttcaccatgttggccaggctggtctcaaactcccaatctcaggtgatccacccgcctcagcctcccaaagtgctgggattataggcatgagccaccatggttttcctttttttgtgagagacagagtctcattctgtcacccaggctggaatgcagtggtgcaaaacatcctcaaactcctgggctcaagtgatggtcccacctcagcctcccaagtagctgggattacaggcgtacaccatgaagcctggctaattttttctttctttttttttgtagagatgaggtctcaactatgttgtccaggctggtcttaaattcctggactcaagcaatcctcctgcctaagcctcccaaaagtcttggatgacaggcgtgagccaccacgcccaggcacacatttttctctttgcaaccccctttgctccccaaatcccattcagcctgaggcctccactcccacagagctgcgggatgcgcccactcctctgccttccctaccctcagtcctgggtccaggtagagccgtgtgtagaacagctggtcgtcgtcatcatccttgtacttccactggcgcacgatttggtggatggtggtggcaaaaccgatgaatcctggcggggagggggagtgttgacctcgagactcccagggtcccagggcctgtcccccaggctgtctccagccctcaggcgcctttaacactctgtgtcccaccgctcttggcccctctgccttgggcactctgccactcaccaccagaattgaggaagcgcttccccgtgcccacctcagggtactgctccgccagcccccactcgggccagcagaagctctctgcagagaagagcaggcggctgccactctggacgaacttcttcagcagctctgtggggctgccggccagaatcacgtcgtagctgggtgaggaaggggaggatgggcaggggtccactgggaacctcagcatccttaccccgctccctatccccagccccgttacctatccacaaacatgatgatcatatcctcccggtcagcgtatttctccatttccttctttaaccaccggaccttctgtcctccaccaactgttcgagccacatcaccccctcgccactcctctcccaggcccagggtctgtggagaagattgccccgtgccaggcaaggggtggggagttgtggggggaactcctgaccaggcttaccgtggggacctgggcatccagacttcagcccacccctcctgctgggaccccctcccaggggcctttccctctcctcacccgcacagtgtagttgaagaactccgcagagcgcaggaaacgcaggtacccctcggtttcagctgtggccacagtgatcaccagcagcttctctgttaccagagggaaatggcacttgagatccaccgcccagctccgggcctcacgtgctttgctgtcctccctctcactcgacttccctccctttcttccttcccattcttaaactcttctcacccaggaacactctgaccccaaggagggcagggtgggagtggtgcccaggaattccgagtccctttgcatagggaggctggaaaccccagttcagggtagtgatgggcgaggggcttggcgcgactcagcctcaagagcacgctgggcgggggacgggccagacacctcctcgagcctccgaccctctccgggccaggctggcaggcacgccagcctctgccccctcggccgtgccgggcctccccgggatctcacctgggttgaccgggtctcggccccggggccggtcggaggctgaggccgcagggggcagcagcagcggcagcagcagcaggaaccggggtccaggccccgaggaggtcatggtggggagcgggcccagacagcacccaggatcctgggatctccgctacgcgcctggatcccagctccggaggggagctctggaaagggggcgctcgggctgctgtgcggccgccgcggggagcagcttggctggggctacgccctgaaaaaaaggcgtatccggaggctacagaaagctccagatgccggcgccacagacaaggcgaggattgtcccgggcgcacgggaggcgggggaggggcggcggctcgggccggcgggcgggagacagggactctgggctgagccagccgcttgacacatgtggaagctgaaacctggacaggggaagtgacccctggcggagggtcgggcgggacgcgggggcgggtcctggccgcagccctgcccagagagtgcgggcggaagacggggagagcgagaggctggcggcgacagggagggaggaagccta

SEQ ID NO: 2563 - DNA, 5291 bp, Homo sapiens
tttgtagaaatgaagtctcactgtgttgcccaggctggtcttcaactcctgggctcaaacgatcctcccaccttggcctcccaaagtgctgggattacaggcatgaggcactgcgctgggcccagaactaccttttattggaggcatggagtccacagtgggtggaggtctcagtgccttgggctcaggggctcagcgaaaggccgcggccaggcctagatgaaggtgaggcaggtggaagcggggaccccacagctttccttgtgctcctcgaagagctgctccagggccgtcatgtagagggcgtgatagtgattgacttcctcctcggtggggtggaggcgctgggggacggggatggggcggcccactgcagggagagggagacaggtgggcgagggatccctgatgcccacgcagctgctggtggccgtccccccggaggtgggcactcacccacagtggtgatgggcacagcaaagggcagcaggccccaggaggtggctgagaagagaccgcgaccccagaagatgcaaggagagaagcccatgagcttcttgaaggtgagctggcaccaatgctgccaggagcctgtggcaaaagccttaagtctaaagatgtcattctccccaaaggagtacacgggcaccagggacgccctgggaaggagcaagagagaagagggggctcaggctgctggactgctccgagatgggcacccccaggggctacaagtccttcccactacgtccagatgctacctcccagggtcattcaaagcacatgactatggctacaaagaaagatctagaagacaggactcgcatttctttctctttctttttctttgttttagagagagggtcttgtaaccacacctgtaatcccagcattttgggaggccacggtgggaggatcatttgaggtcaggagttggagaccagcctggccaacatggtgaaacccccgtctctgcaaaaacataaaaattagccaggtgtggaagtgggtacctgtaattccagctactacagaggctgaggcacaagaatcgcttgaacctgggaggcagaggttgcagtgagctaagatcacaccactgcacttcagtctgggtgacagagtgagactttgtctcaaaaaataaataggctgggtgcggtggctcatgcctgtaatcccaataccttggaaggctgaggtgggtggatcacctgaggtcaggagttcgagaccaccctgaccaatatggtgaaaccccatctctactaaaaatacaaaaattagccagacgtggtgacgtgcacctgtagtcccaggtacttcagaggcttgaactcgggaggtggaggttgcagcgagccgagatcacaccactgcactccagcctgggtgacagagcaagactccatctccaaaaattaaaaattagaaaattttaaaaaataaataatttaaaaaattttaaaagagacaaggccttgctctcttgcccaggctggagggcagtggtgcaatcatagctcactgcagcctcaaccttctccgctcaagccatcctcccacctcagcctcccgaatagctgaaacttcgggcgtgcactaccacacttggctaatttattttattttatttttgtagagatgatgtctccctatgttgcccaggctggtcttgaactcctggcttcaagtgatcttcctgccttggcctcccaaagcactgggattgcaagtgtgaaccaccacgcccagccgggactcacatttcttgagacacagttgtgtagtgggccttctcatagtcattttctcattcggtctttgcaataacaacatcgtggcaaggtaggtatcagccctcttcgcaagtaaagaaacaagtccggccgggcacggtggctcacgcctataatcccagcactttggaaggccaaggtgggcggatcacttgaggccaggaattcgagaccagcctggccaaaatggtgaaaccccgtctctactaaaaatacaaaaattagcccggagtggtggtgggcgcctgtagtcccaactactcgggaggcggaggttgcagtgagccgagaccacgcctttgcactccagcctgggcgacagagcgagactctgtctcaacaacaataacaaaaaaagaaacaagtgcaaggtcttgcctttgagttggggtcagagagggaagccagggcttctgagaccgagggccctgctatttgcattatggtcctgtctccacggatgtgggagggagcttagggtaagcgggccccatgtttggtaccgagtcatgccctggagagcccacgtgggcctcggtgcagggcagggcgctggtctctgggcacccggatcccccatgcagggacctagatgtctggggactgagagagggcataaaccagcagagaactgacaggtagggcctgcacgcgcactcacccgtgcctcagcgccaggcgcacgaagcctttgcgcttctggagcgtaaggcagtgctccccggggactgaatacagggcctcgtgcgcaccccccaccatgatgaccacggcctgcccgagctggggctgggacaggatgaagtccaggctctggcggctcaccggacagagtcctgtgggcaggaggaggtggaaagtagttcccatctgcctccacggcacccccgcccctcacccagcctttagttccaagccccctacccccatctccaaggcggggaacctacccaaatgctcactgcaagtctgggcagtgctcaggctggcccctgtcctgggtgggggacttattatgggggggggtggtcccagaggggctggggaacatctggtcaggagtctcctcccgttctcctcctcccattcggctcaccaaaggacatgatgtagtcgcgatagaccgggaggtagaagaggccagccagcacggctaaccagggccggagccccgggaagagctgggagaagccattgctctcggtggagaaattacagaggaagcctgtacacatgatcccatgagggtgggcgcccagcacgtagttccgatccgggggcagctctgctgttttcaccagcttcggggtgttgagcaggatgaagggaggatggaaggcaagacaccggctgaaaagaggggccctccaccccaacagagttccgagttaaaggttcttaggatagggtcaagggccaccccagcagagttccgagttaaaggttcttaggatagggttaagggcccaggttttttttttttttttttttgagatggagtcttgctctgtagcccaggctgaagtgcagtggcacgatctcggctcactgcaacctccgcctcttggtcccggttcaagctatcctcctgcctcagcctcccgagtagctgggattacaggcatgcgaaactatgcccagctaatttttgtatttttagtagagacgcagtttcaccatattggccaggttggtcttgaactcctgacctcgtgatctgcctgccttggcctcccacagtgctgggattacaggcgtaagccacctcacccactctctctttttttcttttctttttttgaggcagagttttgctcctgttgcctaggctggagtgcaatggcatcatctcagctcaccacaacctccgcctccctggttcaagcaattctcctgcctcagcctccagagtagctgggattacaggcatgtgccaccatgtccggctaatttgtttggtatttttagtagagatggggtttctccatgttggtcaggctggtctcgaactcctgaccttaggtgatccacccacctcagcctcccaaagtgctgggattaaaggcttgagccaccacaaccgcctttttttttttttttttttagagacggtctcactctgttgctcaggctggagtacagtggcgcaatcatggctcactacagcctccaactcctgggctcaagcaatcctcccacctcggcctcccaaagtgcttggattacaggcatgagccatggtgccccaccaaggccccgctcttgaacatcatccactcccaggccgggcgcggtggctcaaggctgtaatcccagcactttgggaggccgaggtggctggatcacttgaggccaggagtttgagaccagcctggccaacatgttgaaaccctgtctctactaaactacaaaaattagccaggcatggtggcgggcacctataatcccagctactagggaggctgaggcatgagaatagcttgaacctaggaggcggaggttgcaatgagctgagattgcaccactgcactccagcctcggtgacaggagactcagtctaaaaaaaaaaaaaaatccattccctgtcccactgcctgagcttaggcagcggggagctcaggccccagcacaaggaagggctcctaggtgtgggagggagatggggagaggtaggaagcagtttttctgcagggtgacccatcaccttgacaggataataatcccttagttgtctccaaattgcccggttccttatccactccgaacgccttccacctgcggacaatgagatactggtggacgaacccccggagtcacctcccctcaccccccatgtccccaccatctctggctacctgggcccccatccggagctcaccttggttgggtgtgtcccagtccacatagagccacaccaagtaaaaaacagagaagggccagagtgacgtgaagaggaggacaaagacaagaagggagaagaaagggcctgggggaagggagagaaagaaaagagttcacttctgaaactccatcattccctccagctgctcccttcccttcctccccttcagaacaaccagctctctcctctggccctctcccagaccagtcacctggtcactgtcctcaggcatgcaagccagcagcccagccactctccctccaagccctactcccctggcagaccccaggcacccacgcctccccagctctcacccatgaagaggaaagtgagcacatattggtaggcgcccactgcttctagatgctgcttctgcaaggttttggaagtggttgggggctgcagggttgtggcaactcccattgcagaagctcccctcttccagcaggatcccagaacccggaggacaaacgatgaaggcttggatgtggacctgggcagactttctccctacaggagcccagctttgggggcctggctaagtcgcaaatcacctcccagagtagcgtgtgtccgtaggtgtgtgagtg

SEQ ID NO: 2564 - DNA, 6488 bp, Homo sapiens
tggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttggggttagtacgcgtgcgcagcagtttcttccgacagttgtgttgtgccaatggtggagaagaaaacttcgggtatgtgagcccccgcggttcgcccccttccccttcccaagtcagtcctagaattttcttacctagtcattcctcttttttggtctcgctctttcgcctaggctggagtgcagtggcatagtcatagctcactgcagcctcgatttcctgggatcaaaccatcctcccacctcagcctccggagtggctggaactgcaagcatgaggccccacgcctggttaatttttaatttgttatgtggtgacgggctctcgctatgttgcccaggttggtctccaactcttggcctcaaagcgatcctcctgcgtgggccttccaaagtgctgggattacaggcgtgagctgccgcgcccggccccagctattcctcgtaaatcccttcctcagccctcgggtcctggcgttgacccttcattcacgttttattggtgcctgctccaagccgggcgctggggatgaagaggagaaagacccctcttatccaagcattggctttttctggaaggggggcagaaacgcagacctaacactgtattttactgtgatttgtgatttgtgctatggcagagggaagcacagcgcctgggaacagggagacgtggcatctagcccaggttctgggaggcaggggactgtgaaagcttgaaggaaaaatgaaaaagcttgaattgagtcttgaaagtctagttagggtttctctcagtgggaacctcacgtgcaaaggcagtgaagcaagaaaaagcaagtcgcttaggaagccaagttcacagtttggatcttacagagtaataagaaaggatcgaaggctggggaaaggttacattttgaaaggcattatacacactgcccaggagtttgaactctgtagggaaacactggagagccagcaaagactttttttttttagacagagtcttgctctgtcacccaggctggaatgcagtggttctatataactcactgcagcctcaacctcccatgctcaagtgattcttccacctcagccacctgagtaggtggaactacaggtgggtgcaggccaccatgctgggctagtttttatattttttgttgagatgggtgtctcactatgttgcccaggctggtcttgaactcctgagctcatgtgatcctcctgcctcggccttccaaaatgctaggattacaagtatgagccactgcgcttggcccttttagtttttctttctttctttttttttctttttgagacggagtcttgctctgtcccccaggctggagtgcagtggcgcaatctcggttcactgcaagctctgcctcccgggttcacaccattctctggcctcagcttctggagtagctgggactacaggcgcccgccaccacacccagcttatcttttgtatttttagtagagacagggtttcaccatgttagccaggatggtcttgatctcctgacctcgtgatccacccgcctcggccccccaaaatgctagaattacaggcatgagccactgcgcttggccctctcagtttttcaaaggcatcgcagtctcccagccatcagttttttcatgttggcctcaaggtctgaaataccccgctgtctcccctagccaggtcattcaccagttaggccttaacctagacttaccttcttctgggaagtcttccctgactactccaaggccaggttgggtgtttctgtcctgggctctgcagcactttatacttccgtatcctagcctactccatgctgtacttactgtgtttgtttcattaatcatttgtgtttgccactggactgtaagctttggcatccctaaaacctagagcactgcctggcatttggaggggagacagagtagtacagtgatcataatcatatttttttttgtttggttggttttgggtttttttttttttttttttttttttgaaacagggtcttgctctgtcacccaggctggagtgcagtggcacaaacacagctcactgcagccttgagctcctgggctcaagcaatccttgcgcctcagcctcctgaatagctgggactacaggtgtgtcccactacacctggctaatttttgtattttttttgtagaaacatggttttgccatgttgcccaggctggcctcgaactcccgcgctcaaacaatccacccaccttggcctcccaaagtgctgagataacaggcatgagccactgcgcctggcaaggtcatgctttttgatgctgggtagttctttgactcctgacctggccacttgttagctatgtgaactttggacacatttcttaatctctgaatgttggtaaattggggatgatgatactgtcccatacagctgttgtaagggttaaatggttcaagtgttgcaaagagctgagcacgtgcctggctcatagtaagtgtccaacaagtgatagctactggggctgctgctgttattattatgcttaacaggtggttaatgaataaagagatatattatgcaaaattatcagaatctggcaaacagctgataaggcaatgaggaaagaggttttttgttttttgtttttgagacagggtctctctctgttgcccaggctggaatgcaatggcgcgatctcagctcgctgcaacctccacctcccgggttcaagcgattcttgtgcctcagcctcccgcgtagctgggattacaggcatgtgccaccacaccctgctaatttttgtatttttagtagagacatggtttcaccacgttggtcaggctggtctcgaactcctgacctgaagtgatgagcccacctcagcctcccaaagtgctgggattgcaggggtgagccactatgtccagccgaggaaagaggtttaaaataacttctaggtttctggtttggatgtctgcatagacggttccatttgcgtagagagaatctgcaggagaagcagacttggatgggaatttttttttttttttgagttgcagtgtccacagggccagtgggtgatttcttttttccttctttctttttttttttttttggagacagtcttgctttgtcactcaggctggagtggtggcgcgatcacggcttgctgcacactgcagcctcaacctcccgggcccatgtagtcctcccaccgcagcctcccaagtaactgggactacaggcatgtgcaaccacgcctggcttattttttaattttttgtagagatggggtttggctatgctgcccaggctggtttctaactcctggcatcaagcgatcctttggcctcccaaagtgctgagattacaggcgtgcgccaccacacccggcctcaccaggcgctggctgcatggccagttctggagcccgggagcaggttctgtgttgagggagtcactctgggagtcatttgcttgtgggtgatcatcagagccctttgtttggagtcaaaatcccaggaagagtgcatagactgagcagagaagagggccagccacctccatagaggcagggagagcagccgagctggagccggaggattcctggacatggagaaggcctgcagttttgtcaaggaagcaagcaaagggtctctttctactcgatgaaggtagtcggcaccgccacagggtggacagggctcaggtccaaggaggaggaggaaggcacactggagccgctctggggcccagagcgtgggtgggtggtcccccaggatgaccaggcaggtgtcagattttggggttcaaggagaggatgggaggtgaaaaagtgacacatcacgtgagttgctgtgaaggagaaggagctgtgaagccgagtagacacatgagcgtcgccagctctttgatggaaagtgccggttgaggaggaggggttgaagatgggagagggagggaatgggctggaggtgaaggctcggggtcagtggtgggacttggggcgctccagggcaggggtgtgcccacttggcatcacgtttgtgggtaggtggcctggaagatgagcgtatccaagcatgggtggcccctggttcctttgaggtaggaggtgagatgctgagtgtgagggccatgtgtattgagggcccaggacagcctggaagccccagggcgctgtgacctccccagtcagcagtgagctgtctccaggccggggctcactggctgggactgggattgagaggaaggcggagaaaacaggcaggagaaactgaaagggtctcagctggcgggacaggaagtgtgggcccagggcttggcccgggaggagacaaggggaccaagggcttggcaatggggatgagatcagagagctgcagcttccaccccgggtgccttcctcgccctgcccagagcggcggccacactgctctttcttggaagccctgtaactttgcgtgccctgctccatccagttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggtgaggcggatggaggaggaagcgggggatgggactgagaggagggcgggagagtccgcccaactcaggctgtgggaggacccaggagctcctggtgcctctgccagtgactggctcccatggctgtgagcaaccacaccccctttctgtgcctcagtttcctctcgtgtatgtgaaataaacaagagagactggataagctctgacacgaagccttaggcttgggggcatggaggtgactgtcagctgggattggagaattggggtggagggcagaggctggtagcgaggggccgacttagagccaggagggcagggccaggtgtggtggctcacgcctgtaatcccagcatttgggaggctgaggtgggcggatcacttgaggtcaggagttcaagaccagcctggccaacatggtgaaaccccatctctactaaaaatacaaaaacaaaattagccaggcatggtggtggacacctgtaatcccagctactcaggaggccaaggcaagaaaatcacttgaacccaggagatggaggttgcagtgagtcaagatcgcaccactgcactccagcctgggtgacagagtgagactgtctcaaaaagaaccaggagggcacatgggcatggggagtgatgaaccagagaaagctgctgtctttctgggcaagtgccaagcaacggatcacccttgacccctaggaaagaaaaagaagaaaacccgaggtgatcattttaaacttcgcttccgaaaaaactttcaggccctgttggaggagcaggtgagaggagggtcggcctgggaggaccccacagggaaggggtgagcctggcccgggcaggtgttcgctgcgtgggtgggcggaggagttctagagccggccccttgtctctgcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgagcatgagacctgctgtccactcccactccctccttcccacagcctccccagacctctctcccctcatcctggcttcccctctgtctgcaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaa

SEQ ID NO: 2565 - DNA, 41609 bp, Homo sapiens
gcacatcataatcaaacttcttacaaccagtgacagaaaaccttaaaagcagccaggaaaaaaatgacatcttacacatggaagagcagagataacagtaatcttgctggaaatcacaggtagataccacttaacatccactaggttggcaaatttttaagtctgaacttaagtgttggagatgctatgaaacaaaggtaactcacagtgccaagagaggtataaactagtacagtcacttcagaacacaaatttggcattattttatcaatatatcaagcaatataactgctagatacaatgttcacagcagcattgtttcaacagcaaaaacaaataaacaaaactcaaatgtccatcaagaatgaataagttgtagtatatttatataatactatatagcaataaaaatgaaagaaagtcacagaagtaaacattttgccatttatataaaattcagaaacatacaaaattaacatttcacttacagatacatacgtatgttgtaaaactataatagacaaatgacaaacacaaaattccaaataattatttgagagggagagggccttagggaacttctaaaatgtcgacaacatctgtatcttaagctggctgatgagtacacagatatttacatttattatccctttatatatacgtttatgtatttttgtagtatgaaatacttcattaaaaaaagagtgaaaatgtaagacttcaaaaatgaagactaccatttatgtataacaataaaattagtgtaaaaaagtatacaaagaaaatgttcaattctttatctttccgtgctctatataatcagtattaatctaaagaccataatcctagtatgaaaaaaataacaagctttgacacaaaatctaagcatctgctttcctggcactcttaagttagacaagagtaaatatgttagcctctcaattctgcctcttcatctttcatctatacttagatttttctttatctttggacttctttggacttctgcttcggtctctctttttactcctttctctttcataaagatctgtttggtattttgatttatgactattactataatggccatccctctctcgagatcggctacgacttcggttctgagttcggtctctcttttcactcttttgtttctcccaacagctttcttcttcttcatagtgaccaaaccccatttctctatagatatcctgtcaaaggaagggggaattacaagtgaatcagtaaaataatcattttgtgggcattttcaattaataaaacttagaaaagtctaccattagaaggctgttataacagcttaaatgtgaacactaccactaatgtcaagaatcttgtaaattacaaagcaataaaataattcagaaaaaggtttaacaacgtcattgatttgtatctactattttggctgaaacgaaggatcagcttcaaaaatatggaactgaaatagctcaactgaaatcagaacatgtctctagagcaatctgcaaaatcaaaaattctgattatgtatagtcttattcccagctccccacccttcactcccccaaaacgtggtcccattattgatctgcaatgaaactactaaaattcccataagaatcctataagaagatatcattgaaataacttagcaggaagagatcttagacaagtcagtaagtcttaaataagaaaatggaggctggatgcggtggctcacgtctgtaatcccagcactttgggaggttgaggtggatggatcacctgaggtcaggagttcaagaccagcctgaccaacatggagaaactctactaaaaatacaaaattagccaggtgtggggacgcatgcctgtaatcccagctactcgggaggctgaggcaggagaattgcttgaacctgggaggcagaggttgcggtgagccaagattgccccactgcactccagcctgggcaacaagagcgaaactccatctcgaaaaaagaaaatggataatgtatacttgggtctgagcaattaatttttaaagtgttttattttataacagctcctctctagatgttcaaatacatcttccatgtttagaaagacagaagttagagaggagaattttttttgagacaaggtcttgctgtctcccaggcaggaatgcagtggcacgatcatggctcactgtagcttcaacctcccaggctcaaccgatccttcccacctcagtctcctaagtagctgagaccacaggcatgtgccatcacacctggctaatttttgtatttttttgtagagacggggtttccccatgttgcccagggtggtctcaaactcctgggttcaagtgatcccctcccacctcggcctcccaaagtactgggattacaggcatgagccacctcactcagctgattaggcttatgtcaaaattattatatttctttaaaatgagtttttaaacactggtagaatcctttgccccaaagataataaaattgctacatttaattctactcttagaccacagccaatgctctttcaagagatactttgtaaaatttaactttcttaagactgcccaaaggaaaggaaaattctaaggactaaactcccaagggtctcaactctatcaccagataccactgtagcagacataaatgtcaaggcttaaaattcagagtgatgaatacccatggttaaggactgggttttaagcaaattattagttattccatatactgtctagatactgtacaccttgagtttgacagtgtgtgaaaacagatgtaacaggattgttatagtaataatcacactgtgtaatacagtattataaactgatttgtgattttccacacaatcccaatagttcttgtcatattataagagtccctgaggtagaaaaaatgagtaggcattttggtttagccttttgccatcaattttctagtaaaatatgacattctgagataaaagaatttttgtgcttcctataacatatacaaaatagaaatattcatatactattatatctgtacatcttgtacttatttctgtattggttgagacaaacttttaaaatgccgagactgctggctgatgtataaatttataaaatcctcagtatgttattatacaaatgggcacttaagtgctttgagtatttaaaatagaagagataaaagattatgtagcacttcattcttttaaaaatttgaggaagctgaatatttgaattggactgaaactttaaaatcactcctactcgggagtagttttcaaagctacacaagctttgaagtcaggtagatctgggttcaaatagtctttgacatttaggagatgtgtcaaacaagtactcttaaggttagaataattagagaaggtttcatggagaagttaggatttcagatgagcctcaaagggtaagtgagcttgggtctgaatgggctgcaagaaggctaatgaaagtagtgtaagtgaaaactgaaaagcaaggaaaaatgagccctgtatgtatgaaggggaaaagttaaagtggctgaatgaagccatgtaagaggagatcctccaagtacatgctaacacagtgctaagagctttaggagtgcaatatcctcattctagaaatagggaaactgagactcaagagatctgcacaggttggagataatttaacttgacatccaaaattaaaaaggggggagtggtacagaataatggggaaaaaatccaacacctgactgaaccaaataaatgttaaaattctagctctcccactataaaggcctaagggcctgtgggatcagtatcttcatatctaaagtgagataaatgaattagataaggtctaggtcctttccagtatgaatttttaaaagttatattatttatacatttaaaacataagacaagatgattaaactaccatgtggcaaaaaaagaaaagaaaaaacgaagaacacaaaatggccaatttaaagcaattaacctagcaaatgacttgaaataagcaatcaaaaaaagtctaatctaattaaaagctatccttgctcaagtctctgggactaaatcaaagatctggttaaatcttagtcaccaagataacattaaatcactaaaatgacagaaaaagtacagtcaagaatacaaacactatgaaaaccccagtggaaaactgacaaccagcatgaatacttctcagcaaggcaacccccagctgaatacgcatttcctgtaaccccagtaaaacccaaacctcaacaacacaaaaaccatctctggaattaagacatgaggtggaaaattaaacaaacgttttcgaattgattagtaaggctagttactcaataaaaaacaaagaatttgaagaaataagttaaaatactcttgggaaaccagactcactaagcaaaacaccgacaaacaggaaaatatgaactatagctgaaatttgtctagtactgaaaattctctttaatgaattttaaaaaataaaaaacaaaataataaaaaatcggggggccattaaaatcttaaatactgatgctgagttttattaggaagaagagaaaattaatgtagctatatcattaaatcaaagtacaaaactttttaaaatttaatatactttaaggggagaagttaggagatcattattcagaatttaataattttatagttaatattgccttaaaatttcaacttaaaattgccttaaaatctttttaaaaatactaatagcattcccccaaaatcttgatgcttttactccatgcaaaatgagaaggatatttgctactgtaaggtttcaagtaatcaaacagcagaatcagaaagactcacacaaaaaaaacacaaccagtctgaaattttttagacctctgattatctcaaacacaccaatgtttatttatctcaggcttaaattcatggacggttccatgtacaagtgcaggatgaaaagctggagctaaaagcagcacatggagggggaaagaattcagagtttttagtggaaaacatgctaaacattcacaggaatgtgatacagccaccagtaaagaagactgatgcgacctcagactaaagtaatagagtacagacatttaagaaggaggagatgtgttcctattagatcacattggaatattatactatgggacaaattttattaaaataacattagagtttaggaaagaaaactgatgagaatataccccaggtaagaagacgagcaaaagtagttaggagtatgtttcaagttaagagtagttagtttcaactatgaaactaaactgtggttccactacttactagctgtgtaaaactatgggcaagtaacaatttttgttctcactttgttgtgtgaaagggggataaaagaacccaccttacattgtaaggaccaaaaaatattaactactactacttttttcttttatttaaaatttttatagagacagggcctcctatgttgcccaggctggtcttgaactctgggatcaagcgattctcctgcctcagcttcccaacatgctgggattacaagcatgagccactgcacctggcctactactacttttattaccaccgattcatgtgagaaatatttgcaggaaccaacaaaagtatggcctgaaaacgggatgaggcatgaatgatggcaatctttaaacagctaaagggctatagaaagaagaaattctatctctgctggattatagcaaagagctaactacatatatcaaatatttacttgctaaatttttttaaatcaataacccataaaacacataaaatagttacccacagagggaagaaggaaaaggggagggaacaagaatggaagctaggttctctaaatgtaccattttgtagatttcactttggaaacagtttttaaaactacaaaacaaaaaattgttaaagcaacccttaaaacattaaaaataaataaataaaaatgaaacagggccgggcgcggtggctcacgcctataatcccagcactttgggaggctgaggcaggcagatcacgaggtcaggagttcgagaccagcctggccaacttggtgaaactccatctctagtaaaaatacaaaaatcagccaggcatgatggcaggtgcctgtaatcccacctactcgggaggctgaggcaggagaatcgcttgaacccaggaggcggaggttgcagtgagccgagattgcaccattgcactccagcctgggcaacaagagcaaaactccgtctcaaaaaaaagaaagaaaagaaacactttaactgaaatatgaatctagttaatgtcataaccacagagagaaactattccaagtaactctaaaactagtaatttgctttaacagttaaaaaaaaaaagtagtaacaataataaccagtgtagaaaatgtttgcacacgcatttttttcactgaatcttaacaaaatgcctgtgaagtatttctcacttttcacagaggatgaaactgtggctcagaaagttaaacaacttgtcaaggtcactttgatggccagcagtatgtaaacctagctctcctgacagcaaatccttgactctgcctatcatactacatttctctatttctgcatctttggttaacattctcaccatcttaaattccctcccttctcacctcagcccactgaaatccttctcatccaccagggcccagcataaatgtttctatgtggtaaaacaaaagcaaggagctctgatgtaaaaaaaaaaaaaaaattttttttggagacgtggtctggctctgtcatccaggctggagggcagtggcatgatctgggctcactgcagcctctacctcctgggctcaagcgatcctctcaagctcccaagtagctgagaccataggtgcacaccaccatgcctggccaattgtgtgtgtgtgtgtgtgtgtgtactttttgtcaaggtgtgtgtgtgtgtattttttgtcgagatgggggtttcaccatgttgcccaggctggtctccaactcttaagctcaagcgatctacctgcctcggcctcccaaagtgctaggattacaggcgtgagccaccgtacccagcctgtaaattgctttttatttaactaagaaccaaagcacaggctggaaataatcacttttcttcacaataaattttctttggggaatttttattattttttttaaatgtgctgttcaggagagcttttagcatgctaaagttaattaccagtgctgtttttcttatatacaatacagcaggatataaatgttttataggatgtaaaatctcaagagcccttaagtgctatacataacacttggtgataaattaagcagataaatgacaaaatctttttcagcacaaccacacttgtttctgatgggaataaaggagtatccacaggtacggaaatcactcttgcttcacaatgtggaagtatttgatacattaagttatgtcaaaaatgatcttttatcatttgtgataaatatttttgaaaattaaaatcccataccccagtgcaaccattctgcttcttaggaacaaacccatctctgcttagaactatcccttacctcctaaattatatcactaagacatcatttacagagggataaaatatttatttctccacatctaagtctggacattagaggtacctgattagtatttttgattggcatgtagtcctcatcttctttctcttcagaacagtgatgggttttcttcttgtgttttttacttgtgtgtgagtgacttgattttgagtcttcggcctgctcatctaatataagatcgtattttgtactgcagtagttagttaaggataaatgtgataaataatactggtaagacatcaaaacttaagatctggtaaacaaaggaggtcataaggctaaaagtaactaaagcaaaaagcatctcaaaagaatatagtacatttctaaaacaaaactaacattttctttcattatatagtcaggagaaatggaaagaatcctaatcctaaacaatcttaaaataaagactagtaggcaaaaaaattaggaggaaaaaataaacgtatttgtcaataatttaaaaaatttaaatttagaaaatgagggacatctttaactagaaaaaattattataaattccaatgcccagaaaagctatataagataacaggtacatttgtatgtctcttcttttagttcaatcaagaggaaattcagcaatgcatatcgagttatcatgtttaaattcttcttattattttttttgagacggagtcttgccctgttgcccgagctggagtgcagtggcgcgatctcagctcactgcaacctccgcctctcaggttcaagcaattctcctgcctcagcctcccgagtagctgggactacaggcacatgccaccacgcctgactaattttttgtgtctttagtagaaacggggcttccccatgttggccaggctggtctcaaacacctgacctcgtgatccacccgcctcggcctcccaaagtgctgggattacaggtgtgagccaccacacctgcccatcatgtttaaattctaataagaatttatgaatacagttaaatgaacaaaaatatacataaaagccaggcgtggtggctcacacctgtaatcccagcactttgggaagccaaggcgggcgactcactcgaggccaggagttcgagaccagcctggccaatatggtgaaaccccatctctactaaaaatacaaaaattagccgggcatggtggcgcaacctataaccccagctactcgggaggctgaggcaggaaaatcatttgaacccaggaggtagagacttttgtgagccgaggttgcactactgcactccagcctgggtgacagagcggggactcagtctcaaaaaaaaaaaaaaaaaaaaaaaaaaaatatatatatatatatatatatatatacatataaaaaatatgcataatagtattacttttagtagcaaagtaggaacaacaaaatatctagtaataaagacatacttaaatgcattatagtacttcaacaagatacaatattataaatgaagttatcaacaacgataaatgctacagaaaaaaccctagaaaggtgtttatgaaaattaacatgaaaaaagcttaaagcaaaaacaacatataccatacaacgattataactttacataagagaaaggtttgaaagaaacaaggagaaataaaaagtatcatgtgtctaggtgatgaagctacgagtgaatctttttaaatttcatctaaatgtgttaaaaatgttttaatgttttaattcagagataagtattttcttaaatatactataatagaataagagaaaatataaaagagttacgatttctgctgaaaataatctcaacctcaaaggtggattttgaggaagactgacatgggctggaatggtggttttccagagaaaggttatgaggaagcccaacaggcagagctatgctaattacatgtgggaccacagtaaacgcagacacacttccctcaggactagaggctcgtgtctgcttcacaaagccacaactcaacactttccacaggaatgtctcacttctacataagatcaaatgaaagacattgttcctcctagcttcccatgagatggctaaagagggttagtcagctcgtaccattcggttatgactccattatctccaacttccctcttttcactatgctactctgtttccggggcatcttctggatcttgccttttccagatacacattccatagctcccacctatgatttcatcctaatgtgtgctctgcacatgctgctccctctgtccaaattcttcagagcactcagtcttgctctgttgcccaggctggagtgcagtggcctgatcttggctccctgcaaccaccccatccagggttcaagcaattctcctgcctcagcctcccaagtagctgtgattacaagtgcacaccaccacacccagctaattttcgtatttttagtcgagacagggtttcgccacgttggccaggctggtctcaaactcctgacctcaaatgatccacctgcctcagtctcccaaagtgctgggattacaggcatgagccactgcgcctggctcagagcaatgtttttcaaactgatgactataatccatcaatggggtataaaatctatttagtgggccacaacagcatttaaaaaaaaaaacagaaatacagtatatgcctaaaaaaattttattttattaatcttttggttcaagtgtgtgtgtgtgtgtgtgtgtgtgaatgtttgtactgtgactgtattgggttaagacaaaaactgtattttttttaattttttttttgagacggagtttcactcttgttgcccaggctggagtacaatggcgcgatcttggctcaccacaacctctgcctcctgggttcaagcaattctcctgcctcagcctcccgagtagctgggattacaggcatccgccaccacgcctggctaattttttgtatttttagtagagacggagtttctgcatgttggccaggctggtcttgaactcccgacctcgggtgatctgcccgcctcggcctcccagagtgctgggattataggcatgagccactgcacccagccaattttttttttttttttaagaaaaaaaaaatggagaccgggtctcgctatattgccctggctgctctcaaacttctgggctccagcaatcctcccacctcggcctcccacactgctgggattacaggcatgagccactgcacccagcctatttcttaaatgatggatcatacgaaagaagacagcactcccatgagccactgcacccagcctatttcttaaatgatggatcatacgaaagaagacagcactccacctcagccctcctatctcccatattagtgtcacagctttaatgccacttttttcagtgttgagggtattctctaacctctcgccccctattatgagtcccatatctctttgcaatatttatttgcaataatttagacgtatttagaatggtaattatttaatgtctggttttttttccccactccaacagcaaaatgtaagctctatgtgggcaggaactgaatatctttcattgctaaactgagtatgtgacagatgcttactaagtatctgttgattacttgtcataccctcaagacacttgttgtatctcctgcttcctcacttacccactatcttgtacttatcactaaaatcaacactttcagaagacatcaaatccctctccctttgaataaaacacaaatttgtgagctcactgccatcttttctccaatttcttccctgaggtctagttgggccaagttatttccttctcctacttctatttttgattcttcttattaataatctatactttcactaatttctctttctcttaaggcccataaagtagatgccaccatgccttcttaactgacttaagacaatttatctgcacatcagactatcccctaacagcatttctctcttttgcatcaacttcaaaaggctagaagctacactattccatataagtatatgtgtggttgtttcaattaattaaaattaaagaaaacttaaaattccccttcttccagctatagttattagtaataagcctaaatttaatttcaaagatttggtaaataaatatcaaatgtattccattcataacttttatgattttgagctttcaatcatatgcccttgaatgttgatcttttctgaccaaatctcagcttcttatttggtctgtctgcatgtgaaagcctctccttatgctgattttatcagctttcttcagactttatccagttctaacacctcacaatgctttatacattgcagacaatcaacacatcttaaaacatgaatatagaccaggtcaacctgatattcatctttcttgatgagtacttggaaaagaaatgtctacatatgtagaaaaaaaaatccctgaaataccaatagaaactaggaaacaaagacaccatttaccagaaagaatcacaacagaaataactcttgcaatgtgtggagtgatatatttataatgggaaaaattagtgaaccaatttaaatgtcataatataaacagtatgtttcattactttttacatgtctcaacctaaaacttggaagaacctgaagtaaatggtcaagtcaatggatttctttttaatcctacaaaagtgaactcttgcactcagtagaagcccaataaatatttgttgttgaaattacaatatactataccgaaagaagtaacctaacattgtaacagagaacaataggattttgttatctaggtaaggaagttaaacataacagcaggtagcacaaaggaatcagcttagcaataataaatttcagattatgaggaatagaaaacattacaattacatatagaaaatacaaagctagtgttacagctcttttagaatttgtctagtaggctttccggtttttgcaggaaagcccccccaaaaagaaaatacaaatcttacctgaagatcttctgagaatatgataagtaggaaagtacttaacctagagtaggaaagtattaataaaagaattaggctacagatttctttcaaccttaactttctccatacactagagtatagtgaaaaagcaaagtatatgtaagatcttgaaaagagataatgataaactaagttacttcctcacaaacaatctggattcaggaaatttgtcttctatagcttttgtgacttttcataacacatcacacagtactctacacatagcagatggtcaatacatattaactaactgattcttggtaaggatactcctgtttgggctttactttatctttcagaaccaaattaggtggtttatcctgttctttttcatactccttgaaatcactcttggtgtatttcccacctatttattaagaaaagaaaaaaagagcttagtaaaaaaaccacctaaccaagaacaataattattttataaaaagcataagagctattttataaatggcatatatcgagagacagagaaagggaacaaaagaatcatagtaattccatctccattactaatttgaaatcagacatccatttttgctaggtagccacatgctgccacctaacgatatatgtgaatattacaacatcaaactttcaaataaattacacacaaatgccgtgttcaagtagagccattgagcccatgagaacattaagtccagtggaaaactgaggatttgggacctgagtttaagatctgaaagacctaagtttgagagaagtgagactttaagagaccttttaaagatctaacgagatagtgtgtgcctgtaatcccatctactcgggaggctgaggcaggaggatcgcgtgaacctgggaggcagaggttgcagtgagccgagatcgtgccactgcactccagcctgagcgacagtgcgaaactccgtttcaaaaaaaaaagatttaacaagagatactctgctaaatggcaacagagcatcaggcaaatagaagagggcaggatgtgcagaagatcaccaaacagctgtgagaggagagggtgggtaatagcaccaaagacaaactgtctctactttgaaattctaacttaggggcaacttcattcctcccaagtgccaaaaatcccctcaggaaaataggacctactgctacatcctaactagcttggtagggctagaaaggaagagcattcaatgcagcctctctactctcaactctagtctcctatcagatgagaattcaattttcaagtctcctaccagatgagaattcaattcgcatccatgtcccagacctgttgactgccctgcctttcctatccctcaaccacaccactaggaaatgctgtttgtagaaaggcttcctacagaagggtcctagattaaatgtagaagtaaaacaaactggaggtacagacagaggttttgactgagaatcctatgtgtaccttgattgtcagggttttaaagggggacccatagggtaagcaaaaaagacaagatcaatctatttggcaattccagagactccagaaacaaaagtggccagcaatgtttcccataaatgtgaaacagtctactgcaagagttaaaataactggtaatggtaacaaacagccatcatttatcattgaaaaattatttgccatctgcctgccattaaaagtctcactatggatgaagcagttaccgtataacagaaagggcaccagattaatgtaagaggttcttgactgtagtgggaggtcctaggtaagacaccacttctctgcaattcattatctttatttacattatcttcatttataaactgaaaataataccaacatttcacagagttgctggaatcatcagactataaaggaaagttcttagtgctgtgaatggcacattatacacattaagtttataaatgtgaatcaataacatatataattatctcaaaattaactgagaataataaactgtatgtttatgatggcatatacaaaaccaaagcttctccctcctatgtgacattttatcttaggaaaaaacatgaagaaatttatttaaaagtcacaagaaagtagtagtatttattcaatgggtggatgggttgagaagaagacaggattgagagggtaaaaaacaaaccaaatgtagggtctgtctaaatcatctgtgtatgtgactctaggtaaatcacttctcaagattatgcctcaaattccatatctataatgaggaattataatatttatttcatacacttcccaaatgatacaattaaactagctctttggaagcagagctctacataagagccacctggcattactactggccagaactacactgcatcaggccagcagctcaccaacactttgaatatacttactggaatctttcattcacaaagttgtaattttcatatgtggaaaaaaatcttagtgcttcaatttaggtttcacaaatcactcaaacagcactgtcaaaaactagccatgtgttctaggaggaggtaaggtttcacaggagaaactaatagtacatggaactccaatccaagtcaccctctcctttatcacagagatcacagcttccactcaacattccttgcctactttagtcacattaataatttcttccttctctgaactcccataaggtaacagaatccaccaaacaattcagcaattcacaactaaatagtgtttttctttcttactaaaaacagacaaaaaaaacagttcattaaaagcatgggaaataagtgttatagaaaaagaaagtaaccctgaaattcccagtaaaatttagcattacatgtgagtaactatcaaagtgaaacctgttaaaaacactgcatcaaaaaccaaaaactcgtattatttcaacatatgagagacccaacttttaagactgacatgctacgagcaatgtatttgacatatatgtatgtgtatgtgggaaatgtaatatgtacaaaggtggaacatactgctatggacatggaagagtaaaaatttagaaaacccattaacagggctggttcattttatatactgatatgaactgatctcttagatacactgttaattaaaaaatgcaaggtacaaaaacagtatgtatagcctgcatcctttgttttatattttcctttttaaaaggagaaaatcatatatatatatatgcacatatgtattcaaaaaatgtaggggaaagttagtaccaataggtgataatggttaccctggaagagaaattagatagatgaggagcaggaatgaatgagacttttatctacctttccatggaccttttctattttgcatcatatgacaactaaaacaaacaaaaaaaatttaagttgtgcacctaaaagactcaaaacaccataaagtcaaaataattactttggaaacatatcatgtctgcagtgggtaattattagtaatttataatatagtcaaacatagaaaatataatttttcatcagtttaaaatacacgcacaggtgcacacatgcatgtgtgtgcacacacacacacacacacactctacctcagattctagatagcaggtttgtaaaattacaaatggcaggagttacatcaattaatatttctcctaattaacagcactcaataaaaggctcatacaagcatgaaaagcataacaaaaacaaggccgggcgcagtggctcacgcctgtaatcccagcactttgagaggccaaggcggtggattacctgaggtcaggagttcgagaccagcctggccaacgtggtgaaaccccatctctactaaaaatacaaaaattagctgggcatggtggcacatgcttgtaatcccagctgcttgggaggctgaggcatgagaatggcttgaacctgggagacacaggttgcagtgaaccaagatcgtgccactgcactccagcctgggcaacagagcgagactccatctcaaaaaaaaaaaaaaagcagaacaaaaacaaaagataaaccatcataccttttcctttccatttaacctttgcaaccgactggctaaaatccacatgtattcttctgtcatctataagcacattgtccattttgaagaatgctttctcacaatcttcttcctgataataattataaaaactcaagcataaatctttatggaaaagatttctgtagctagaatactgaaaatacaaaaagtttgttgttacaaaaattaatgtttgaatacttattacacacccgatgctgttaaatgctttgtatctattacctcaaatacctctggtaacaaccccatgaggtactatccattttcttaatgagaaaacagaagtttagagaagtatagaagttgttggcaagggtcagagccaggattttagagagacagtccaactgcagtgaacagataaatatacacttactgactgtattatacaggttcacaatcctttttactcaaaattcaaaaacatcctggaaagtgaaagttgtgttcctaagtttgttgttaaaattaatttggcagtaacaccaaacctaatggtaggttatgacctttttttatccacttagtatgaatattcatttgtttcactgcagaaatacttttgtgacagattatggaatgctgacccagaaaggtattacataatcacagatgtaatgtgtatgtgtgtatgcatatatacagtattacctttctgaattctgaaaaattctgaattaggaagcctagttattctcaagggttttagataatgaactgtgagactgtaataccaagctctgtgctacacaagaatccttcctgtcagtaacttcacaattctaaatccctgtttctgacactgacagttacatatttcaactcagtactgaccaattttcttttacattcctggaaacttattcttactagagataatccaaagagaagcagataaaatagttataatcatatttattacatgtcaataattaaatgaattataaaatccatgaagatatagacaaagcttgattcgtctttgtaactacatcatttagaacatcatatggcatggtatctaaaacgtaggcaatcagtgtacgtttcatgaatctgactgattattttcaggcaggtataattctatcaccatgctatatccccaaagagaaagctctgaagatcactttttcaggaggatagtatttgcaaatactcaatttacttacacctaaataatagttaataaatctcttcaaaattgagaaactgattcaaaaataaatattcaaaagtcaaaaacagctatgacaatcttcaaaaacaacaaagttggaagactcacagttatcaagacatttataaacctatagtgattaacacaatgtaacagtggtatatgaatagacaaatagatcagtgcaacagtatagcgtctagaaacagactctatacatatatggataccgatttataacaaaagtggtactacagagctgtggggcaggacaactttttttattatttttttcatcagtagagacctcagagaaaaaggacaactttttatttatgtattatttttttgagacggagtcttgctctgtcgccaggttggagtgcagtggtgcgatgctggctcactgcaacctctgcctcccgagttcaagcaattctcctgcctcagtctcccgagtagttgggactacaggcacgcaccaccatgcccagctaatttttgtatttttactagagacggggtttcaccatgttggccaggatggtctcgatctcttgacctcgtgatccacccacctcggcctcccaaagtgctgggattacaggcgtgagccaccacgcctggccaggacaaccttttaaataaatggtgctgtcacgtggcaatccaatgtatgaaaaacgaaacaatgtaatacaatacaccaaaagcaaattacagaattgaatgggaaacaatttcacaacaaagcttctaaaaataatacaggagaatatcctcatgtctttgaagtaggaaaatattttttaaataggccactaaaaaggaagaaaaatactgacaacctgaaccattaaaattagaaatttgtttataaaaagacaccattaagaaaggaaaaaggcatgcctgtggtcccagttatgcaggagctaaaattggagaatcacttgagcccatgagctcaagtccagcctgggcaacacagagtgatcctgtcccttaaaaaacaaaaaaaaagtaaaaggaaatccacagagaagatatctgtatcacacataatcaaaaaagagcttgcatccagaaaatataaagaatccttagagatcaataaaaaagtaaaacagcaggtgcagtggctcaagcctataattccagcactttgggaggccaaggcaggtggatcacttaaggtcaagagttcaagaccagcctggccaacatcataaaaccctgtatctactaaaaattcaaaaatgagccaggtgtggtggcaagcacctgtaatcccagctacttgggatgctgaggcatgagaatcgcttgaaactgggaggcggaggttgcagtgagctgagatcatgcgactacactccagcctgggtgacaaagcaaaactctgtttcaaaaaaataaaaagaaaaaaaaaaaagaagaaaatggcatagctgcaaaaaactcaaaacatgggcagtcattagtctatgtgctacaaatgaaattttatttgtgagaaaataaataatagattctatagtgtcaatgatagaatgctagtgcaggtctacaagttttcacagcaaaccaaaggtaaaggtctttctgctggcaccaatgtaccttgtaagtatcatttctggtacatctgacacagtgcctacatataactttatggtctatcttccccaaccctccatgattcatcttgtatccctaggccttattgctgtgtctgaaaacataaaaggtattccataaatgctttgtaataattagaacttagaatgagctactactggatacatatgagtccaaagttgcattaaaaaagagcataccatagcacagtgtaaactcaatgggaacagaatcagacatatctgagttcaaatcccagctatgacattcattcactaggtgtgtgattttgaacaagtcacattagcattatgtgtctcagttaacttatttggaaaaggggatggtccctatcttacagaactgtgaggattaaatgcagcaaaagtaacataatgcctagcttaaagtaaatatttaagcaacataagctatcattattacagctctagaaggggccatctattctaatacccaagttttatttataagaaggtaagacctagaaagaacggttaactaaactgccaagtatcatacaatagctggctaataacaaaagatgtattaatatctaaatcttaacacccagttcagttctctttctattactcaactttatctccacttaagtaacagggaaaaattaagagtctctgaagggctttacttagaacttaaaaagttctaagattggctgagtgttgtggcttatgcctataatcccagcactttgggaggccgaggcaggtggattgcttgaggtcaggagttcaagaccagcctggccaatatggtgaaaccctgtctctactaaaaatacaaaaaaattagcagggcatggtggtgggcacctgtaatcccagctactggggaggctgaggcaagagaatcgcttgaaccaggaggcggaggctgcagtgagtcgagactgcgccactgcactccagcctgggcaacagagtgagaccctgtctcaaaaaaaaaaaaagttctaaagatactttcatgcagattgcacctgaacctaaagtaaaagtacgtatgttaacatcaacagatgttgaacttatcccctatatagatacaataaacttaattttggggagtgccaaaagaaagggcaactctagaaactagaaaaagttctataatttttcacattttaataccatataaaagcaaataaataccaaacttatgtctgtattatgacataccttttcaaattcaataaaagcgtaacagagggactctcctgtcttccagtctcggataacttcacaactgaaagaaagtatttaaaagtgacttaaaaaaaaaaaaaaggaagaaagcattcactctcactcttcaaaactgaagaagaaataagtcagttactacaaggcaaagttaaattcatagattatttttccaaattcatttaataacaattcttttttaaaagtagttcaccagagcagtaactaaattatctaaattctactctaagtgccttatataggcctacagtcctaaattcccttaagcactgaagtaagaataaaaatatttaattttcctttggcaaaagtaaactactgctaaagacttttaaaatcacaacacttttctagtccaaatatagtcgaattatagaatatctaacatctaacattactgtagaataatgtatgcatactcatacatatataaatgtttaagttcaagctttgaaatttttgaattttaatataaatcaagctcaaatttaacactgtaagcacaatgttaattacagaactaatataccataataaccaagtgaaaaggccaataagctgaagttgaaagcacctggcttgtcccttgccccaagtgtcataagtctcattttaaaaacctcattttaaaagccgggcgcagtggctcatacctataaccccagccctttgggaggccaagacggacggatcacaaggtcaggagctcgagaccagcttggccaatatggtgaaaccccgtctctactaaaaatacaaaaattagctgggcgtgttggcgcatgcctgtagtcccagctactcaggaggctgaggcagaagaatcacttgaacccgggaggcagaggttgcagtgagccgagatcacatcactgcactccagcctgggcaacagagcgagactccatgtcaaaaaaataaacaaaaataaataaaataaaataaaatccctgaaacaaaaggaaaccctaaatataatactttttaatcaattacaaaatagtccccttcctcacagaaatactagcttcatagactttttcattaatgcagggaaaactaaccaaaagaaaaattttagaaaatttagttttaaattaattttgacataaattgctggtaattccaggagttgaatgagataaatattttaaatattaaagaaggctgttgagagtattacagaactagatttaaattgttccattcatttcctgttttagggtgaaaatgtgttgagagtgggagattcaattatttatctgtgtgtgtgtgtgcacgtatgtatgtatgtctacacacacatatatacttttcttccctactgtccaaagactcacctgtaaaaattcaccagtacaaaattcgcctagaattcacagaatcatcaaaatatgtcattagaaaaccaccaactgatacctagtttttctaaatatctctttcactaattctaaggattaccttcttattggcccaaatctagagaatattatttccagatcctcatctgtggtcactgggttcaatttacacacaaacagtacattttctggaggtttaatatctgcatcaggtaggtctcccacctaaattacaaacaaacaaaaacataaatcaattcctatttagtttccattctaaatcctatccaatcccacaatgctgatttccttaaaacatctaaatttatgttacaaactgcaggctctggaaaagaaatccaaataagatttcaaaatttgaactacactgttcctattcttaacagtgttaatagctaatatttaaataactcatactttgtgtgaacagtgcttggagcttcagatctattacgctaattcttgaaacaatcctgcaatctccattttaaagacaagtaaagcggctgagcatggtagctcatgcctgtaatcccagcactttgggaggccaaggggggcagatacttgaggtcaggagttcaagatcagcctggccaacatggtgaaaccccatttctactaaaaatacaaaaattaaacgggcatggtggtgtgcacctgtagtcctaactactcgggacactgaggcagtagaatcgcttgaacccaggaggcggaggttgcagtgagctacgccacttcaccccagcctgggcgacagagcaagactccatctcataaataaacaaataaaataaagacaagtaaagtgaaatttaaaaggttaaacaagtaacttgcccaagaccacacagtggtaaacaacagagctgggatttgaacctacatttatctggcttcaaagaccaattttacccctacttcatcttttttcaagtatttgatatattttttaaaggataagaatttatgtaaagtacatgtaagtcataaagcataaaaataaaaaccactatgatgctaccatctagcttaagaactaaaatgtcacctatcccattctccctgtgcctcctcatcagagacaacaaataccctgctttttggttttcctttttcagtcatttccttgcatatcatcagagttttaccatatatgtatgcaactctatcacatttagatggggcaacaacatccctttatacatacattcaaacactctttcagagattatttctgataagatcacctgtaaagtgtctcctcttggataaacatgcccttccccccaaaatcttgaaaataaaaaacagtaagaagcaacacagccagtaagatctcctcagtgtttctgaagtctatcaaaagacaacattatgtccaataagaagtatcacagccaggcatgatagctcacacctgtaatcccaacactttgggaggctgaggaaggaggatctcttgaagccaggagtttgagaccagcccacgcaacatagtaagaccttgtctctatagtaaatttaaaaattagccaggcatggcagtgtgagtagtcctagctattcagaaggttggatggactgcttgggttccagagtttttgaggcagcagtgagctatgatcacaccactgcactccagcctagaaaacagagtaagaccctgcctctaaaaaacaaaaaagagtgtcaaaacacagaaggagtagagcaaattagtaaaaatcctccaaagcacctataatggcagaaaggaagcacaaacgagaaaaaaagttaatgagtcaaaaaagaacttgctatagtacttggtcaaagctaactttaaaatactattaggaaatttaaaacattcataaaagctatgaggttcaaaactaattttacaaaacactagctgaattatcactatattacaaacaaatgcaataaagtaagagaaacagatattcttagaaaacagaacatggaatatgttaataaaatcaaaaggacacaggatcaccttttagagtgactaaaatccaaaaaataccatcagcaaatgctggcaaggatgtgaggcaaaagaaaccctcattcattgctggtaggaatgtaaaatgtaaagccactttagaagacagtttggcagtttcttacaaagctaaaccattcaatccagcatctgaactcctaggtatttacccaaatgcatagaaactttatgcctacacaaaaatctgcatgcaaatgtttacagcagctttaatcacaactgccaaaacttggaagcaaccaaggtatctttcaacaggtaaaaaatatacaagctgtgatacatccatacaatgaaacattacttagcaattaaaagaaatgagctatcagccatgcatggtggctcacgcctgtaatcccaacactttgggaggccaagacaggaagatcacttgaacctgggagtttgggatcagcctgagcaacatgggtaagactccatctctacaaaaaaatttaaaaattaccaaggtgtggtggcgtgtgcctatagtcccagctactcaagaggctgaggcaggaagactgctcaacctcagttcaaggttatagtgagctatgacagcaccactgcactccagcctgagtgaaagagtgagactttctctaaaaaaaaaaaacaaaaaaaagaaagaaatgaaatcccaggccgggcaacatagtgagactctgtctctacaaaaaataaaattagccgggcatggtggcacacgcctgtggtcccagctacttgtgaggctgaggtaggaggattacttgagccctggaggtcggggtgcagtgagccattattgtgccactgtccatgcaacagagcgagaacctgtctcaaataaaaaaaaattaaaaaaaattaaaaaaagggccgggcagggtgactcatgctgtaatcccagcactttgggaggctgaggcgcgcagatcacgaggtcaagagatcaagaccatcctggctaacacggtgaaacctcgtctctactaaaaatacaaaataattagccgggcgcggtggcacgtgcctgtagtcccagctactcaggaggctgaggcaggagaatctcttgaacctgggaggcagaggttgcagtgagccgagataatgccactgtactctagcctgacgacaagagcgagactccgtctcaaaaaaaaaaaaaaaaggagggaaagaaaagaaagaaaaagaaaaagggaaaggagaaagggaaagggaagaaagaaaaaaggcacagtggaaccttaaatgtatattgctaagtgaaagaagacagtctgaaaaggctacatacgctataattccaactatatgacattttgaaaatgccaaaactatatagacagtaaaaacatcagtagttgccaagaagtgggtgttgggggtggggatgaacaggtggagcccaggggattttttagacagtgaaactaccttgaatgatcctgtaagggtagatatatgctatcgtacatttgtcagttccaccgaatgtacaacacaaagcttgaattctaacgtaaatcatggattttaattaataatgtatcaatattggctcatcaattgttaacaaatgtgtcacaataatgcaagactgggggaaagagggagggagtacttagaaactctctgtactttatgttcagtttttctgtaattctaaaattgctctacaaattgtctattaaaaacaaagccaaaaaaagaatccatgagacacggataatgaacggatagataagcagttaagaagggagggctcaggcgggcacagtggctcacacctgtaatcccagcactttgggaggccgaggcaggcagatcaccaggtcaggagtttgagacaagcctgaccaacatggtgaaaccctgtctctactaaaaatacaaaaattagctgggcgtggtggcgggcacctataatccctgctacccaggaggctgaggcaggagaatcgcttaaacctgggaggcagaggttgcagtgagccaagattgcgccattgctctccagcctgggtgacagagcgagactccatctcggaaaaaaaaaaagaagggagggctcttccttacagtagaatgcaggttggtaattgtggaaaaagtggtgggggtgggaaattaccactttgcataattaccactttgcacttagcagagtcaaaactggtgcagtcaggaatcatgaatggctgagaaatttatgggggaaatttgacaaggaacaagacatttgaaagatctccaagtgtctagccacagattgtctattggagacaccaggcagtggactaccatgaccaagtgaccaaaattactcatcttccaatgaatatcgtacacctccagatgtgacctctgaggacacaacatcactcacgtactatttcggctgtgggtgcataacctgaatctaatcatgaggaaagagtagataaacctaaattgaaaaatattctattggccgggcacggtggctcatgcctgtaatcccagcactttgggaggccaaggcaggaggatcgcctgaggtcgggagttggagaccagcctgggcaacacagtgaaaccctgtctctactacaattacaaaaaattagctggatgtggtggcaggcgcctgtaatcccagctactcgggagcctgaggcagaagaatcgcttgaacccgggaggcagaggttgcagtgagccaagatcgtgccattgcactccagcctgataacagagcgagattctgtctcaaaaaaaaaaaaaaaaaaaaaattagccaggcgtgggtggcaggcacctataatcccagctatttgggaagctgaggcagctgaatcgcttgaacctgggaggtggaggttgcagtgagccgagatcatgccattgcacttcaacctgggcaacagaaactccgtctcaaaaaaaaaaaaaggaaaatattctacaaaataaatgcaacagatgataagtcacgagctggattctagtctggaggaggaaacaattataaaagatattattagaacaactggcaaaattggaatataaactgtaatttcttttttcttttttttgagacggagtctcgccctgttgcccaggccggagtgcaatggcgcgatctcggctcacagcaactttcgcctgctgggttcaagcgattctcctgcctcagcctcctgagtatctaggattacagccgcatgcctctatacccagctaatttttgtatttttagtagagacggagtttcaccatgttggccaggctggtctcgaactcctgacctcgtgatccacccgcctcggcctcccaaagtgctgggattacaggcgtgagccactgtgcccggccctataaactgtaatttctgtcacttctaaattttctgattttggtaactacactgtgaatacgtacatattgttatacacattgaatactgctgctcttaggaaatacacactgattaagaggtaaagggaaataacaggcaacttactgtcaaatagtcgagaaaaaaaatgtgtgtttatgtgcttgtataatcagagagagagaaaaagagagaatcataaaacagatgtagcaaaatgttaaaaattggtgaatgtgggtaaaaggtatatagaagttctatgtactttttcccataaatttgaaattatctgaaaacaaaaagttttaaaaagtatgttaatctattttcttctggcataaacttccaaagtgttgctgtggaaaagtctgataacaatctaaattcattcccttataagtaacttattctttctgcccaattgttcaacatatctttcaagtgtagtaattctcttagaatttgtcttggtgttgggtgttcagagtcaatactctgagatacacagtgtgctcattaaaatgtgtattttcaattaatttttttaatttcagtaaagctttcttgaactatacagcctttactatttgttcattcagacagttgatggtaatataaacttaagcctggccaacatagggagatcctgtctctacaaaaaaaattttaaaattagcagggcattgtggtgtgtgactgtggtctcagcaactcaggaggctgaggcaagggcattgcttaagctgaggagttggaagctgcagcaagctatgatcatacaccactgtactccagcctgaacaacagagtgagaccctgtctctataaaataataaataaataaactttaaaacagactacaaatctgaaagttctattatataaaatagtaactttattatccattcattccaatatttattatctatgatatgacaggtatgcctattctacaaaaataagaaatggaaaataataccaagtaggtcaattaatcatctactgaattattattccccaaatgacttcaggttgttagtaatacagagaagcagtatattttagagtgctcagtttccacccattattttgccctacaactaccattctgtttaatcttaacacttgagtggtacagtgaagaactattctttaatatacataaaattcagcctgctaaacactctttaagaatgagatgaatattaaacaactgaaattcaattaataagttagagatccacttcccactgtttaaaaaggcacttagcactatattgacagtagagtcaaatttattttcacagtagagccaatttattactatgccataccaaatttaaatcagaaaaaaatcataactcaatttttaacattttaagactactgaagagccagaaataaacactcagtaagtattattagatatattacagaacaatttgaacaaagataattatcttaccatctccaaaagtatagcctgagttttagcctctttttctgcctttatttcttctacttcctcagctgatcttcctttgaaatcatcaatttcttcatctgctcctattcgaccactctgttaagacagaagttactcatgtatatatttaaagaataaaaaaatctgagaaacatagaagacatactttattcttagttatatcaaacatgctaaaacagtaactgatcaaggttgcagtgagctacaatcacaccactgcactccagctgggtgacacagtgagatcttgtctctaaaaaaaaatttttaataattaattggacagcaactgagacaaacttataaacctccaagaattgatttatattaattctaaaatattagccaaagtgggcttctgttaaaatcaaaataggccaggcatggtggctcgtgcctgtaatcccagcactttgggagaacacgcaggtggatcacttgaggtcaggagttcgagaccagcctggccaacacagtgaaaccctgtctctactaaaaatacaaaaattagctgggcgtggtggcatgcacctacaatcccagcaactcaagaggctgaggcacgagaattgcttgaatgaggaaggcagaggccacaatgagccgagatcccaccacgcactccagcctaggcaacaaagtgagactccatctcaaaaaaataaataaatatttatatggacactatttattatccaattctaactgctgaatgaagagaaatgatctgacaattaagcaccaatcccaaccataaagacaaattcagctttcaggaagccacataaaccttaaaatatgtgggggaacagtctgcgctgtttcacagaaatttctgggttctagcctggctccagagtgtccccagttgaaaagttacctcacaagataacagtttaatttgatgacaagaaaaacactttcccaaggtgttcatgtaagcttctagagctgaggttgtctcagtagaaaagaaactgaagaaaggaaattagagaaatgagaagacagctagaaaaatgagtacctctgtggaaaagaaaaagaactccaaacttgttgaatataattaagcaagataataattcggaaaaaattaactttaacagatgaaaaagataaatccatacaaatcattaatatgaatgtacatttaatcataagagggctttacttacatctaattgttcccttgtaggttctggtgatcgatcagggattaataaatcaggagggtcatcaaatggatcatctaaaatcaccgtatgatttatccttacaaaataaatccaaatcaaatgttatacattgaagttatttcagaatcctattttattttaatagattacaaaaaattacttgattatctctaaggccaaaaaaaacccatattgcatatggatattactaacctagatatactttcacaatgagtgttactgttttgcattgagtgataccatatttatcaccctgcattactttaagatgtaaactaatataactgtctaaatcttagtacttttgccctacttctcaattaaaaaactaaattaaagcattaacaattcctccagctgggtgcagtggctcattcctgtaatcccaacacttcaggaggctgaggtgggtggatcatgaggtcaggagatcgtgaccatcctggctaacatggtgaaaccccgtctctactaaaaatacaaaaaattagccaggtgtggtggcgggcgcctgtagtcctagctacttgggaggctaaggcaggagaatggtgtgaacccgggagacagagcttgcagtgagccaagatcgcgccactgcactccagcctgggcaacagcatgagactccgtctcaaaaaataaataaataaataattcctccaaacataattataaataattagtacaagtataaaaatacaaaaagtcctttttattataaagattcttacagtcttatattaattcaccttttgggattagaattatccagaaaccagtcctatgcataccgttcctatccataccactacgtgttaaacatctcaatattaaaacattctagtacattcagatagcaaattgtaaccatacctgatatcctgatatggtacaaagtccttgtcaacaaaggtctcattaattttcttaattatgtccatgccttctgtcacctcaccaaacaccgtatggacaccatcaagataatctagattttctcctgtggtgataagaaactataaagaaggacacataataaataccataaaaataatacataactcaaactgaaatcagttacagactgacaaaaaaatacatgaaagttaagagtccacatttactgcaccaattcttagacacttgttaccaaaactaagtaaaaagtacaaagcttatactggcatacctcattttattgcactttgcagatactgcattttttacaattaaggatttctggcaaccgtgtattgagtaagtctattggtgccattttcccaacagcataggctcacttcatgtttctggctcacattttggtgattctcacaagatttcaaactttttcattactattgtatctgttattaccatctataatctttgatcttactaccgcaattgttttggggcaccacaaactgtgcccatataagatggtgaacttaatccataaatgttgtatgtgttctgactactccaccaaccagccattcccatctttctccctctcagtgctccctattccccgagacacaatactgaaatgaggccaattaaccctacaagagactcttaagtgttcaagtaaaaggaagaatggcacatctcttactttaaatcaaaagctaaaaatgattaagcatagtgagaaaggcacgttgaaagccaagataagcggaaagctaggcctctagtaccaaacaatagctgagttgtaaatgcaaaggaaaagttcttaaagaaaattagaagtgctattccagtgaacacatgaatgataaaatgaaacaggcttactgctgatatgaagaaggttttagtaatctacataggtcaaaccagccacaacgatcccttaagccaaagcctaattccaaacaagccctaactttattcaattctataaaggctgagagagggaaggtagctgcaaaagaaagtctgaagctagcagaggttaattcatgaagtttaaggaaagaggccaggcgcagtgaattactccatctcaaaaaaaaaaaaaaaagaaaagaaaaatttaaggaaagaagctgtctccataatttaaaagtgcaaggtgaagcagcaagtgctgacacagaagctacagcaagtggccaggtgcagtggctcacgcctatgtaatcccagcactttaggaggccgaggcaggcagatcacaagctcaggagttcaagaccagcctgaccaacatggtgaaaccctgtctccactaaaaatacaaaagttagccaggcatggtggcgtgtgcctgtaatcccagctactcaggaggctgaggcaggagaattgcttgaacccaggaggcgaaggttgcagtgagctgagatcatgccactgcactccagcctgggcaacagagtgagaatctgtctcaaaaaaaaaaaaaaaagaagctgcagcatgcatcaagttatctggaagatctagctaagatcactgatgaagatgacttcatgaaataacaaattttccatgaagacgaaacagccttatattggaagatgccacttaggactttcacagctagagaggaaaagtcaatgcctagcttcaaagcttcaaagacaagctgactcttctgttacatgctaatccagctggtgactttaagttgaaaccaatgctcactgactataccaaaaatcccaaggccgttaagaatgatgctaaatcggccgggcgcggtggctcacgcctgtaatcccagcactttgggaggccgaggcgggtggatcacgaggtcaggagatcaagaccatcctggctaacacggtgaaaccccgtctctactaaaaatacaaaaaattagccgggcgtggtggcaggcgcctgtagtcccagctacttgggaggctgaggcaggagaatggcgtgaatctggaggtggagcttgcagtgagcagagattgcgccactgcactccagcctgggcgacagagcaagactccatctcaaaaaaaaaaaaagaatgatgctaaatctattctgcctgtgctctagaaatggaacaacaaagcttggatgacagcacatctgtttacagcagggtttatcaaatattttaagatcactgttgagacctgccgctcagaacaaagatccttttaaatatgactgctcttttaataagaaatccttttaaaatattactgctcattgacaatactccaggtcacccaggagctctgatggatatgatgtacaaggaaattaatattgttttcagctgtgcacagtgactgacacctgtaaacccagcactttgggaggctgaggcaggtggatcacttgaggccagttcaagaccagcctggccaacacagtcaacatggtgaaaccccatttctactataaatacaaaaaatcagccgggcgtagtggtgcacacctgtaatcccagctactcagaaggctgaggcaagagaactgtttgaacccaggaggcagaggttgcagtgaggtgagactgcaccactgtactcaacctgggtgacagagtgagaatctgtctcaaaaaaaaaaaaatactgttttcatgcctgctaacataacagtcattctgcagccatggatcgaagagtaatttcaactttcaagtattactatttaagaaatacagcctgacatgtggcatgcacctgtagtcccagctactcaggaggctgaggtagaaggatcacttgagcaacgtagtgaggccccatctctaaaaataaaaattaaaaaaaaatacattttgtgaggctatagctgccatagatggtgattcctctgatggatatgggcaagtacattgaaaaccttctgaaaaagattcaccattctagatgtcattaagaacattcgtgatttgtgggaggaggtcaaaatatcaacattaacagaagttaagaagaagtagattccaaccctcatggatgactttgagtggctcaagacttcagtgaaggaagtaactgcaaatgtggtggaaactgcaagagaacgagaattagaagtagagcctgaagatgggactgaatgctgcaatctcatgatcaaacctgaccagatatggagctccttcttaaggatgagcaaacaaagtggttttcttccttttttttttttgtttgagacagtcttgctgcatcgcccaggctggagtgcagtggtgcaaagtcggctcaccgcaacctccacctcccaggttcaagcaattctcctgtctcagcctcccaagtagctgggactactggcgcctgccaccacgccgagctaatttttgtatttttagtagagacggggtttcaccatactggtcaggctggtcacaaactcctgacctcaggtgatccgcccccctcagcctcccaaagtggtgggactacaggcatgagccactgcacccagccaagtgatttactgagatggaatctactgctggtgaagatgctatgataactgttgaaatgacaacaaaaggtttaggatagtacataaacttggctgatacagtagtagcagggtctgagaggattgacttcaatcttaaaagaattctactaaatgctatccaacagcatcgtatgatacacagaaatctttcatgaaaggaagagtccatcaacatggcagacttctgttgtcttatttatttatttatttgcaagacaaggtctgtcacccaagctggagtgcagtggtacaatcacagctcactgcacccttgacctcctgggctctagtgatcctcccacctcagcttcccaagaagcaggaactacagccctgtaccaccatgctcagctaatttttgtatttttttgtggagatggggttttcaccatgtttcctgggctggtctcgaaatcctgagctcaacccatctgcctgccttgcccccgcaaagtactgggattacagatgtatgctaccacgccagtcagttgtcttattttaagaagctgccacagtcaccccaaccttcagcaatcaccacccagattagtcaacggccatcaacatcaaggcaagacccttcaccagcaaaaagattatgatttactgaaggctcagatgatcagaagcacttgttagtaataaagtattttttggtcggccacggtggctcacacctgtaatcccagcactttgggaggccaaggcaggtggatcacctggggtcaagagtttgagaccagcctggccaacatggcaaaaccctgtctctacgaaaaatacagaaagtagccgagcgtggtggtgggcatctgtaatcccgctactcgggaggctgaggcaggagaatcgcttgaacctgagaggcggaggttgcagtgagccgagatcacaccactgcactccagcctggctgacagagcaagactctgtctctaaataaataaaataaaataaaataaaacaaaatacttagacaagccatgactcaacttcatgtgtatatagtagaaaacagaagtacctactctaacaagtaggtcattgggagaattaacagggtcattgggagaattaaacaagacaatgaatagaaggtactctgcgtaatgtttttaaaaaagtaagaaatactgaaaaacggccaggcgcggtggctcacgcctgtaatcccagcactttgggaggccaaggcaggcggatcatgaggtcacgtgattgagaccatcgtggccaacatggtgaaaccccgtctctactaaaaatataaaaattagccaggtgttgtggcaggcgcatgtaatcccagctattcggaaggccgaggcaggagaattgcttgaacccgggagggagaggttgcagtgagccgaggattgtgccatcgcactccagtctgggagacagagtgagactacatctcataaaaataaattaattaattaaataaaaagaaatactgaaaaatgagccacaaatgtgaacagtgataatcacggatggtggagttgtaggtaatgtttttctttgtacttttctgtattttctcaattcttcacaataggaatgctttacatttaaaagaagaaaataatattttttaatatagaaaaagtgcattttttcccctaacacatatttctgattgaaaccctctaagccttactggatagtttaaaaaataactctgtgggctccttccagtccttcatttctaagcaaatctcatattcttactcatttcctaacctgagatccatgttgatcactgccattattcaccatggacactgtgcctttcttcttgtgcttaattcttgggactttttctgcctcaaaaaagcttgcttgatcaccatacagttggctgaaaaaacatataaggttataaatgtaagtactctcaaaatgaaatacagaagtactagtaacatacagggttatcaattatttctttacagaaatgccaacagaattcaaaatattacttttttttttttagggaacttgggggaaaaaatctaaatttaaaccatattttaaaatgcagattgaagcatgagcaattatatttttcctcatttaagaataaaagaatttgttctgcccttccagaggttaaaagtaaataaataaataaataaataaataaataaataaataaaacaacttacccaaagatagactctcctccacggccagtccctgtaggatcgccagtttgtatgataaaatccctctgtaatatgtaggattctttgttaattcacagagtttgttagatagttccaataacaaaggaaatgactaatatctaccaactcacctgtacattgtgaataaggcaataattgtaatattttattttgcacagtttcaagaaattcaagcaggctgaaagaaagtaaataccaaatttatcacagtaatccacaaacacatttttaaataagtaaagccacagtaaaatgtaatttctaaattactattaaaagaaaaaaaaagtcaaatgtccaaagctataaaaaagggcaataggccgggcgctggctcacacctgtaatcgcagcgctttgggaggcggaggtgagtggatcacttgaagtcaggagtttgagaccagcctggccaatatggtgaaaccctgtctcaactaaaaataccaaaaaaaattagccaggcatggtggcgggcacctgtaatcccagctactagggaggctgaggcaggagaatcacttgaacccaggaggtggaggttgcagtgaaccaagatcgcaccactgcactccagtctgggcaatagagcaagactctatctcaaaataaaataaaataaaataaaataaaagggcaataagtctagaaaaaaaacattttaaattacctttttttttcctttaataggagttttggggcatctgggctaatacagaaaactgacacttataagcaatcatttactgatggattgattttattacgagaaaaaagaacacttaaagagcatattgtagtagaaaaggatctagcagaatatataaaaatggatacggattatatcaattaggaaaaagtcaaacacccggggtcattttttaaataatagttaaacagccctttataaaaatccatacacttatgaacaacctttctcatacaagttaatctgcttatccaataaacatttactgagtaccttctagatgcctgacactgccatcacaaatgccattaaactgtggtccctgctcccaaaaagttcacagtctagtcgtggaaagacacattaacaagctcttaaggcactaagttagaaaccaaacagacagtaagatatatgaggcaatccctgccctcaaaaagcttacattaaattagggtccttacatctgaacacaagtagttacatactgggcatatctaattaataacatgtgtgccacttatttaaaatggtaaaaaaagtagttttaaaaattccacaagagttcaaaagattgtttctggctagggaaattagaaaacctcagggaaggttaaggcaagcattaaaagaactggactagcagagagtgaagggtgagcattttaggtctggaagactatgaaaaggcctggaagtggaaatttaaatgttttaggggaggtccaaaacaccaaagttctgtaatagtctggtattacacagtaatagagcatgaaaagactggagagataagatggggctgagctgttgaagagtgctgaatatcagtcttgcagttgtttttcttgaatatatttctgggcttcatgtttaacagataggggtggtccttttactagaaacaaaaataatgaatttaggcaatgatcatcaatggctgccaaaatctttaggtctttcatcaaaatccgatgggaacaatttataagcgcaacaaggccttaacccactgaccaattttaacatcacagagccaaccagacatcaagtgcctcctgaatgtgatgcagctgaaagtacacactatcttatatgaaatattcttgccaaaaacattaaactggaacctaatcaaggctctgaagctaaagaacaatttataggaaacaggggacacaaaaatatgttaacgcacccagtaaataatcagtcgaatccaaacaagagaaattctacaagacaaagcacccaggttgtttctcaaaattttttcaaggaaaaaagggggagaaccaatagattaaaacatatatgagacattttaaccaatatatggactttgggtcctaatttaaatcaccatattttttagaagtttatgagataataagaaagtttaaatgatactaaaaattattgctagttttttcaaagtgtgataagatctgtggttctgtttttttattcttttttacaactttttctctttcctttagtatttttcccttttccctgtcaagttttttttcttttttaacctgtcacttatgtggtacttaagctcatagttccattttttcttgttttttttaaagagacgttatattttagaaatacatactgaagtaattacagattaaatagatgcactggaggtgggggtattataaatgaagcaagattggctatgtgttcacagctgttaaacaaagctggtcatgtggacatgagagttcatttacatgattctctctacatctgtgttttaaattttctataataaaaagttaaaaaagaaaaggaagaaagaatggaaggtaggtaagtctggatatgttgatcatagattgataagtgagtataaatatagcaggtacacatgtaagcacatctccagtcatatgcttacaaatatgtacagggggtggacttattgttatgggcttatctttgcagacccactgcttgttaattgggtggggtagctctacacccctttatttcctcataactctgggaaaagaggcccatttattttgccaggtgctactctacatgggcagagcgtcaaaggaactcaaagaaaagcaaaatcaagagataaaaaacaaaattccctatgatattctttgaaacactcgatccagccactcgatccaagcttaccccagtattatgaggcaaccaattattttgtttatgccagtttgagttgggtttctatcacttgaacaaagggtcctaactaatacaacacatttatatccattagtcatcataatgaacctctagtgtgtgccctaaaagtagcagacattgtactgggtactcaggatatagagatgataattatggtatagttcctgctctcattggagtttacattcttgagcgagggcacgcttgtaaacaacaccaggataataggtaaatgttaaaataaaatgtgtcatgtggtttataaaagacctaagacacagcagaggaaccctcaggtaactctgcttagaaaggagggagagcttcaaagaagagatgatgcttgatctgagatttagataataagtagtaagtttgccagaaggacaatagtggagaagaatattgtttagaagaaacagcaaaagaatggtaacaatggtacgggagagtttgtagtgttttcgccaggtggagaggagggaggaatagctgcgtgcgagggaaagcggagcacggcaggaggtagttattgtacaatattgcaacttatttcaccttctttgataggctctgcattccatgtgggtaggaccctgtttgtaactaatctctcctggtctcagtttcttcctgactctgatacattctccacaccgctgcctattatcttctcaaaacaagtatgccatgcctcaatcctgcttttaaagtcttcaaggactctgatcatcagtagggcacacaagactattcacgactgacctaggcgtatctgaccacactcgagtctaccattccacgactcacaccagtccttccagccacaccaaactacttgccgtttccagaaaattccaaacaaagaaagtccaagctaagaaaaccctcattcccattcatctttgaaagaactagttcaagtgttctatatagtattcgctagctttgcttcttcccaccccccaccaaagaagccgccctcttctggtttccgtggcaacttacacattcttctaccataacacatagaaaactaaaatgggttcctgtgtctacttcccccagtggaaaaatcagaccctcgggggcaagaagccaagcccaggacttagcccagtgcctcgaaggctcagtccacactccagacaacctcttcctcctccacctaagcggtatgcccacactcgctgcgccaagcacaccctaactgccttcatcaagatttaaccgattacacaccaagcaatagttcctatgttcctctcacgagtaaacacaataaaggcacaaaagctatgggtattgtatgtgcagctcgaatcacacacacacacgccccacacacacactcccaaaggcaattaatgaccgcaagcaccgtccaccggactggccaacacaaaatacgggagaagggctgccaaggctcaaacgaattcccgtcacaaaaacttttctagccaaggccggttaataaaatagcccagtcgcgggcaccagcagcccagaagctcgagctctagccaatctctgccctggactgcgcagagaagggaaagtagggagacaagctcgggggccccggcgacaggtgagtggggctcaagcctcaccacgcggccgttcttcggtgtacaagtcgatgacgacgtcgcctaaagtggtctccagtagaaccgccatggcgcccgctcctcctccgctacaaaccccgggaggaggggggtgacaggcgcaggccgacggcgtcgtctacgccacgcgtcaccctcggcgcgac

SEQ ID NO: 2566 - DNA, 165175 bp, Homo sapiens
gctgcggcgagtgcggcgctgacagagacgcgcgcgcgcgcgatcgcgctcggaccccggccgctgccgccatcactgtcgcccgcccagtcgcccctcagccgcttcccctcgccatggaggcgaggccgccgccgccgccgcggggctcggagccgcgggccgggcggcggccctgagggctagtggcggcccgaaacgccgccgcggagccgaggcggagccgctgtcctcgtccccagcggtcccgcccaacgcccgactctgtgagtgttcgcggccgctgcgcccgggtgggctccggaagggggagcggctcccgggggcggtgggaggggtcccgggccacagcccagagcccggagcccgaagccctaagccatcttttccgggtagaagcctgcgggcgcctgcaggttgattgtgcatccttgcgggtccgtcgcggggagggggtccccggaaacgtgccggcccgagtgccgacccctcgcgactgcccaggaactttgcatgcgtccttctgggaccaggccagggcactgccagagttgattctcagagaagaaacttagaacggcgagaacagaatttgctcaggtccatttaatgggaggaaagaggaaaactcttggcatgagaaaatttgcttttgcagtgaccaacttttctttcccttcaagtccacctccctcggtcccccggcccgtctcccaggcccctctccttgccgccctctcccaactgttgaggctgtttaagaagggaaataagggctgagagctgcccagaattcagaataggccaattgagaacgcaggtcccctccctttttactttcggtaaataaaaaattttttttgaaaaaattagttactaattatatctcctgaagattaaaaaaaaaaaatagcagagcagagtcctgtcttgagggtttcgtttttatttttgagatcactgatgatatttgtaagacaggaaaagaagaatgtgcaaatccaccctctgcagggtgaacgccatcagaagcctttgctcaggagagggattccggctctagaaccagtccacatcaccctggagatggcttcgtttgccacctgctagctgtgcaggcagcctgagaaacagaagatggtgggcgagaggaggactgactaggaaagggcgaacatcttcctgcctggccactcctttcagaaacagatctgatgctgtcacttgtttacttaaaaactccctcgcttttctttttcccatgggatgaatgaagcctaaaatgccttatcaggtcatacaaagcccttgacaatcttgcctcaatttactcctttacttttagcctaatcggatcctccaattctccttcccctcatcccgcttgctggctagtattcagagctgcttgactgccccctcacatgttgggatgtttttgttttatgtgatcctctttcttccccacctttacctgccaagctccactttttcttttaaagttcttctcatttgagaagcttcttgcgggcaggagctgtgtcttgcccacctttctatctcccgtggtgggagaatcctccaagttgtcttgtagattctttccaatctcttctctcttatgcctaggctctgtttatttcccggtatccacttcccaagagattttttcgtgttttgaaggcctgcttggagtacatgcccaggacttttagtatttctgattcccggcttccccatgtccatcccacccagcccccataagcagtcagcaggtgggaactggtaggtcccatatcccactggcctccaaaaaactgtctctgaaagactaaaagcccttcagtctcttttcacctctgcctgctcaaagtgacctggctgataccgtgcattgtaaggcatggtgggatcccggggcctgttctctgtttagccacttaacatctgggtgaaatacagaaccagaaaaaccacccctctgacttcagtacattcatgtgtcttccctttgccaggtgaattgcttgggatacaaaagtgaggaagtcagtccttaacctttgaggaactcagagtctaatgtaggacaggtggatataaatacatcacaggtgctataagattgtgataataataatagctattttttatttgccttgtgacaagctatgtaatgttttccatgaattccctcagtcttttcaacagtcataaaagggcttattcctactctacagggttggaaactgaggccaaacagtgggcaaatgagggaatagtcaagatttgaattttggccgtgtatttgcagagcctctgccaggctgtgtagggagcatcccctgcctgggtgatttgggaaagctttcctgggacgggggggccttcggatcatgaaggatgcataggagtttgcgcgtggtggactgcacacataggcaagagggagcagcacaagcaaacttggtggtggaaggaatccactgtccttggggaggagggaagaggttaatcatagctggatcaggtaaggacaatggagagctactagaggatttaaaggaggtcagggacttgggctgaaagaattttggaaagatcatttgggggcaatatagggccaaatgcagatgcccctgcaatataggaggcactggttgggtctgacagaggtagagtcacagcctcttagacccagaggaaggtgtagagagaatcctgctcaattttgggaaaagataattaatgcagatgagagaaaaattcaaaagttctagcaatacaaaagagtatatagagaaaaatgtccctcctaccctggccccaagtctcctgtctccctaacctcctccccagagatggctgaagttttcagtttatatggccttccatagacactgttgctttataaatatgtgcctgcttatccatactcctcccaccatgggacgtaccactcacaccttactgggtttttttacttaacatatttaggaaatcattctattatcaacatatatagagagttatttgttctttctgttgacatgcttttacttatttagttgtatggctgtactgtaacatctttgggttaaatatttgtttccaggttcttctcttacagcaatgaatgtccttgtacatactgtgttatgtgctcatttgcaaagttatctgaacaatatgcttttagaagtagaattactgggtcaagggatatgtctgcatttttgatttgcagacatggagccaaactgccacccgtttctggggggttgtaccaatttatcctctcccccaaagtgtatagctggatagatgatctttggagaattcaggaggatcaactacgatgctttttcagctattatatgcctacttttcctccacaaatcctcccccaccctatgcgattctagccagtttctttgaatttacagagggagatgttgaggctcagaaggataaaagtaacttgtgcaggatgatcagtgcgggtggtggtgggtgttttgttttgtatttttgcacccctcatgtttgtatttgccagcacctttcattggaggtgctcagtgtcagtttgtaaacattattgcattatttttctccattttcacatggaaaaaaatgagatgcaggggaagtttgagttatgagagggaaactggccaaatatagaatcttgtcattttacttccagtgcaataataaatgtttccaaatgacaaagctgaagagatgttttttgtttgtttgtttgtttgtttgttttttgagatggagttttgctcttgttgcccaggctggaatgcaatggcgctatcttggctcacgcaacttttgcctcctgggttcaagcgattctcctgcctcagcctcccgagtagctgggattacaggcatgtgtcactgtacctggctaattttgtatttttagtaaagacggggtttctccatgttggtaaggctggtcttgaactcctgacctcaggtgatccgctggtcttggcctcccaaagtcctgggattacaagcatgagccaccgtgcccggtgaagaaatggttttttagtgagtctgagtacaacaaaaatagcaataatataacactaacttaataaaactgaacagcaggcccaaaaatagcccaacattaaaatttattttaatgtattctctatggaaaagagaatccattaaatgtaaaactatttattttactctaaattcacatccatttgtgtcagtgtacaagacataatttttatagtagcagtcagtacatatagaatatgatttttgaattcttcaatagcataaaatattttatatttactcatttaagtatttgttcatttaaaatcacaggctgggtgcggtggctcacgcctgtaatcccagcactttgggaggctgaggcaggtggatcatgaggtcaagagatcaagaccatcctggccaacatggtgaaaccccatctctactaaaaatacaaaaattagctgggtgtggtggcgcgtgcctgtaatcccagctactcgggaggctgaggcatgagaatcacttgaacccaggaggcggaagttgcagtgagccaagatcttgccactgtactccagcctggcgacagagcgagactccgtctcaaaaaaaagaaaaaaaaaatcacagtatagtattccatgcatcgacagctgtagttttttttaaatttgtttttgtttttttgagacagggtctcactctgccaccctggctggagtgcagtggcatgatcacagctcactgcagccttgacctcctgggctaaatgatcttcccatctcagccacctgaatagctgggactgcacaggtctgtgccaccacgaccagctaatttttttattttttgtagagacatttttatgttgcccaggctagtcttgaactcctggactcaagtgatccacccgccttggcctcccaaagtgctgggattacaggtgtgagccaccactctcagccaacagctgtagttggtgcaatcctttttattcttttatttttttctacctttttgctattataaatggtacttttataccccttgttcaaatacttcttttggattatttccttggactcttactcccaacctgggctcaccaagtcagaggatacagtttcggtgcctaattgcaatctggaaaggttgaactagtttccagcactatcagcaatttatggggccatttcttgacaacccatctagtgctattacaaagaaatgtaatgataccttgaattaggtttaatttacattgctttggaaaaagagaccagtagctgatttagattttttgaaagaagtacagtgctgtgatatagattatctccaagatttatgtaactgaagccaacttgtggttgaagaaagatttggttgatgagattgaaatattgtggaagtttagaataggatcatagcagtataaaatataaggctagatgctgttcagttggaaataccaggcattgtgccggaagctggggacaccccagagtaacatagatgtgatgtctgtcctcatgacacttttaggttagtgcagtagacagacattaaaatcacctatggtaattatagatgtgatgaaaggggaagaatagggtgtcgggagtgtcagagaagttcagcagctaaacaacatttgcagttaaacatttgtgaaggccctgagctgagaagggatttggtagctcagggcagcgcttcgctaacttgaatgtgctcatgaaccatctgggaatcttgttaaaatgccaagtcctgaatcagtaggtttggggtgggacttgggattctgtgttactaaccagctcctgggtgaggcagatgctgctggtgggtggatcacacttggtgtagcaaggcctaattgagagcttggtgagcacctaaaactggctgaccatggtgagcaggaaggggcaggtggcttgcagtgacagagtaattctctgcctaggctgcactttagattcacctggggaacttagaaaaatcagggttgcaaatgccccacccgcagccattttaatttaattggtctcagttggggcctgagaatgtgtatacagtcatgcacagtataacgatgtttccatcaaggagagactgcatatgccacagtggtcccataagattataatccataattttactataccttttctatttttagatatgtttaaatacacaaatactcactgtgttagttacttacagtattcagtacagtaacatgctgtacaggtttgtagcctaggagcagtaggctatacaatatagcctagatacgtagcaagctgtaccatctcattttgtgtaagtaccttttatgatgtttgcagaattatgaaatcacatcaggactcatcctcagaatgtgttccattgttaagtgatgcatacctgtatatatattttaactccccaggtgattctaatgtgtagccaggcttgagaactagagactaaggacagtgttgagactagagaatggcaaggagcagagttgagggtcctgtatggcatgcaaggattttggactctatcctgaaggcagagctaaatctttgaaggatttttaagcaggagagtgaactgatctgatttgcaattgttaaaaagttcactgtggctgtagtccagagcagtagttttcaaattgaggtagataagatgatccaggggaactggaagaaaatttagaactttttattgtttttatctaaaagataagataaaacatttaatttaggaattgtctctggcatcttcttgggtctataggtcaaacagttaatgtgttaactgtagaactttgggtgtcctgaaggaagagactgaattctgcagtgagcagagacatatttatacatttgttctccatgtattgcaacatgttgttaacagtttatattaaccagttctcattgaactagcctttacaaaatggacatgcagagaaaccagtgatcaaagaaaatactaataatacaagcacaagcaaacaagttgtcagagctgacacttgtccaactcctgtgatgaattcttggtgagctattcaaataagtcagctcttactaaattggaaagtatcaggaaatttataagaaacatgaactttcgtgctctgtcattaataggaatcttgctttaagattccttttaatcgtatgtagaacccagctgcacggtggctcacacccataatcccactgttttgggagcctgaggtgcaggaggccaggagctcaagacaaacctgggcaacatagcgagaccccatctctaccaaaaataaaaaattagccgtgtggtgtcacgtgcctgtagtcccacttacttgggaggctgaggcagaggattgcttgaacccaggagttcaaggctgcattgagccatgattgcaccactgtactccagcctgggggacagagggagactctgtgtctcaaaaaaaaaaagaggaggaccgggcatagtgggtcacacctgtaatcccagcactttgggaggtcagggtgggtggatcacaaggtcaagagatcgagaccatcctggccaacacagtgaaaccccatctctactaaaaatacaagaattcgccgggcgtggtggcgtgtgcctctgggtaatttcagctactcgggaggctgaggcaggagaatcctctgagcccaggaggcggagtttgcagtgagccgagatctcgccactgcactcaagcctgggtgacagagcaagactctgtctccaaaaaaaaaaaagtatgtaaaaccttgagatattaaataataaaatatgaggctgtcaccagtatgaagacatttgaaaaccaaaaatttggaacataaaaagaacctctacattttttttgcagtgatgtttaaagataaaggatattccatcagatgctttacaaaattttgctaacttcaattattaaaatttatattttgagggttttttgcttttaagagacagggtctcactctgttgcccaggctggagtacagtggcacaatgatagctcactgcagcattgaactcctgggctcaagcgatcttcccaccttggccttccaaagctctgggactacacatgtgaaccaccatgcctggccagtttttaagtttattgttcttataaaagacaaaatggggccgggtgcagtggctcatgcatgtaatcccagcactttgggaggccgaagtggacggatcacttgaggtcaggagtttgaaaccagcctggccaacatggcaaaaccctgtctctactaaaaacacagaaattagccaggtatggtgggcacacctgtagtcccagctactcgggaggctgaggcaggagaatcgcttgaacctgggaggcggagattgcagtgagctgaggttgcgccgctgtactccagcctgggagacagagcgagactgtttcaggggaaaaaaagaaaaaagacaaaaaaacacatacccttggcagattcttcctgccccacccccaaaaggcccacttaaacaaaaaatggactgatgtactacatggaaaataattttgtcaggaaatcaaaatactgttggaagatgtatagaaaacattgctgaatatgtgaacaaacaatattagaacaaattttgcagtgtgggaagtttggtatacggttataaaagtacagaagcttctagcatgtctcagtatcgctagatactcttttttttcttttctttctttctttctttttttttttttgagacagttttgttctgtcacccaggctggagtgcagtggcaccatcatggttcactgcagcattgacctcccagtctcaagtgatcatcctacctcagcctctcaagtagccaggaccacaggcatgcaccaccatacctattttttttattttttatttttaggagagatgaggtctcactatgtttcccaggctggccttgaactcctggctcaagcaatccacctgccaaaagaccttccaaagtgctgggattacaggcatgagccaccgtgccaactgtgccaggcctagattaccttttaatagttacatccaagaataaggaccacttcttttgtgagctactggaagaaagttgtactggagaagacatatttttaatagtaaatgattgccttcataagaacattactatatggaataatagactgaatgtaaattaatggaacagctgctttgactgaacaaaagaatgaaattcattcattacttctctatgggcaggctgttgagtccacttatttgttaattatcttgtggtagagttgttgatgagttttgcatttttcttttttaaaaaaatgccaactttttgttatggtaagtggctacagtttgagtaatcctaatatgaaatccaaaaggcttccaaatccaacactttttttttttttttttttttttgagacaggttctcactctgtatgtagcccaggctggagcgcagtggcatgatcatggctcattgcagccttgacctcctgggctcgggtgatcctcccacctcagcctcctgagtagctgggactacaggcatgcaccaccatgcccagctaattttgcaaccagtaggaataatgcaaatagtacaaaatctgaaaaatacctaaatctgaaacacttctggtcccaagcatttcagataaggaatactcaacctgaacctagcaaatatcatttgaaaaaataatatcttaatctgtctcttcaagtaaaagtattatttaaatagtgagtgaaaaaggaactacttcttttcttagaaagaaatgtgcaggccgggcgcggtggctcacgcctgtaatcccagcactttgggaggccgaggcgggcggatcacgaggtcaggagatcgagaccatcctggctaacacggtgaaaccccgtctccactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaagaaagaaatgtgcaatggtagagcgttttcctcgttggaattttttttacatgtaatcattataagctataacttacatattataaaattctcctttttaaaatgtacagttctgtggttttttgtatatgcatagagttgtgcagcttttgccactgtctagtttaagaacatttcatcaccccaaaagagaccctgcacccattagcctcacttcccattctctcctccctccagtccctggcaactactaatcttcctgtttctttggatttgcctattctggacatttcatataaatgaaatcatacaatatgtgaccttttgtagctggcttcttttacttagcataatgtttctggggttcattcatgttgtatcatgtatcagtacttcattccttcttatggctgaataataatccattatattgatatacgacatttggctaactggttcatcaattgatgaacatttatttgtttctactttttggctttatgaataatgctgctgtgaacattcatgtataaatttttgtgtagtcataggttttaatttctcttgggtatatatatatacctaggagtaggattgctgggttaaacggtgactaactttgaggggctgtcaaactgttttgtaaagtgactacccattcccagtagcaactcacaaaggttccagcagcaatacaataggggtccagtttctcccagcaatgcttaggggtcccaatgtctcccatctttgccaacatttgttactctctttttgattatagccatcttagtgggtgtgaagttgtatctcattgtggtttttatttgcatttccatgatgatttatgatgtgcatcttttcatgtgctgttggccgtttatgtatgttctttggggaaatgtctgttcagatacttggctcattttaaaatttagttattgctctttttattattaagttacttatatatttttagatataagtcccatatcagatatacgatctgtaaatattttttcccatctgtgggttgtgtgttcagctgtttgcgtggacatatccttttgggtagatctaggagtggaactgctgagtcaaatggtaactctctggttttttttgttttttttgtttttttttttttttgagacggagtctcgctctgtcgcccaggctggagtgcagtgacacgattttggctcactgcaagctctgcctcccaggttcatgccattctcctgcctcagcctcccgagtagctgggactacaggcgccccccaccacatccagctaattttttgtatttttagtagagatgggatttcacagtgttagccaggatggtctcgacctcgtgatccgcccgcctcggcctcccaaagtgctgggattacaggcacaagccactgcgcccggtttgaggaaccactgactttgttgaggaacagaaagaacgcctgcacctttttacaatcccagcagcagtgtatgagtgtatcagtttctccatatccttgtcaacacttgttgttttttttaactgtagccatcctagtaggtgtaaagtggtattgcattatgttttaatttgcatttccttaatgactcatgatctgactgtgattttgttgcatctataaaattctcataatttgacacatgaaaaccttagaaacaattttgtaacctaataaaaatctccaaatgtgtttctaaaaacatttccagatgatctaatgaagtaaagaatctaggcattggtcaccagtggctgttaaaaccattagggaactttataataaagggatcagtgtgacaatcttctgatcaatcataacatctctaaaattgggacaaccaaatcttatattctttctatgtgatactaggaagaacatatcattcatgaaatagtcttgcttgccccaacaaacagagtcaaaccttcctctgattagtgtagatctgattactggtttataggatataattggcaaatttagaatgtgaaaaatattataggacaaatgaacccatttacttcaaatgaatggcaagaaaaaaaaagtacacgaactgctacagattaaaaaagacttgaggctgggcgtggtggcccacgcctgtaatcccagcactttgggaggccaaggtgggtggatcatgaggtcaggagttcgagaacagcctgaccaacatggtgaaaccccgtctctactaaaaatacaaaaattagctgggcgtggtggcacgcacctataatcccagctactcgggaggctgaggcaggagaattgcttgaacccaggaggcggaggttgcagtgagatcatgccaccacactccagtgtgggcgacagagcaagactctgtcttggaaaaaataaaaaagacttgaatgaaacatattaattgaacataagtatagatcttgtttagatcctgtttcatgcaaaccaactgtaaaaagttatttatgagcccattgggagtaatttaaatttgaaaaccacttgtatattagatgatttttaaacaattttaattttttaaaggttattatagtagtatggttacattaaaaagaaagactcctttctcttacagataggtactgaagtattttggatgaaatgatgttgatatctggaatttgctttaaaataattcagcatgtttggaggattacagacgagacaagaattgccatacgttgataattattgaagctggataataggtatataagggtttattatagtattttctctactgttgtatatgtttgagaattcccatagtaaaaaattaaaagagaaaccactgtaagggaagagttttagtggatttcatgtccatttgttagaaatagaaaaatgtggccaggcacggtgactcacacctgtaatcccagcactttgggaggccgaggcgggcggatcacctgaggttgggagttcgagaccagcctgaccaacatggagaaacccccgtctctactaaaaaaaaaaaaaaaatacaaaattagcctggcatggtggtgcatacctgtaatcccagctactcgggaggctgaggcaggagacttgctttaacctgggaggtggaggttgccctgagccgagatcgcaccattgtactccagcctgggcaacaagagtgaaactctgtctcaaaaaaaaaaaaggaaaagaaaaaaaagaaaaagaaataaaaaaatgtagtatctttgattaattttcaaaagtatatcacagaagatagatatttgctagccatatttaaaaggaaatatttgtataatgggggtgaaaaaatgattatcacagtttagtaaacacagccatagtgcttcttcctttggattcatgtttctttttggttatgatagcattaaaacttggaatcaggcttttaaattgctctataatatattaaaatgagatttttcaaacataatgagaaatatttaatcatatggattgcactaaaatatttttaagatgggttttacattactattttaattgatggaagtaccattattgtgatcattatgtatttcatttgaaatgttttgtagtatttataggtattagtacctgtgttctgtttataaatgaacatgtgttggggatgtatactcttatttattggtggatgtgcagtaaaaggtttgtttgtggagaacggactgggcagggtatagagacttatttgatgtttattagagcaaatgtggccagtgatgatggtgttctggattggcttagggtgggaggagtggtgatagggatggagatacatggacaagtatgatttaagcagtagaggcattagggttctagatttctggctttttggaagagatgattgctagttaatgaactgagcttttgtgtgtgggaagaagttgaaacctggcccctgtgaattgtgcaagtagttcttaaatattgattgacaaatagcttaacgagcaactaattttcaaatattggttgacaagtggcttattacaatattgtaaatgcattgatactaccattagtaaagagaatgtcttcctttgataatgttagcagcactgttaccagagcagtgtgggatagttccaggactttcactgtctaaaaggaactggaggcccaagcttttacggggatacttctgctctcctggttcccatgtccccagtgatgtgaatgtccctgactcagtgcctctgctcacgctgtctgtgagatcactgccttccagtgcctcttacctcttgggcctgcccactttgttaacagggacagatttcacagtgatttccagccagtatttctctctccccagtttggggtgttagctagaatggtccctcaaagccctcaaacacggatgagaaatagaagaagctcagggagactatacctgggctaggttcttgctaccagctggtggaagacaaagaaaaccccttttcttcctgtatttcatgcccagtgagcagtagtgccatcagcagcagttgtgaacccctaaatcagtgattctcaatatgactgacatggtggggaagacgtaagtttgaaaatgcattttcaggctaggtgtggtggctcacacctgtaatcctagcactttcggaggccaacatgggaggatcacttgagcccaggagttcgagaccagcctgggcaacatagtgagaccctgcttctacagaaaaataaaagctagccaggtgtaatggcatgcacccatagtcctagctacttgggaggctgaggtgggaggattgcttaagcccaggagatcaaggctgcagtgaacataccacagcactccagcctgggcagcagagtgagacccctgtctcaaaaagaaaaagcatttaaaaaaaaaaaaggtttgttagtgtttgtctcaaaattttgcttaatttaaaattatgtatatatttgaataatatgtgtccatgttaatagttctaaaagtatatatagtatatatagtaaaaggtagttttctctccccctgcctttcagctttccctttccataggcatccacaagtactatgagcaatacttgtgaaaccatgctgaaatactacatgctcataaaatgtaagttacttaagtttggtatttcaagtaacaataagggaagataggagagttttatgtttatcaaaaggggtgaatgttatagcagattgagatgagatgttcttacctttgggtgggatcttaagtggagctcaattcggtttccccaatgttagtgggagagattacttaaaccatccatacttatccagttgtacttggtaagttttcaaaggttctactttgaagagggcttttgttgagcaagtagtggttaatagagcagctcagttacatgtgtaagttttttgatgtgggaaaagggcttttgtatacagaaggactattttaaaattatttgggctttaaattaacatgtattaaagtggtaaatttaaaacccagttttcttttagtcttgttattgtacttgtaagcataggcattttgtatagaaataagaatagtaattttcacctgcttgtcaattaagttaatataaatttaacagatttaattgctccaggccccttacttagtgaattaaatttccttagatgtttaaaatacatttacacagtcagtctgtcaggcacagtcagtccttgacaggtcagagttaccaccttaaacagaaacttcttaagctcttgggcaatctgtgatactaagaaattaaatttgtaaatgtagtaaaacaggttttggttaagacttccagtgcttttcattagctgaatctgaattaccaacatttaaaaaacacataccctaaacttaacgcaaaagtactactagtaccatgagtttgatataccatacctcattttattgctcatgtcttttctttctgggattgtgatgccacttacccaattaaggaggacagttttatcatctcagaaagccatggttatcagattaaaaatacagaatcatgatacagttattattggtcagagatttgagactgggaaagggaactaaggggtctgtgtttccaggataattctactcaagagatgctgtgcctttccttatgttaagagtcctgaatgtggcatcaaagggggaatccatgttcagagtttgttttgcaaccccccatacctttttttgagacaggatcttggtaggttgcccatgctggtgtgcagtggtgcaatcatggctcactgcagccttgacctcctgggctcaagtgatcctcccgcctcagcctcctgagtaagtagctgggaccacagatgtacgtcatcatgcccagctaattttttgattttttttttttttttgtagagatgaggcctcactatgagcctaggatgatctcaaattcctggcctcaaacagtcctcccgcctcagcctgcccaagtgctgggattacaggcataagccaccatgcctggccttttcttcaaaaataacccttcaatcaattttttttttcctggtcaaattggattttgtgtttcttttatatattccttgtcaggccctacagttattttaattttgggtgttggatagactagggttcatattccatgcctgccatgctttttgtgaacttgggcaaaatagttagctcttctgagactcacttttgtcacctagtaaatgggttcagctgtagtactctatgtatttgtttgttttaagcattagatagtgcgtggtaaatgcttagcacagttcttagcacatagtaaatctttaataaatgttagaaaatataatgatcttgattctctgtcttccctccctagtagttgatttggggcacagtgtagcattatttgaattatcacagaataactttttacctttctgattttaacaggggagagtgtgtaaaggatgggagagggaagagagaaaaaagctgagtaaatgtgatcaactttacagtctttattccctgaactatctttccctgagttatgtgacacattctccttgttttcctctttctatctttgtggccactcctcagttccctaggcccctcttctttgaccactccttgtttgagttaccaaagattccatctctggccttcttgtgttgattctacacgttcttcctggaagcacatgtccatggtttcagcttccttgctaattaggagaaactttgtcctcagaacccatctggattacagccaacagcctactggtctccattgggctatctcccaggtacctataacagtctcagaactgactcatcttccttttcagcgtgttatttttataatctctatcttgatgaatggcacaacacagtgacccaaactggaaacttgaatgttgttcatctggttggtgatctgttcctaactgttttacatctgtaacatttctcaaatttgcctattttccaccatttctcctatcccttaattcaggctgcttctcacctagatgactgctgcaggttcccttgttgtctactcattattagtttctcattccaagtcattgattagatggctgccaaaagtgatctctttaacttcccaactttagattctgtgaataaaatccaaactccttaacagagcaggccctcatgatccaactcctcttaacgttggtagccttatcttttctctgagcccactgccgcttgatccttggtggtgctgtgctctttcttgctctctgtctttggttggactgcccacctccctccttcttacttgacattataatttatcagatagagatcagctcctccagtcagcatttccttactgactactccaagtctgacccagtgtagattctgtgcttatatctgtcaagtcacttattgtatgataattcatacacttatatgataattcacacattggcatgtgtagattaaacatttatagtctcagaaggatcctgatagtccaaaaggtatagtaatgcagttgtctcttagtatcttcaggtgattgattccaggatcccccccatggagatcaaaatccagggatactcaggtgccttatataaaatggcatatttgcatgtaacctatgcacatcctcctgtgtactttataggccctaaataatctccagattacctatatggctaaaacaatgcaaatactatgtaaatagctgttatactgtatttttaagtttgtttcttattttatggttttatttgtttatttttttgatctgtggatgtgcaacccacagatagagagggtcaactgggccgggcgcggtggctcacacccgtaatcccagcactttgggaggctggggtgggaggattgcctgaggttaggagctcgagaccagcctggccaatatggtgaaaccgtgtctctactaaaaatacaaaaattagccaggcatggtggcaggtgcctgtaatcctagctactctggaggctgaggcaggacaattgcttgaacctgggagttgaaggttgcagtgagccaagatcctgccatagcactccagcctgggcaacagaatgagactctgtctcaaaaaaaaaaaaaaaaaaaaagaagagagggccaactgtatgtaatttactgaagcatggattcacattatagatggtccctgatttatgatggttcaacttatgatttttatactatgatggtgggaaagctggtgtgatatacgtattcagtagaaattgtacttccaattttgaaatttgatcttttcccaggctagtgatatgcagtgtgacaatttctcatggtgctgggcagaagcattgacccacacctcccagtcagccatgtgatcaggagggtaaatgagtatactccatggtgtactgtgttgccaggtgattctgctcaactgtatgctaatgtgagtgttctgaacacatttaaggtaggctaggctaactatggcattcggtaggtaaagtgtgttaaatgcatttcctacttaaacgatattttcagtttatggtgggtatattggaatatagccccattgtagggcaaggagcatctttatttacccagttgagtttagtggcagcagaactaagttcggtttagctgttcagtgagccaagcctcacttagcatctaattctgtctttattttctgctttagataggccacagctctcctgaagggattaagactttctgtgtgaaaaatggtattcagaaggaagccagcattaattctgtttttatacatttatgaagatttgaaggaatttcactgtcaattctgtcttaattgtattctgtataataaatcataatggtatccaacggctcttgaaaggtttggtttttgtgaacatttctttgaatgtcaaagttgtattagtttgtttctcaattaaactgggtgctctttgagggcagggatttatgggacttgtttgttttgcagttttatatctccagctgctaatgcagtgcctggtttgtagtaggaatgagagatttactccaatagaaccatactaaagatcttacacttatggattacagttgatagctttgtagagtgaactggtattccctttaaatgagacgacatgacctgagtataaagtataatcaactacatgactccagcaagaataccatgtgtccctcagatagcatagctggcagatggagttatgcacatcaactggacatttaagacagctggagatttcttacatttagatgacagtttagattagaaatatttaatcttagctgtacttaatatattatgtagctatatgatacatcatgtatatatggtatatcatatatatcatatatttaatcacatttaatccttagctatattttcatccccaaaatggtatatggatctgtttttattgtcagctggttatttattgttgcttatccatggctcatgaaaatcttcatgttacttgggaaatctttcactctgccttttgaaggacagcccagaaccatttccttcttggcacatgaccttctaacccagtgaccaaagagtatgtaaaagcatggtacacactgcttttgaagattacgtgtgtctattctagatgtgtcttatttcttgcagatatattgcctacaaagattttgatatatatatatacagtagactatactatataattaatatttataccagatattaaatatataagcattctactagaactaaagttaagaatttgaaatagtctcatgtgagtaattaaaataacaatagcatctttttcaagaaagttttttttaatatggtggagataatgacatggaaaaaagtagttaattatttttggtattcccgtatttcatcagtaggttgccatagaacataatagttatataatcaaacagcagaataattttatatgaggtttattgatacagaaatgtttggttcagtgtttgtcttccagttttgcagattttcttttcgattttaaaactggagaatacattaaaaccagaaactttcagcctctataatgccctcaaaactcagcaggttttgaaaatgcctcttccttctcttctcctccccataatcctgcttatttttggcattaagtgagtcaggggttccaaacccaaatacgtttttcaaggctatgtagtcagtgtgaatgagagaagtaaatctgttgggtcctgtgccacactggagtttccaaggctggtctaaatgagttcaacttcagtttttttgtgtttttttagagatggagtcttgctgtgttgcttgagctggtcttgaactcccgggctcaagtgatcttccagccttggcctcccaaggtgctagaattataggcatgagccactgtgctggccaatttttttttttttagcccactgtgctaccagtttgtgatcttcactttaactgtgaaaggactgtcaaagattgtacgtataagatttagtttgagagccaggcctggtggctcatgcctgtaatcccagcactttgggaggctgaggcgggtggatcacgaggtcaggagatcaagaccatcttggctaacacggtgaaaccccgtctctactaaaaatacaaataaattggccaggcgtggtgacgggcgcctgtagtcccagctactcgggaggctgagacaggagaatggggtgaacccgggaggcggagcttgcagtgagcagagatcacgtcactgcactccagcctgggcgacagagcgagactccttcacccaaaaaaaaaaaaaaaaagtagtttgtctttctctttgaaactgaattcattaaacaaaagcctaaataactatactattacttgttatttatttatttatttattttagacagagtcttgatctgtcagcaggctggagtgcagtggtataatcttggctcactgcaacctctgcctcccaggttcaagtgattctcgtgcctcagcctcctgagtagttgggactacaggcatgcgtcaccacacccagctaatttttgtatttttggtagagatggggcttcaccatattggccaggctggtctagaactcctgacctcaagtgatccacccacctcagcctcccaaagtgcataagtgctgggattacaggtgtgagccaccacacccagcctactacatattcttttagacccagctgaaatatcacgtaattgctgaaggctcctgaactcttccagatcagggattgattttcctcattttaagattgtcatgacaactgtagtattgataactgtattttattttattttattttttttgagacagagtgttgctctgtcacccaggctggagtgcaatggcacgatcctggctcactgcaaacttagcctcctgcgttcaagcaattctcgtgcctcagcctcccaagtagctgggattacagatgtgcaccaccaaacacctggaattagtctggctaatttttgaagttttagtggagatggggtttccccatcttggccaggctgttctcgaactcctgcctcaagtgatccacctgccttggccttccaaagtgctgggattacaggtgtgagctaccgcacccggcttattaaccaatttttaatgttcagcacaacttgatcatgatgtacaatgtcttttttatgttatgtgttgatggagtcaaattaccgatattttggttcagttttttcaataagagatcaggctattttctgattttcattctgtttttttctttgatctgtatgtatttataagtgtctcttattttcaaataggttttttctagttatctttttgtaacggatttatagattatacattgtggttaaagaatatggtctataggctgggcacggtggctcacacctgtaatcccagcactttgggaggctgaggcagggggatcacttgaggtcatgagttcaagaccagcctggccaacatggtgaaaccctgtctctactaaaaatacaaaaaaaatttagccgggcatggtggtgggtgcctgtaatcccagctactagggaggctgaggcaggagaatcgcttgaacccgggaggtggaggttgcagtgagccgagatagtgccactgcaatccagcctgtgcaacagagggagactccgtctcaaaaacaaaaacaaaaaacaaacgaaaacacacacacgcaaagaatacggcctacatgcactttcagtcctttggaaattgttggtatttatttgccatttggcctagtttacccagattccacaggttgttaatgttgtacaattgcgtcttctctttctcacttcacccatctatgtaatttttctgaatcatttgagaaataagttgcaaacataatgctgtattacccataaatcagggtgtgtttcctgaaaacaaggatactctcctataaaatcaggaaataaatattgatataatactgccatctgattcacagaccctactcaaatttcactgatcttccaattatgtcttttatagcaaaaacaaaacaacagaaaccaacaaaattccctcaagaaaacaaaagcagaaaaacttccctttccccttcacttatttctgattcagggaccattcaggattatgccttgcgtttagttgtcatgtctgttcagtctcttttaatctagaatagttctcagtctttccttattttcagtgatcctaatatttttgaagagtagagaattattttgtagcaagtcccacaatttgggttagtctgatgtttccttttgaatagatttaggttatgcatttgtggcaggaataccaaagacacgatattatgttcttctcactgcatcgtatcaagaggttcatgtcaatttgtccaattactggttatgtttaattttaccacttggttaagatgttggctggcaagtttttgtaaaattagtttagaggtatttcatacttactggttagtaagtaataatgcattttgtggggtgatgctttgagactatataaatagcttatttctcatcaaatttttgcttgctagttttaccatccattggtgatttgtgcctgaatcagttattatagtggttgctagatggtaaatttaaaaaatttcattatttcttctgaattcatcacttggcatttctttttttttttttttttttttgagacggagtctcgctttgtcacccaggctggagtgcaatggcgtgatctcgtctcactgcaacctctgcctcccaggttcacgtgattctgccacctcaccctcccaagtagctggggttacaggcacccgccatcatgccctactaatttttgtatttttagttgagatggggtttcaccatgttggctaggctggtcttgaactcttgacctcagatgatctgcccaccttggcctcccaaagtgctgggatcacaggcttgagccaccgtgcccagccaatcacttgctatttcactctaaggaaaagctttctctctctggtttttgtctttgtttttgtttgtttaaaaatcttttaaacatatgagcacagcctcattgattcttattttgttcctttttcatgtattttttgatattcaaattgtcccaaatttggccagtgggaaccctttcaggctggctcctgtgtcctttttccatgtcctcatcattctttttttttttttttttttttttgagacagagttttgctcttgttgcccaggctggggtgcaatggcgtgctctttgttcactgcaacctccacctcccaggttcaagcgatcctcctgcctcagccacccaagtagctgggattgtaggcacctgccaccacacctggctaatttttctatttttgtttttattttttttattttttgagacggagtcttgctccgtcgcccaggctggagtgcagtggcgcgatctcggctcactgcaagctccgcctctcgggttcacgccattctcctgtctcagcctccaggcatgcgccaccatgcccggctaatttttttgtatttttagtagagacggggtttcactgtgttagccaggatggtctcgatctcctgaccttgtgatccgcccacctcggcctcccaaagtgctgggattacaggcgtgagccaccgcgcctggcaatttttctatttttagtggagacaggatttcaccatgttggtcaggctggtctcgaactcctgacctcaggtgatccgcccgccttggcttcccaaagtgctgagattataggcatgagccaccacgcctggtcatgtccccatcattctttgatcactttttttcttactttttggaataataagattttctgtgggctgggcgaggtggctcacgcctataatcctagcactctgggaggccgaggctggtgggtcacctgaggtctggagttcgagaccagcctggccaacatagtgaaaccttgtctctactaaaaatataaaaattagccgggcatagtggcacacacctgtagtcccagctgctagggaggctgaggcaggagaattgcttgaacccgggaggcggaggttgcagtgagctgagattgcgccactgcactccagcctggatgacagggcgagactccgtctcaaaaaaaaaaaatttctgggctcatctttacttttgttatctcagtcgtggaatcaataattttatcagggaaccctggttccttttattagtgaatgtacttagaaaataaaatatgtgcactactagatatgttctttctattggggtgttcttccttttaggctctatgtgaggagagaactagaatattgttttaaaatgtaccaggtaatcccagcactttggtaggctgaggcaggcaaggctggcagatcacttgagatcaggagttcgagaccagcttggccaacatgatgaaaccccatctctaccaaaaaacacaaaaagtagccaggcgtggtgacacgcacctatagtcctagctagagtgagatagagtgagaccctgacttaaaaaaataaacaaataaataaaatatactggaatttaatttataggtatgaatgacacagagaggccaatattattgaaaatgtgttactcacagttcttctgaaacagcaggcgcaccatactatgcaggaccacatggggaagcaccagggtgggtcaggaggcagaaggaaccagaggaaaggatgggtgagttttttttttgttaaagtgctagaaagttgttaggtgggacatcccctattgagcagaaagagaaacacaaatgttgagatttgtggttggacggtttgtaatatgatttttgtgtagcctcaaaaacacagagatggtatgaatgtaaacaactttggtcgttaatttggcccatcctttcaagatgccaaatcatcaattacagaatatcaagaatgattatataggtatgtatgcatgtctatacatacatatatacatctgtatcttcctgtaaataatgaaagccatggtttcattccaatactcttaattctagtccaacacaatagggtttcttctggtgtttcccttttctgacattgaaaaatctgaggccaggcacagtggctcttgcctgtaatcccagcactttgggaggccaaggcaggtagatcacttaaggtcagttgctcgagaccagcctggccaacatgatgaaaccccatctctactaaaagtacaaaagttagccaggtgttgtagtagtggtcgcctgtaatctcagctactcgggaggctgaggcaggagaatcgtttgaacccaggaggtgggggctgcagtgagctgagatagcgccactgcactctagcctgggcgacagagtgagactccatctcaaaaacaaaacaaaacaaaacgaaaaatctgcctcctttttttttttcattcattcattaattctttagatggggtcttgccctgtcacccaggcggtagcgcagtgacacgattatagctcactgttgcctcaagccatcctctcgcctcagactcctgagtatctgggaccatacaggcacgtgccactgtgcttggctctcacattgtcctttttactcaccttcctgttggtgacaatctcctgactatgtaggccattttcttgcccccagccccactgaatgagctggctgatcactccttcaagttccatgagccattgttacatacaggtagtactcagtttgcttggttttgatattcataaatttccattgctgtggtttaattaaataatgccagtcctcaaatagcagttaatgaaatacaaaatataacctgtgatcaagaaaagcttctcaggtgggcgtggtggctcatgcctgtaatcccagcactttgggaggccggggcgggtggatcacctgaggtcaggagttcgagaccagcctgaccaacatggtgaaaccccatctctactaaaaatacaaaaaattagctgggcgtggtggcaggtgcctgtaatcccagctactttggaggctgaggcaggagaattgcttgaactcaggaggcataggttgcagtgacccaagatcaagccattgcactccagcctgagcaacaagagcgaaactccatctcaaaaaaaaaaaaaaatagcttctccaaaattttaaaaatttaccctgaccctgaaatagttgattgttccctccctagacatcattcagttggagctagcctaattttgttttttttgttttgttttgttttgagatggagtcttgctctgttgcccaggctagagtgcagtggcgcgatctcggctcactgtgacctctgcctcctggttcaagtgattctcctgcctcagcctccagagtagctgggattacaggcgcgcgacaccacacctcgctaatttttgtatttttggtagagacagggtttcaccatcttggccagactggcctcgaactcctgaccttgtgatccacctgcttcggcctcccaaattgctgggattacaggcatgagccaccgcacccagcctttttttttcccttgaggagaattacagtctgcactgctctcagctgaactttacacagcttttacatttccctctgtcagttcctcttgtaatggtgggtgggtagctgaagggaggatatgtacaataatgtatttttagttcctttgaacagagaggttgcttcagccattgctattgatggcaggaagtatatttatagctccagggaaggaggggtagtacgactgctggtttaagaaaacctgggagattgtatttaatatatgttgttaaaactcatttgtactttattgtaagttcttgccttagaaatgcagctgagatgaatgaacctgttacttatgttatattgttacttatgttatatatgttatatgtattattgtaagtatattgactctgctccctaatttggaaaaatcttccgttttgaaattttacaatatacaatacctaaaacaaagagtacttctagagcatacaggatgtatgtggagaattcaggtgttagcatgcaattgaacagtaaagatactgactagcagtataaatatcgtccccatttagatattttattcataaagttcttgttggtgtagcttttattgtgattttttcttttttttttttggatacagagtctcgctctgtcacccaggctagagtgcagtggcgcagtcttagctcactgcaacctctgcctcccaggttcaagtgattctcctgcctcagcctcccgagaacctgggactacaggtgagcattaccacactggctaatttttatatttttagtagagatggggtttcaccatgttggtcaggctggtctcgagctcctgacctcaggtgatgcacttccctcggcctcccaaagtgcagggattacaggtgtgagccactgcgcctggccaattgtgatttttttaaagattgaaaccaaaatattttatacagatcataagatattcttggtaaacactaagcacctcataactttaccacaattttgattgcacaactttcacctgtggttatcatgtgcaatgggcacattcaacacaaatcaaattattctgaagcttgctttctttcttttttccctactccctttcttaattgaggggagcaaaaagttggtttccagggatatgtcttctctcttatgctggtcccagattgatgcagtcatggaaactaggcagtaaactcattcttggcagctgccggcactggtctgattctttcttttaaaagcatgagattctttaataacacatattggaaagattgatgccaagtgattccaggtcatcctagaggaggcttgggaacattgttgaatagatttaaatgattcagttaagtgagtgatttaacccaaggtttgtgtctaatttaaacaggacctataaaatatagaacaattggtttgtttcttttttagaatattgaagattagattttaatttgagaattttactaatttgagggttttattttttgtttttaagcgttcaaaatgttgaattgtagatatgctgagttttataatgagcacaatgaaggtttttcaactggcccgttaaagccaacccactaatgaaatgaaaatatgaaatattatgactccataatatttcatggattttgaagctgggctgcctgggttcaaatcccatctctgctactttttgggtacgtaaccttgtgccagttacttaacctctctgtgcctcagtttcttcatctgcaaaatgggagatagtgcagtttgagtgttcctaatctgaaatctgaaatgctccaaaatctgaaactttttgaatgcctacatgactgctcaaaggaaatgcttattccatggagcatttggatttcggatttttgggttaagaatgctcaattggtaagtaagtgtaatgcaaatattccaacatctttaaaaacctgaaatccaaaccacgtctggttccaagcattttggataagggatactcaacctgtaaataatgtctgtttcatggggttgtgatgtggagtaagtgagcaaagttgtgtaatgtgcctagcttatagggaacacttagcaaatgttggctattccatttatatataagaaatagaattattggctgggtgtagtggctgatgcctgtaatcatagtgctttgggaggctaaggtgggggattgcttaaggctaggagttcaagaccagcctgggcaacatagcaagactctgactctgcaaaaaaattcacaaattagttgggcgcggtggttatatgcctgtagcccttgctactcaggaggctgaagcaggaggatcgcttgagcccaggaatttgaggctgtggtgagccatgataatgccactacactccagcttgggcaatagagtgagaccccaacttaaaaaaaagaaagaattattgatgggattgtaaaggctgaatattaaataaattcagaggaggtttttacggaacttatttgtgaaatatttttaaaggaaggaaggcatgtttgttttaggtttataagagatggcagatttaggaagctcctccctactccagatgaataagccatctgtttttctatcccttttaaggatttgcttggtgggtttccataacttttttttttttgagactggatcttttacccacccaggctggcgggcagtggcgcaatcatggctcactgcaacttcaatctcctgggctccagcagtcctcccgcctcagtctctcttgagtagctaggaccacagacgcgtgccaccatgcccagccaatttttatttatttttttgtgtgtgtggagatagggtctttctatgatgccccggctggtcttgaactcctgggctcaagtgatcttgctttggccttataaagtgctgggattacagttatgagccatggcgcccagtctatgtattcttacaaaattaaattcatgttaagtgctacactagcagaatttttaaaatttttaaatgatgcacaaatagagaagagagagtgcaaattaacgagaaataggcaagactaatttgaagaaaactatgaagctttactgaaggatttttttaaagatataaaatgctggccaggcgcggtggctcatgcctataatcccagcactttgggaggccgaggtgggcggatcgtgaggtcaggagatcgagaccatcctggccaacatggtgaaactccgtctctactaaaatacaaaaaattagccgggcatggtagcggatgcctgcggtcccagctactcgggaggctgagctggaagaatcacttgaacccaggaggcagagttgcagtgagccgagatcacaccactgcattctagcctggctagagagcaagactccgtctcaaaaaaaaaaaaaaaaaaagaataggcaaataactagagaaaaatagtccagaaacagacctgaatatatataggaatttagaatatgaaagtgtcagtgtgtaggaaggagtgaaatgaaaaaagaaagaaaaaaggaatatgttgaaagtggcattcagaaatcagggagaaaatgatcgattactaagaatgatcctgtaacagtgggctgtttggggaaaaatacgtaaagatttctaatttagactatattcaaataatcaccaaattatatagagcagggatacccaacctccaggccacagaccatcctgttaggaactgggccacacagcaggatatgaactttaggccagggaacattacacctgagctctgcctcctgtcagatcagcagcagcattagattttcataggagcacaaaccctactgcgaactgtacactccagggatctaggttgtgtgctccttatgagaatctaatgcctgatgatctgaggtgttgcagcttcatcccaaaatctgaaaccatatcctccacccctccatttcatagaaaaattgtcttccacaaaactggtccctgggtgccaaaaagattggagaccgctgataatagagtatatataatcaaattacagaaataaccacactctattcttcctctagaatatactgaatgtttcctaagaaaagttgaacactcatggctggttggctgctctctagcacatcttgccttcgtctctcactagttgaattttacacttccaggggtcagtatgtttgttccaaatctgcttatgccagttacatttagtactgtaattttataatttaattaaacattaactaatgaaatatgactgcaaaaagtagttgtttttaggaaaattaagttgtagatcttgaacaaattggataaatacaaatccccttttccccttttcaccaaattactgtcttactaattgtgggcgtgaatattttgaaagattgggggtggaaatcataaaattcttttttttttttttttttttttttgctcttgtttcccaggctagagtgcaatggtgtggtctcagctcaccacaacctctgcctcctgggttcaaatgattctcctgtctcagcctgccgaatagctgggattacaggcatgcgccaccacacctggctacttttttgtatttttagtagagacatagtttctccatgttggtcaggctggtctcgaactcctgacctcaggtgatccacccgcctcggcctcccaaagtgctggtattacaggtgtgagccaccacacctgacctcgtaaaattcttaaacgatctatactcagttgtcttacagttgcctagattcttgttccatttaaagaaactgaaatttgaaatcacaaatgtggattatggatatgatgggttatggatatgatatatttgtaatgaatatgcaagagagaacatttgaaacattaattagtagaaatgtacttaaagaagaggccttggttttttaccgtaatattggcaggtgacatgtatttgttttgagtaaaaatcaaatatttcagttacatttttaaaattacctgatatactgtactttttcatgtaaccagtcagccctgagtcctatttgtgttagataagtttttaccaatcccagaaggagatagaggacaagcttttatatgcttcggctgaagaaaacctttctccaaagaagtaattatctgatcctcctataaagggccagatagtaaatattttagattttgcaggctgaagtagaatcaagggtaatacgtacgttctgatataacaagagagaaaacaaattttgagaaatttcttaattgattaaattcaaaataataaacacaatttattgaaatacaggtatactaatgagaagaatggagttcttttcggagtgataacattttcttaattggagttcagagttagtgcttcctattcaataaataatcatcaaaattgattgcaagtatttatctattaatgcaggtctgtaatgaggttttatatatttcatctttgacatgtcttcacacatacatgtcaaataattgataccagcccataaacatatgattttaattgagcatattaataactcaggaagcatttatagaattaggtttttcttataacatttaccttttagtatattattcattgctgcttaattacttccaatggaaggttagacagaagctccacaattgcactgttaaatagatactgaaatatagatatttccttgtgcattaaggtcctaaaaattattctggaaatgtagtgtgagctaagaaactatatccactgcaaatttgtttgggaatggagatctcacttcttgttttaacttttgatagcatgtaaagtgtataaagcagctcaacgttgcttatgattcaaaagttagttgtctaaataacaacagtttaagtttcatatataagtgttgttctgtcctgtaattttaagttgaatttactattataaaattagcaaaagctaattctcaaagccatttattgtttgatcatagtgtctgaaagcagtcttattgttgtgaaaaatttcaatctcagttccaagctgaaaagaaaaaaaaaaaagcatgataaaactttagtacagctcagccgtcaaactgctgtgtgcctgggcaagtcaggttattcagcttctgtttctgacaatggttaagcccatggcagtgaatgaaattcaccattaacatggttggtttaataattcatgataaattcagatatttttcatagaatatctattgataaaaaacatgaataaccaccttacattttcacgttttataaatcacccaactaagcctttttctgcttcacacatatttttaccattatcaatgataacgtatctgagattccactttaggttatatggaattagtactttttcaccttcttgtttgtagttgttcaacacagactattcatagaagctaattcttcagttgttttaaacttggcactgactccttgaataaacatctgaacagtgttgtaacatctatcaaactcattcaaaagagatggaaatctacttaacctcaattgccttggttttttttttaaacagattattgatcttgctcctaatattttcgacttttagagcaaatgattttgttgaaaggctaatagtctttttttctttttaaattatcttatattaaatttaaaaaataatttttttgttacctgtctggagaaagcctagagaaaggctaattaatactcttaaacaagtttattttctctggatacatttcttcagcttcttcatgatttaattcacttatcactagaatattacttttcttgctttgctaacaaatgagctacttagaaacttccctcctttacaaactttctattccttaccttccctccttgctgtaatgaaatattccactttaaattttcaaatttttctgaccattgctttcctgtgaatcggaaatactgtgatcggtccttagtttggtaacattgatgtattttgaattcttttagcacagacagacagttgactccttgaacaacgcagtttcaaactgcacaggtccaattatatgagaattttttttcaataaatacaatcagcagtttatacatatacaaccaaacgtggatcaaaaatacgttatttgaggaaacccccagatacagaacagtgaaatttttgtatcctctgggccactgtgggacttgagtgtgcatagattttggtatccacggttgatccacagataccaagggatgaccgtagagtcattgcataataaacaaaatgcttccctatcttgtcttgataaaataatgcataccctccactgtgccttaaaagcatgacattcaggctgggtgtggtggctcacacttgtaatcccagcacttttggaggccagggtgggaggattgcttgagcccaggagttcaagaccagccttggcaacatagtgagagtccatctctagttttaaaaaaatacaaaattaaaaaaaatgaaaaacatgacattcaaagtgcatttgtttttgtttcgacatgatggttatgcactaataactaatgatagttatgtactaataaaatgtcaaaataataacgacttttagttactgataacagttatgcattaataaaaaataaaatgtcacagtatgacaatatgcatgtgtggcaccaaacatgctgttgagttataactttgtgactgtgatttgtgggatactgagcagcagtggaaagctatataagccactccactctgccagtcagtacagtggctgattaccaattatggataaccagaacacatcaaaaagcagttcaacaaggatcagaataataacatgtaagtaccatttattaagtagttatgtgtaaggcactgtgtcagactgtataatgtacattatttaaccttcaaaagattgagagggaagatcccttgagtctgggaggtcgaggttgcagttagctgtgattgcaccactgcactctagcctgagtgatggagcgaaatcctgtctcaaaaaacaaaacaaaacaaaacaggcctggtgcggtggctcatgcttgtaaatcccagcactttgggaggctgaggctgaggtcaggagtttgagaccagctgggccaacatggcgaaaccacgtctctactaaaaatacagaaattagttggtgtggtggctcacacctataatcccagctactcgggaggctgaggcaggagaattgcttcaacccaggaggcggaggttgcagtgagccaagatcatgccactgcactccagcctggatgagagtgagactccatctccaaaaaaaaccaaaacaaaacaaacgaaaactacaaaagattgtctgaagccagccacagacaatagtaaatgaatgagtgcagctacattctttcttatttatggatgcagaagtttgaatttcatataatttttccgtttcacttatatataaattatatattatatattacataatatataatatatattataagataatataatatatattagataatatatataatataagataatatatattagataatatatataatataagataatatatattatataatataattaaaatatattaattataatatataatatatgacatatatatgttatatattgttatatataatatgtgtaattatatattataatatatgatatatatataatctatcatatatcatatatataatctatcatatatcatatataatctatcatatatcatatcatatataatatatatcatatcatatataatatatatgatgtatagtatatatgatatataacatatatataatatatgatgtatagtatatatgatatataacatcatatatactatacgtcatatataatatgacgtatagtatatatgatatatgatatatatactatattgtatatgatatataatatgtattgtatattatatataatatatatataaggcacagtggagggtatgcattatatataatatgtattatatattttatatattataatatatattttatatataatatattttgtatattatatattttatatataatatattttgtatattatatattttatatataatatattttgtatattatataatatataaaatgtatattatatataagtaaagtatatattatatataatttttatatatactttttttttttttttttttttagactggatcttgctctgtcacccaggctggaatggagtggctgggactacaggtgtgtgctatcatgcccagctagttttttttttgttttttttttgttttttttaattttttttttttttttaagacggagtctcgctgtcacccaggctggagtgcagtgacatgatctcggctcactgcaagctccgcctcccgggttcacaccattctcctgcctcagcctcccaagtagctgggactacaggcacccaccacacgtccagctaattttttgtatttttagtagagacggggtttcactgtgttagccaggatggtctcgatctccggacctcatgatccacctgccttggcctcccaaagtgctgggatcacaggtgtgagccaccgcacccggcctactttttattttaacttttttttttttttttgtagagatgtggtctcactgtgttgcccaggctggtctcaatctcctggggtcaaacagtgctcctgcctcggcttcccaaaatgttggtattacaggtatgagccactttgcctggctatcttataaataattttgatgttaggaatttttagttgcttttatttttatttttgttgttttaaatatttattaatagaagcaaggggtggataaatcttctagatcaaactcttccttaaaatagttctgcttttggtaggattccagattttcctagttttgttaagtgtttctaatgatgtttggcataggtgttaacttcatgggcctgttgtatacaaaccaatttttttcttgctctgagtgaacagtaacagaacctggtaggtgagtcacactgatactgcattcactgaagttactaagctgaatgataagagatgagaatcctttgcatttgtattcaaatcaagagttgtagaatttgaaattcctgttttgatgaactatgtgaagcatgctgtcattcttctctgctagtctatgttgatgatgtcattaaactagtctttgacttttagttcttggcttaaaatattggaatgattatataataaataggtttatttcatgtggaaaaggaataatgtgtttgccctgaaatagtctgatctgatcaggaggatattatgctgagcatggctggaaataaatttgtagcaccaattaaatacactgtagcagctctgagagggaataaaagtaaaatataaatagtaaatatgagagaaagtgactatgggatctaactatgtaagagcagggtgggagtatgggtagatacgtacatgccccctagattttaggaaagcatatttcaagaagtagagaagacatggatatcaatcagtggaaatcgtatactaaaacggaagtcagtgaaaaaaaaagactgctctcaaactaaagatagatggttgcttctaataggtaggtattcagattcgattaagaaattagaaggccgggcatggggactcaggcctataatcccagtactttgggaggtcatggtgggcagatcacttgagcccaggagttcgagacaagcctgggcaacctggtgaaaccccatctccacaaaaaataccaaaattaattagcagggtgtagaggcacatgtctgtattcccagctactcaggaggctgaagtgagagaatcacttgagcctgggaggttgaggctacagtgagccgagatcacaccattgcactccagcctgggtgacagagtaagaccctatctcaaaaaacaaattttgaaaatatacagaagtatagaaaaactgaagtaatttaatttgtgttaaaatctgtttggtattaaaactaatgtttggccgggcatggtggctcacgcctattaattatcctagcactttgggaggccgaggcaagtggattgcttgagctcaggagttcaagaccagcctgggcaacgtggcgaaactccgtctctacaaaaaatacaaaaattagctgggcatggtggctcacgcccgtagtcccagctcctttgcaggctgaggcaggaggatcacttaagtccaggaggtggaggttgaagtgagctgagatcgcacctctgcactccagcctgggtgacagagtgagaccctgtctcaaaaacagacaacgacaaaaaaccctaatgttttatgaaaaagctctttaatttttcgtgaccaaactgctattctctagacctacactgtccaaaatgatagccattagccatgtgtgctactgtgttggacagcacgtatttagaacatttccaacatcacaaaagttctattgcagaatgctatgaaaatgagatacactttcattagaaaagctagtaaaaataagtaggggtaatggggtactttgactatccagaaattttactaaggaagaattagatttttataatactgggacattagtgtgcactttttttgtcgtaattgcattttgttttttattttgaaataaatacatgtacagaaaaattgcaagaatagttacagagtcttttcgctccctgaaccattagagagtgagccccatcagccccaaatactttaatgagcattaaatctggagtttggccgggcacggtggctcacgcctgtaatcccagcactttaggatgacgaggtgggcagatcatttgaggtcaggagtttgagaccagcttggccaacatgatgaaaacctgtctccactaaaaatacaaaaaaatgagccgagcttggtggtgcacacctgtaatcccagctactcaggaggctgaggcatgagaatcacttgaacctaggaggcggaggttgcagtgagctgagattgtgtcactgcattccagcctgggtgacagagtgagaccctgtctccaaaaataaaataaaataaatctggagtttaataccagtacagtactaccagcttatcttcaggccccattcgagttattctagttgtccccaaaaggtgaaggatccagtttaaaatcacacattgcatttagttgtcatgtctgtctttgacttgatcgccttgacacttttgaagattacaggctcattattttgaggaagtcattaacatggacctgatgtttcttcatctttagattcagattatgcattttatcagaattgccacataaattgtgctgtgttcttattttatccatccaggtactacataatttccatgtgtcccatttttcttgatgttaaccttggtcacttgattaagattgtgtctgccagttttctctaccatacatttaactattttttcctttataatcagtattttatgaggaggaggaggaggtactttgagacaatgtaagtatcccattcctcatcaaactttcaccttctagttttagcacccattgaaatttttttgctggattattggtatgatggctgccaaatgatgattttctaatttcatcatcccttctacatccattcattgacatttcattgaaaggaaaaactgttttcttcccatttatttaacttatatcaatatggacttacggattcatattttattcaataagttatctattagtgtactttggtactttgatgctgagtttgtcccagatttggtcagtggaaaccctgtcaagctggcttctgtatccttttgacattgtcctatcattctttgatcactttcctctttctgggaccagatatgatcaaagcccttcttatacttttcctgccctacctctggaatcatttcaccaaggtaccctggttccctttattgaagaatgtatttagaggttaggtctggacagtagatggcattgttccactgaggtgtcactgctcctagactttctcagcagacagagctagagcatatatgcatgtatatacatacacaaacatacatccacacacatagactcatttttttatttcttgctctgtgtgtgtgtgtgtgtgtgtgtgtgtgtgtgtgtactgtgagttcacactggtacctagtacctcaacacctcagagttcattttatttttcttcctttttgtatttgtaactcccttctctgacagagaaactgggccccagtttttcttaatatattactatttacttaattgatcaatccccttgaatgtgcccagtctttcctttccttatcagatcatgtgcatgctaaccttgctcagccccacctaatggtttttagactgaattatttggagacgaaaaaagtacggttgatgctcattagtcacagattttttttatttgcaaattcacctacttgctaaaatttatgtgtaaccccaaaatctgtactcgtagcacttttatggtcattcatgaacacgtacagaagggtaaaacatttgagtcgctattgggtaacgtgtattcctaggtgaggccaagcaaggcagtctactgccttcttctttgagtcctcatactataaatagttgtcccttttgcagtttacttagcgccacatattttgcattttgacttcttttacttagcatgtgttttcaagttccatccatgtttatagcatgtatcagtacttcattcttcttcttttttttttttaaagagttgggggtctcactgtgttgcaggctggaatacagtggctattcacataggccatcatagcatgctgtagcctcaaactttcactgggctcaagtaatcctcccacctcagcctcccaagtagctgagattagaggtgtgggccactgtaccaggttccttcctttctaaggctgaataatagttcattgtatgtataataccacattttgtttatctattcatccaataatgggcatttaggttatttccaccatttggctatcttttgaaaatcttttcatgtgcttgttggccattagtatatattctttggagaaatgtctcttaaattctttgcctattttttaaattggggggaagttgtctttttttgttactgaattgtaagagttctttattctgataactagacccttatcagatacatgatatctgattaacacatagtttcttgcatcccataggttgtctttcaaaattttgacgaattccaatttgtcagttttgttgcttatgatttttagtgtcatatctaagaatccattttcaaattcagtgtcatgaagatttacctatgttttcttctaagaattttatagttttagaccaagcgcggtggctcatgcctgtaatcctagcactttgagaggctgagacaggcggattgcctgagctcaggatttcaagatcagcctcagcaagatggtgcccatctctactcaaatacaaaaaattagcctatggcgtgtgcctgttcagctactcgggaagttgaggcaggaaaattacttgaaccatggaggcagaggttgcagtgagccgagattgcatcactgcactccagcctgggccacagagcgaaactatgtttccaaaaaaataataacaataattttatagttgtagctttttaagtttttaatccactttgatttttttgttttgttttgttttttgagacagggtcttgctctgtgctgcaggctggagtgcagtagagcagtcttggctcactgcagccttgacctcctgggctcaagctatcctcccacctcagcctcccaagtagttgggatcacaggcttgtgccaccatgcctggctaatttttgtattttttctagagatggggtttcactattattgcctaggctggtcttaaactcctgggctcaagtaatccatgcccaccttggcgtcccaaagtgctgggattacaggcgtgagccaccactttcagtcccaagttaatttttatatatggtatgaggtaaggattcattcttttgcatgtgaatatccagttgtcccagtgccatttgttgaagagcctgttctttccccattgaatgttgtcttagcactctttccaaaaattagttgaccatagggcatggtggctcatgcttataatccaagagctttggaaggcccagatgaaaagattacttaaggccagtatttcatcaccagccagccatggtggtgtgtgcttctgggagggtgaggcagaaagatggcttgagctcgggtgttgaaggctgcagtgagctctgattgtgccactgcactccagcctgggtgacagagtgagacactgtctctaaaaaatagaataataaaaatcagttgactatagatttgtggatttatttctgaactcatttaaaactattccattgatctatatatcactccttataccattaccacacagctttggttaccggtgctttgcaataagttttgaaatcaggaagtatgagttctccaactttgttcttccttttcaagattgttttggccattcggagtcccttgcaattccatataaattttaggatcagtttttttatttcttttttttttttttttgagacagagtctccctctattgcccaggctggagtgcagtggcgtggtcttggctcactgcaacctccatctcccaggttcaagcaattctcctgcctcagcctcccgagtagctgggattacaggcacacaccatccgcccaactaaattttgtatttttagtagagatggggtttcagcatgttggccaggctggtctcgaactcctgacccccaagtgatccgccggcctcggcctcccaaagtgctgggattacagacatgaaagcttttttatttttgaaaaaataaataaataaataaagacataagatgtctttccatttatttagggtctccttgttcttggaggtagattttctctgatctattttcattgagaccttgggccttaagagagccacaatttcatgagagattatttctctggagcccttcctacccttctcctatttcctgtctcctttcctcccttgttattcaaaagtcttaacaaatgctcctgggcccaatacagaggtcagctcacacttccagccttagctttggttcactttttgctttcttgccactggtagttttccctcctctcttaagaacttagctaagcttttcaaaggatgtttgcatttatccaacatttctagattttggtagctggagagttttaataattttctagattgctgttttactagattagaaaaagatagagctgggtgtagtggcacatgcctgtaatcccagctactccagaggctgaagtgggaggattgcttgagcctgggagttagaccaacctgggcaacatagtgagacctatctcaaaaaaaaaagtaagactttagggcgcagtgtaatcccagcacttttggagaccgaggcgggtggatctcgaggtcaggagttcaagacaagcctggccaagattgtgaaaccccgtttctactaaaaatacaaaacttagctgggcagagtggcaggcgcctgtaatcccagctactctggaggctgaagaagagaatcacttgaacccgggtggcagaggtttcagtgagccgagattgcaccactgcactccagcctgggcgatagagtgagactctgtctcaaaaaaaaaaaaaaaaaaaaagacagtgttttttaaagatggagtttagtatacagaaatattgggtgtcaggcaaagtattaattactttgtacgtattctcttttccttcttttttttaaaacgagacagggtgaccaggctaaactctgactgttgggctcaagtgatcctgccttagcctctggagtagctgggcattacaggcacatgccactgtgcccggctacatactcacttataaaactctatttttaaatgacagctcctctttacaaaatagatcaggagagcgattttcctgtctgcttcctgaggaagcaaaaaggcagaaacatggtgagcagcaagaccagtggttgccgtagtaagcatgggacttcctatgaatggctctgttaacagtaggggatggtaatgttctttgatttgtggactctgtttgatttgtggacaaggttttatttcctgtctttggggtaggagggtctgccatatccacaaattggctcttcccatttgttgtattcatttagttagaccatgattggaaagcctcactggctgtgcacattgcaccatacttaggaatatatgacggttatacatttcaaacagggctttaaaaccttccattcagctccttttggataaagctcttttcctcatgtggttgttgacatacatgaattataggctttgtttagctagtgggtaagagcagattttggagtcatgtacacctgggtttgagtttcagtcttgccatgtaccagttgtttgtggacaagttatttattaataactactctgtaccatagtttcttcattggtagtatcttcaaaatgaagtatctatttcctgtgctgttttgaaggtaaccttaaataatgtgcattgtacaatttgatacagtgtctgacacgtagtaaatactttaatatataatacctgtttttattctgatccttgttgagctgctgctttttgatgtgttgattatatataattggtaatcatccattttactgacatcttccaagatttgaccaagttgattgtctcaaatttccaagcagaaaaagtacccagaaaacagaaattaagcagttattaaagaatcgaatagcaatgatcattacgacttgtgcttaataagaaatgtgggccatgtctgcctgagcctttatttaatgcattttaaaatttgctgggttttttcctccctttaaaccttactatcaggttcagtaataagttaaactaaaaagaaacggatgccttagaataaagaaagattcaaattaataggatatataatggcctttcatggtggtggaatttctgtgtgttttgaactaagggaaagacttaaaggaagattgcctacagtgtactggacactttgctaggctctgtggatattatcaagacacagtccttaccctcaaggatctttttatttttcttttagagacgggatcttgccctgccacccaggctggagtgcagtagcaaaatcatagttcactgcaacctccactcactctcaaggatcttactctcagctgggggaggccataaacagttaaagtagcttactctcagctgggggaggccataaacagttaaagagttaatgattgactctagggctaagggaaagaaagtaattgggtcaactaggatttctagcttggcaagggggtagacctggattggcaaactacaacccaatgccagtttttgcatagcccacaaactacaaatgtttcttacatctttgagtggttggaaaaatatcaaaagaagaatactattttgtaacgtggaaattatataaaattaacatttacatgttcataaataaggttttattagaatatagctatgctgaaactacatatctatgactgcttttttgtcacaacagcagagatgagtaattgtgacaaaggctgtttggcctgcagagccaaacatttactgtgtggctctttacagaaaaagtttgctaactcaatgagtaggtggtaatttttatccattgaaacaagcaattaaggaagaacagatacaggagaagataacatttctgtgagtgttgattatttgaatcagaggtacttgtgaatatgcaggtctagaaggcaagggaatttataggtttggagtttggaaagagcttgaggctggaaatggatgtgggaggaaaggaggagatcaagaagactggatggaggagtgcaatttttagccctgtctgcacattggaatcacctgtagtgcttaaaaccaaacaaaaccagacagacatttccaggaacccaaccccaactccctctttcccaagattatgatgcacctgagctggacttgggcaccagaattttttgaaagctcccccagcaactctaatgtgcagccactggtacagagtgagaagattggaagatgggacaccaggaacaccaacatttaagggatagttctaggtgcttctgctgaggagaggaaattctgagggagtgatgatgggaattttagggtggtcagatcctgtaatttgagatcattgttgactgatgaatcaagagcagtttctgtagaggccaggtgagggtgtatgtcagaggcccctggtttgaggtgggagagtatgaactattgagaatattgaccgggaggaaaggggggaaagtgatggctgggatggggggcattgggaatgtagtttgttctagagaggtttttttaagatgttaaagccttgaggctatttatgtgctgagggagtgagtactcagaaagaaagcctggaatggcagtatcagatgccaccattcagttttcatgatggagtgaagggctagattttgaatagttcttggaataatcttaatattgtaacctttttggaactgtttgcttaatgtgctttcttcatttaggtgcattacattgtacctggaaagagaaatggacccaggcattgagaagcaaggccaacaactctgctttgcttgcccggttactgtcgttctgtctgggacattggtctcatctctgaaagcaggagggcaaactgaatgggctctgtagtctcttctaaaagtttttagtttaaactattaatagtacaactttgatttaacaaatgaggaagctgagcttacgagatgtctgtgaagcccattgtctgatcttttatttccttagtacctgggaatgcgcttttttttttttttttttttgaagaacaccaacagttgttcacccttccttgaatttgggtacactgtatatacagagtataccaatttagcctgccattagaacatgtcttcacgagcaaaatctagtataaagtcttactttaatattttctttattatgtataaataatagatggttgttatggaatactggatagtacaaaagtttagaatttttaacattttggtttatttattgggactcttttttccccccagtgattcttgtttctccaacaatgtgaatgcgcactccattcagtgtgaacgtgaatgttaatttatgtgccagctggattctacaggaagcagacacagatggggttggaggggcaaagggcttattagaggagtaatgcctgtgaagaaaaggggaacggaacatgtttgggtatagggagccatcagactgcagtgcacacctgacgaagtctctgcccacccagattgcctgatagaggaataccacaagaggtagaaatggctaggctcttgtactaccactttgcacagtcattgactagagatagatctttgatcaatgtagagattttcagccttggcattgttgacatttgggactggatactttgttatagggggttgtcctgtgatttgtaagatgcttagcagcatcctaggcctctatcccctagatgccagtagcccagcctccctgctattagttgtgacagtcaaaactatctttagacactgccatatgttccctagggaagggcctaatggtatataaacaaccctatggtggcatagtccaagttttgggacagggaggagtgttctatactacccttactggaaagacctatgagctattcagaaatctgaactatttaagatggagctttgttctgtggctcctggaattttaagcacacccctgtgaaacatcttgttaggatatactccactctccaaaacaatccataatgtttaaatagggctgttttattgattgattgattgattgattgagatggagtctcactctgttgcccaggctggagtacactgtcacgatctcggctcactgcaacctccccctcctgggttcaagcaattctcctgcctcagcctcccaagtaactgggattacagacacccaccaccgtgcctggctaatttttgtatttttggtagagacggggtttcaccatgttggccaggctggtctcgaactcctgacttctcaggtgatccgcctgcctcggcctcccaaagtgctgggattataggcatgagccaccgcacctggccttatttttctttttgagatggagtctgactttgtcgcctgagctggagtgcagtggcgcgatctgggctcactgcagcctctgcctcccgggttcaagcaattctacctcagcctcctgaacagctgagattagagatgcgtgccaccatgcccagctaatttttgtatttttagtagatgcaggatttcagcatgttggctaggctggtctcaaactcctgacctcaagtgatccacccacctcggcctcccaaagtgctgggattacaggcatgagccaccgctcctggctattttcttttgagactgggtctcattctgttcccaggctggagtgcagtggcacaatctcagctcactggaaactccaccttctgggctcaagcagtcctcccacctcagcctgctaagtagctgggattataggcatgtgccaccctgcctggctactttttgtggagatgggattttgcatgttgcctaggctgggcttgaattcctaagctagaacaatctgctcagggatgttgtatatttctaaaggtatttttccttttgttgcaggtgacacaactaaaaaaaaacaaaggtatttatggaattccactgagtggtaatggatgatgcagttcaaataactaaggtaagagaaataaaaccagaactgtgaggaggcttttgccagccaagtagtgtccttaaataaagctaacatcacatgctttcctgcttcatttcgtttctaagctgtaagagtagcttatttttttattattataaacattgtaattatcctttaagatacttcttaacctgattatgaatcagaatcacttgaagagctttttttttttaaaaaaaaagaccaaagtcaggctgggcatggtggatcacgcctgtaatcccagcactttgggaggccgaggcgggcagatcacttgaggtcaggagttcaagaccagcctggccaacatggtgaaaccccatctctaccaaaaatacaaaaattagccagatgtggtggcatgtgcctgtaatcccagctactcgggaggctgaagcaggaggatcccttgaacccaggagacagaggttgcagtgagctgagatcgcacactgcattccattctgggcaccaaagaatgaaactccttctcaaaaaaataaaaataaaaagaccaaagttaatgccctgccagcattgaattaaagcttcttgagtagatcacagatgatctccaagttttttaagtgggaatgtaaaccaactctatagttttagaaaactctttggcaatatctgcaaaacatacacgtatctaataacccaggaatttcaattctaggtatccacctttgagaaatgaaaaatatatgtctacacaaaagtgcacatacaaatgttcactgcagctttatgtattatagccagaaaaactgtaacccaatcaggtgtccaaaaacaggagaatagttaaacaaattgtgatatatggtcaggtgtggtggcttacacctgtaatctaagcacttgggaggctaaggcgggcagatcagttgaccagcctggtcaacatggtgaaaccccatctctactaaaattacaaaaatgagctgagtgtggtggctcacgcctgtaatcccagctactcaggaggctaagacaggagaatggcttgaagccaggaggcagaagttgcagtgaggtgagatcacgcccctgcactccatccaatctgggcaacagggcgagactatgtatcaacaacaacaaaaaattgacatacactattgataacatggaattttattcagtaatagaaaggaacaaactaccagtagacatgacaacatggatgaatctcgtagataaaaggttgagtgaaagaaaccagatggacaagaaaaagtagatgtagcagaattaccgagtaaaactaaactacagtgataaaggtcatatccctacttcctctgacaggaggtgggaggttgtgactggaaagaggtatgagagagcctctgcagcaccgaaaaggtgttttgttttgttttttgagactgagtcttgctatgtcaccaggctggagtgcagtggtgtgatctcagctcactgcaacctccgcttcctgggttcaagcaattctcctgcctcagcttcccaagtagctgggattacagacacgcgccaccacgcccagctaatttttgtatttttaatagagacagagtttcaccatgttggccaggatggtctcgattgcccaacctcatgatccgcctgcctctgcctcccaaagtgctgggattacaggcatgagccaccgcgcccggcctgaaaaggttttacatcttaatgtgttcatatacatacttttctcatggtaaaatatatataagattaaatttatcattttaactacttttaaagtatacaattcattggcattaagtacattcctgttgtgcagccatcaccactgtccatctccaaaactttttcatctccccaaactgaaactccatatccattaaacactaactccccatttcctcctcccccagctgctggcaaccattctaccttctgtctctatgaatttgactataatagttacctcgtataagtggaatcatatttgtcatttgacatctggtttgtttcacataggtttatttcacaaaggtatcttgtttatttcacataggatgaccttgttttcaagtcatccatgttgtagcatatatcagaatttacattttatggttgaataatattctgttgtatgtttataccactttatgtgtatccattcattcactgatggacacttgggctgcttccaccttttggctgttgtgactaatggtgctatgaacatgggtgtaggctgagtgtggtggctcacgcctgtaatcccagcactttgggaggccgaggcaggcggatcacttgaggtcaggagttcaagaccagcttggacaacatggcaaaaccccatttctaccaaaaatgcaaaaattagccaggcatggtgctgcatgcctgtaattcccagctacttgggaggctgaggcaggagaatcgcttgaacctaggaggtagaggttgcagtgagcccagatggtgctactgcactccagcctgggtgacagagtgaggctgtctcaattgaaaaaacaaaaacaaaaacaaaaaaaaacacatggatgtacaaacatctgttcgagtccctgcttttagttcttttgagtatattcttagaagtaaaattactggatcatatggtaactccatgtttcattttttgaggaatcaccatgctgtttttcacagtactgcatcattttatattcccaccagcaatgcacaagggcttcaatttctttacattctgctttttggtgacctccataattctaaattatatgtatatgctgtttcttcttaattcttttattaataaaaaagacaacataattctttgcctctccagtgtgaaaaaatgggaatttaccttacactatccccccatttaatatttgtattatttcctgttctgctgctgtttattagtttcctcagacttctgtaacaaaactccatgaactgggtggcttaaacaatagaaatttattgtctcagagttttggaggctagaagtcttgcgggctgtgcgggagaatctgttctatgattttcttctagcttctggtagcctcaggcatcccttacattgtagatggcattctctctgtatcttcagattgtcttccctctatgcatatctgtctcttgtgtccaaatttcctttttcaaaataagtgcgctagtcattggattagggaccaccctaatgagctcatctcaacttgatcatatgcaaaaatcctctttctaaataagttcacattcacaggaactgagtagggggttacaattttaacatcttttaggggacacaattcagtctgggtgacagaacaaatctctgtctcaaaaacaaaacaaaacaaacccataaagtgattacatttctaactttcggaagtactcttcaacctcctttttttaggttaattttcagcactctttccttctttcttcctttcctttttccttttccttttttttttttttttttttttttactttttatttttttgagacagagtcttggtctgtcgctcaggctggagtacagtggtgtgatcttggctcactgcaacctctgcctcctaggctgaagtgattttcctgcctcagcctcccaagtagctgggattacaggcacccgccaccacgcccggctaatttttgtatttttagtagagccaggttttcaccttgttggccaagctggtctcaaacttctggcctcaagtgatccgcccgcctcggcctcccaaagtgctgggattacaggcatatgccaccacacctggctaatttttgtatttttagtagagacagggtttcacctgttggatctcctgacctcatgatcgccctcctcagcctcccaaagtgctgggattacagtcgtgagtgccgcgcccacttaatatttatgttattatagctaagtaaatattgttcactgtcaggccaggcagcattttctgggtttttatttctttctctgtaggttcaatgtcatagaccctgggctattcaaatgagaaaatgaagaaaaagtgaattctctctctgaaactatcagttgcttccaatcatgtctttatattttatatttgaaccgtaactttctcataaaattttctccctggagtttctaattttcttgtctatttgcctgttattatagtttcacttttcaccaagatctcaatcatacactccagcctgtcaaggctagttcaaaccatacactgtggcccaaatttaggctagtcgtacactccaatccgagaccagtgggcactgttttttaggctgtctacacagtcatattggtattttccttactggtttttctttgacgggggtgcaggggaggttgggtccactgatcttggatatcagtctttctttgtatttgttttttaaatcttactagaggctagggggcatggtggctcatgcctgtaaccccagcactttgggaggctgaggcaggtggatcacttgaggccaggagttcaagaccagcctggccaacacggcaaaaccctgtctctactaaaaatacaaaaattagccaggcgtggtggtgggtgcctgtaatcctagctagtcgggaggctgaggcaggagaattgcttgaacccgggtggtggaggttgcagtgagccaagatcataccattgcactgcagcctaggcgacagagtgagactccatctcagtcaatcaatcagtcaatcaatctatcttaccagagttcattctcaagtcacttactgagagaaaaggtacctggcagataaattttgactctttctggtatccgttttttgttgttgttgttgttgttgtttgtttgttttggagacggagtctcgctctgttgcccaggctggagtgcagtggcgcgatcttggctcactgcaagcttcgcctcccaggttcatgccattctcctgcctcagcctcctaagtagctgggactataggcgcctgtcaccacgcctggctaattttttgtatttttagtagagatggagtttcactgtgttagctgatctgccctccttggcctcccaaagtgctgggattacaggcgtgagccaccgtacccagcctctggtgtctgtttttaagaccctcatgttggagtgatggtttggttgactatagaattctaggttgcctattatttttcctcaaaactttgaagtcattgctccatttcttctgacatcccttgttgttcatgagaaatagaaagtttcatataggaaattaatttttcttcttttctggaagcttttatgttctatatagtctggaattccatagaggtgtacttggtgggccccttaatagatctgcagactcatagctctccattttttggttcttttctgtcagcagctttctgatattgagcttcctgggttgttcatataatgttcttatctattctgtcctttttaaaaactctttgcttttggttgttttcctggagattgtcataactttatctcctaatctttttttctctctttttttttttttttttgagacagggtctcaccctgtggcccagactggagttcagtggtgccatcacagctcactgcagcctcgagctcccaggttcaagcaatcctcccacctcagctttccaagtagctggaactataggcatgcgctactacacccagctaattttttttatttttagtagtgacagggtctcactgtgttgccctggctggtctcaaactcctgagctcaagtgatccttctgcctctggggactacaggagtatgccaccacacctggctaatttttgtattttttagtagagacagggtttcaccatgttgccaggctggtcttgaactcctaggctcaagcgatccacctgcctcagcctcccaaagtgctgggattacaggtgtgagccaccacacctggcctgctgttttttcttttactgtttcttaaactagtcttctccccgctttcttttcctgtatgaacgttaatagttgaccacagcattggccctgtaatactcttttgttctttgtatttcttcagttttatttagcctctgttgtgtgttcacacattcctttttatttgcttgatgtgtgtcccatcccttcttttgaacactgtgtggtcattaatgagagtgtggtaggattttatgtactgatatttaagaaaatgaccataaaatgttcttggagatggtctttaaagaccgggcatggtagctcatgtttgtaatcttagtactttgggtggctgaggcaggaggattgcttgagctcaggagtttgagaccagcctgggaaacatggggagatcccatctctacaaaaaatgcacaaattacccaggcgtggtagtacatgcccgtggtcccagctattccagagcctgaagtgggaggattgcttgagcccaggagctcgaggctgcagtaagccatgtttgcaccactgcactccagcctgagtaacagaacaagaccctgtctcaaagaaaggaaaaaaaaattttaagtagttgattaaaagaggtctttagggtgggctctaatttgatgtgactggtgtccttgtaagaaaaggaaatttgtacacgcagacatcagaaacaaatacacagaggaatgaccaggtgaggatacagtaagatggtggccatctgcaggccaaggagagaggtctcataggaaaccaaacttgctgacactttcatcttggacttctagcctgtacagctgtgagaaaataaatttctgttgttgaacccaccgagtctgtgatacttttatggcagccctaccaaatgaatatagacatttaagaaggcttggtgcattgcagcatttggtaaattattatgcatttcgttgtattgtgcatgtagtgccattactgagaatagcaggatggatgggaagcatcgagacaaagtaaaatacgagctggccactaacatatggtatgattttgtggtaggtgaaaaaaggattccagaagtagagtgcttatgaaagaaaagctcagtagtgtaagaattttacaccagtttgactttaacagagagtgagttcaacagtgaaagatgaggttgcaaatgtagtttggggacccatattaatttcctggtgctgcccaaacaaagtaccataaactcggtggctaaagacagcagaaatatattgtctggcagttctggaggcccaaagtcaaggtgttggcagtgttggttccttcttggggggaatctgtcccatgcatctctccttagcttccaagagccccctgtgttatttggattgtaaatgatcactcaaatcctctttcttcaattggcattttccctgtctgttttcacatgattatcttcttataaggacaccagtcatattggattaggggcccacagtactccagaatgacctcatctttatttaactaattacatcttcaacgaccctatttccaaataaggtcacatcctatggtactggggattaggacttcatatcttttttggggaggcatagttcaacccataacaggggccaaactgtgaagcatttcctatatatcaatccagatattttcaaatctattgtttattcagtgggaaaccattgaaaactttgagcaggatgaatctaacactttaggaagactccttggggatggggttggagagatgttagctgcactggaagtcagtagaccagagtctggaccactgggagtctggaccagatcaatgttatggaaaaccaggattctggggctcccactcaagatatcccaaacccaaatcttcagactggagacccaggactgttttttaaaagctccctctctctccctgtgagtcagatgatttagcctagcttggatgtaacactgggtgtgaggtgatagaggcatgaaatgggttggtggttatgcaagtagaaagaccagagagaacctgggaaaagagacatttcgaaaaagtagtatgtaaactggcaccggagagtctgagacagtggtggaatccttaacagaaataaagatgtctagagaataaattgggtttaaagggaaggtaattaatttggtttacagtgtaaggtgatagacagtcagcaggcacttggagaatggtgatgtatgttcagaagtgagataatggaggtgataatcaaaaccctttgttttgatttgagcctttgtgtgggagaaaggatatggcgagaagaacagaagatcaggaagccaatactgtagaccctcattccctagcccctgaaacaaatggatttgacttctctgtcatgacacctggaacaaatgtggcattgcttacttacttcctttgccatgaactcagtgaaggcagggacgggtcttggcttgtgtgtgtgtgtgtgtgtgtgtgtgtgtaagagactgggtctcattctgttacccaggcatgagtgccatggcataatcatagctcactgcagcctcaaacgaacctcctccctcaggcctcctgagttgctgggactacaggcatgcaccaatggccctggctttttaaaggccatcatctagcacagtgcctggcttttcaatggaagtctgttgaatgactgactgactgaccgacttggaaaatgaacacatcaacttgagaataagaactttaacttttttcttccttgcatcccctaacatttaatccaatgcctggtccttaataggacccaaataaaattttgatgtgtgaatggtagaagaaaagctaaaattgagtagtcattgtgtcaaagagaaccaggaaacagagaagcttttgagaataagttgaccataacatgtcaaatgcaagtcaaggagaatgaaaactgagggcaggaattagatttaatcaggaggttatttgtagatttgagaacgaaggatttaagaacataatgaggttgttaagggagaatgaaggaattaagatcataatgaggttgttaagtagaggtggaaagtgaggaaatgaaagccaagtacatcttatacaagtttagtagtaatgaggaaaagagaagctcatagagttaaagctctaaaaatctgtttagaacatccgtgtctatttgtaaacaaaggggtatgagggttagggatggaaaaatggaaagtaccagaaggaaatgcataattttaggggaaagatctcaaatgggatcaagaacatgggcagtagccttaaaaaggatgagggaatctcttcctctagtctaaaaagggagaatagaggctctatagaggagagagaggtcatgtcctcttgtcagccatctgctcagagggagcttgggctgctgtgctagaaactgacataggaaactgacaaaggaaggatatgttttctgcacagcactgaggagtgtgatactcctaagcagtagttggcagcctgagataggaatggtggaaccagatggtaagtataatccaggaatcaggatggcactttctgtagattagggagttgtaggctgggggtgtacttttattcactcttctctgattcagaggttttataattttcactaacatcattaaaaacaatattggatgcctactacctgttggtttttattttaatcttgggaaaaaaaagtaaaagctactatcctgaggtttctggttttattggggagatagatcatatatgtaaaaagcaagtttagcaaatggcacatggcattatagactaagtcccaaatcagtagattacataaatgtcagagagattacaattatagcagtacactttgaggttcttttccccttagcttatgaacatttaaattttgtcacttttataaatacatgcctatttgagaggtaagaaaagtaccatgttgctttaatttgcttttctttgttagcaaagatgaattttttcagttgtttatcattattttactttttatgaattgcctattcatagcttttatccatctttccatggttgtgtttgtacttactaatttgtaaatacctcatttaataaggttatttaaccttttgcctgtaacattttgcaaatgttttttctagcttgttttttggggttctttcttttggttggttggttggttggttggttggttgggttttttttttgagacagatcatcactctgttacccaggctggaatgcagtggtgccatctctgctcactgcaacctccaccttctggggtcaaatgattcttgtgtctcagcctcccaagtagctgggattacaggcgcacgccaccacgcccagctaatttttataatttttgtagagatggggtttcacgatgttggctagggtggtctcaaaactcctgacctcaagtgatttgcctccctcagcctcccaaagtgctgggattacagatgcagccaccatggccagccttttctagtttttttaatttaaacattttctttcagatttcttattttgatttattttcagtttatgatgttttgttgacacataagagtttaaatatcttatgtattagaaactattaaatatttctttttaatatttaggaaggctacctcagcctgagaacagacaaatattttcaaatgttttcttcaaattgttttatagtttattggtacttatttacattccattgtattattgttatttatatacttaaaactttaaaccattttggaatattgcatgaaatagagacctaatttttgctgagtagttcagcagtttctagtactgtttactaaataatctatgaaaattttctgcggattcctaaatgattttgtccaggctggagtacagtggcacaatcatggctcactgcggcatctacctccccaggctcaggtgattgtcccacctcagcctctcaagtagctgggactacagaagtgccactacacccagctaatttttgcatttttttgtagagactatatttcaccatgttgctgagcctggtcttgaactcctgggctcaagcgacctgcccacttcggcctcccaaagtactaggattacaaggcatgagccaccgggtattttttatcatattcccaatacttatgtatacagacttccttgtttataaatctgtatctgtaccattgccacatattattgtattaatataatctcatagtgcaaatacttgttcattatttgttttaaataatgcctagactacactcacctatttgtatatgtgaactttttttaaaacattttattttttaataatttaagactcagaaagctgcagtagtacaggttcccaggtatgcttcacccaagggctttcaattagaacctttttttttttttttttttttgagatggagtctcgctctgtcaccaggctggagtgcagtggcgccatctcagcacactgcaacctctgactccctgattcgagcaattctcctgtctcagcctcccgagtagctggaattacaggcatacgccaccacacccagctaatttttgtatttttagtcaagacggtgtttcgccatgttggtcaggctgatctcaaactcctgacctcaggtgatctgcttgccttagcctcccaaagtgctgggattagagtggtgagccactgtgcccggcccctgaaatcaccttttctgtaatgctactttgttcaataaaaataacatattaatatcctttttaaaaatacatacaatatattgttattaactgtagtcaccatgatgtacaatagatctcttgaacttattcctcctaactgaattttgtgtcctttgttcagtatttccccaattcccctacccaccaacctctagtaaccaccattttactctctatttctatgaattcaactttttacattccacgtgtaagtgagatcatgtgatatttgtctttctatgtctggcttatttcgtttaacataatgtcctccaggtttatccatgttatcacaaatgacagaatttattctttttttaaggctgaatagtgttccattgtgtatgtatgccacattttctttcaccattcatccatcaatgaatgaaaacacttaggttgatttcatatcttagctattgtgaataatgctgcaatgaacatagtagtacagatatctcttcaacatacccatattagttatatcctttagatatatatccaatagggggaattactgaatcatatagtagttctatttaaatttttttttgttttttaattttgtttgtttagagacagggtctcgctgtgtctccaaggctgtagcacagttctgcaatcataactcactgtaagctcaagtgatctacttcagcttcgctactacaggcacatgccactatagtcagctaatttttaaaaattgtttgtagagtccaggtgtggtggctcacgcctgtaatcccagcaatttgggaggcctaggcgggtggatcacctgaagtcaggagtttgacactagcctgactgccatggtaaaaccccatctctactaaaaatacaaaaaaattagccgggcgtggctgtgcatgcctatgatcccagctacttgggaggctgagaggcaggagaatcacttgaacccgggaggcagaggttgcagtaagccaagatctcgccattgcactccagcctgggcgacaagagtgaaaatccaactcaaaaaaaaaaaaaatcgtttgtagagacagggtctcacaatattgaccagtctggtctcaaactcctggcttcaggcagtcttcctgtcttggcctcccaaagtgctgacattatagccatgagcccctgcacccagccttatttttaattttttgaggaacctccatacatgttttccataatggctgtacttatttaccttctcaccttattgtataatggtgcatatctcagaatgtgtccttactgagtgacacataactatatttgaagtaagtttcttatagatagcatatagttgggtcttttcttttctttttttaatagagacagggtcttgctatgttgcccaggctggttttgaactcctgggctcaagcagtatgcctgcctgggcctcccaaagtgttggtattataggcatgagccaccatgcctggcctaggtcttttttttttgagacagggtctcacttttgtcacccaagctggagtgccgtggtgcaatcatggctcactgcagcctcaacctcctaggctcaatcagccctccacctcagcctcctgagtagctgggattacagatgcatgccatcatgcctggctaatttttgttttgtttggggtttttttggtagagacagggttttgccatgttgcccaggctggtctcgaagtcttgggctgaagtgatccacctaccttggtctcccaaagtgctgggattacaagcgtaaaccattacacgtggtctagttgggttcttttttaaaagaatcagttctactaatttcttttcgttggtatgtataaaccatttatatttaatataattattgatactttggatttaaatttgccatttttgtttcattcattatttttgttcttctgtttcccctttcctgttttacagtgggttccttgaacattttttaatatttcattttgagtgtatctctttataaagttttttgtgtgattgctctaggaatatatatgtagataacttattacagtctattaatatcaactttttaccaccttaagtagaatgtagttagttttagtagaaggaatcttttagttccttctacctttcttcttctttttttttttttttgagacggagtcttgctctgtcatcaggttggagtgcagtggcgtgatctcagctcattgcaatctccacctcccgggttcaagccattctcctgcctcagcccctccgagtagctgggattacaggtgcatgccaccacacccagctaatttttgtatttttagtagagatgaggtttcaccatgttggccaggatggtctcgatttcctgacctcgtgatctgccggcctcagcctcccaaagtgctgggattacaggcatgagccattgtgcctggcacaccttccttctttatggtacagttgtcttaaatattacctctacatacaaggagaaccacttcagggactgctataatttttactttcaaccatcaaacataatctttaaaactcaagagaagaattgcttaattagtgtatgtatgtgtgtctgtatatgaataaacatatatatatgcataacatatatatggatatatgcatatatagacacacacacaccctttccattgctttttctttacttctatttgaggttttcttctgttatcatttacttcctttctgatagagtttctttagccattcttttcaaagctgatctgttggtgacacatttttagttttgttcatctgccagtatttgtatttcatttttatttctgaaggatattttcactgtctatagaattttagcttgatagttattttctttcagcatttgaaaaatattgtatccatccttgtggtttccatggttcctgatgaaaaatctgttgtctttcaaattgttattctcctatgagtgatatgttgtttctctctaattgatttcaggacttttctttagtttttagaagtttgattctgtaagtttatatctaaatctgaggctgagtgtggtggctcatgcccataatcccaacactttgagaggccaaggtaagaggatttcgtgagtccaggagtttgagaccagcctggacaacatagtgagaccccacctctaaaacagatagatagatagttgattttgtttttgttttttcctttttttgagacggagtcttgctgtgtcacccaggctggagggcagtggctcgatcttggttcactacaacctccgcctcctgggttcaagcaattctcctgcgtcagccacccaagtagctgggattacaggcacccgccaccacacccaactcattttttgtatttttagtacagatggggtttcaccatgttggccaagctggtctcgaactcctgacctcaggtgatccccctgcctcagcctcccaaaatgctgggattacagatgcgagccaccgtacccagtagacagtttttagccattatttcttaaatttttttttttcatctctccattcattctcttactcttgggaccctgatagcatgaatgttagatctttgttattatcccacaggactttgaaactgtgttcatttcttttcaatctactttctctcttgtacagactggatgatttccattcatttaagtttactaattgtttcctttatcatttttcttttgctgttgagcccatccagtgggtctttttaatttcagaaattttatttttaaaaattccatttggtactccttatgtcttctatatgctgagtgtttataatgtcttgtttgagcagtttcatgagcgctgttttaaattcttttcaaataattccaaaatctatattatcttggtattgtcatctgttgattgccttttttcattcaagttgagattttcatgttcctggtataatgagtaatgttggattgcatcctagcacttggaatattgtgctatgagattctggttcctgtttaaatttttatatttaacagtcaacctgtttaggtttagaacacataccctgtcccacttttgtcgactgtggttcagttttcagtcttgttttactcttatggtctgtgctaccgaaaggccagtctgaaatttaggtgttattccggagcagtgttcagttcttatgccttttgctgtgttgtttctggtcatttttacacatgggttgctcagaggcacttttaggatttcatacacagattcagagaattcatttctctagctctctcctcaccataatcctttcccaattctgtagttttgctgggattaggactccatctggttattccagggtagagaaagatgagttcacccacattctctgcagctgtaacatggagaagaggggaaaggcgtgccacctcattatggcagagttgtgttggaaggcagaatgctgttcacaatttctgggccacagtgtctggtgaggaaaaggaggggtacctcctccccttttttagtttgcctggtcaaaatgtttttgtctgctgagctgcccctttcccagttctttacctagagagggcaggcttttcttggcactttcttgtctgtgcttactggatctttcagattgtggcttcagagcttgggctaggacatattagaagttaaaccaaaccaaacaaaaaagtagggagcttcctgttgggtcagtcctcatgtcccctggtccctagccaatctaccttcttttttctacttttcagaatttttctgtcacttgtgtcatgaatttcatctagaatgttcggttataatcggtgggaagggctgggcgcggtggctgacgcctacaatcccagcactttgggaggccaaggcgagcggatcacctgaggtgaggagttcgagaccagcctggccaacatggtgaaaccccgtctctactaaaaatacaaaaaaaattagccgggcatggtgggggacgcctgtaatcccagctacttgggaggctcagataggagaatcgtttgaacccaggaggtggaggttgcagtgagctgagatcgcgccactgcgctccagcctgggcaagaagagcaaaactccatctcaaacaaaaacaaaaacaaaaacaaatcagtgggaggaatagggtggaatatgcttactccatcttttcctgaactgtaaatccctgctgcaattttaaattatgaactttagttccagtagttttttttaacctatgtacgtagtctttcaaatacaaataacagttaaggggttttcccccaataattatatcttgttttcttttcttttcttttttttttttttaaagagaccgggtctcgctgtatcgcctaggctggacttgaactcctgtgctcaggcaatcctcctccctcagccttccaagtatctgggactacaggcatatacccccatacctagctgttttcttatcccattatctacttttagaacaaggattggcaaactataatctgtttcccatatccagctcactgcttattttggtatggcagacaagctcagaataggttttccttttttttggagacaggtctcactttgtcactgaggctggagtgcattggtgtaaacacagctcacttcagcctcgacctcccaggctcatgggatcctcctgtctcagagagaaaaagagagagagaaaaaaagaaattatatgaaattcaaatttcagcgttttattagaatatgccatgttcatttgtttatatattgtctgtggctgccttcatggtacgacagcagagttgagtagttgaagcagagacttaattgccagccctttttccagatgatttgtaaatcctagaagtgaaaccattgtccctttcttgtcctgctttagtgatactgatatttcaagatacataattttcttgggtgaaagtttcttttgtttctggtttctaggtatttgtgagatatttctctcacaaaacgtgttcttttcttctggtttttttttgggggttttttttgtttctttggttttttgagacagtctcgctctgtcacccaggctggagttcagtggcgcgatctcaactcactgcaacctctgcctcctgggttcaagcagttctcctgcctcggcctccctagtagctgggattacaggtgcctgcaatcacgccaggctaatttttgtatttttagtagagatggggtttcaccatgttggccaggctggtcttgaactcctgacctcaggtgatctgccctccttggcctcccaaagtgctgggattacaggcatgagccactacgccttgtctcttttcctctgttatctgacttactggatggcatctgttaggtaaatcagaaaccaaagaggagtagcattcagcactccctgtcaccccaagagcaaatctattatcacaccctgtgcagtttacttcctgaatatctccttccttgtaacacttttgtgtctccaccagtaacttctaactggactgtccacatccagtgctatattctctacacccagctaaatgaagtgttcattccaaaatgcagggcagggaggtcactgtcatgcttctgttcttcaaaggcttcttaatgcttatgggacaaagaaaaatcacccttgtgtggccctaccctgtatacatctccagcttcctggcacctgctcccccttactctttatacttcagacacggtggcttctttcagaccctgctcctgccctttctgaggttacggactggcatggagttccctgccctccttaatgcctccctgattcctgttcatcttctacttgtcagctcaggaatcagtgccttagggaggccttggctgagctccctgactaggtcaaattttcttcttctataggctcttagagtcctataattctcttttccatcacttctcctatttgtctgtgaggtgatttgtttaatgtcagttttctgctactagactgtaagcttcatgaagatagggattctgttagaatttgttcactatttctagtagaaggaacagggcctagcacatagtaaatactgagtaagcgggttatttccccaatgattgcctttttaaagaaaaccagttctgtaaaccagcattcatcaggcttatcatatggctttttatattttgaattatttttgtgaggatttttattaatatgttttccaataatggaccatggttaaatttttgaagtaagccttacttgatcaggttgtggtataattataacatatgctgctttttctttgctaggattttaagattttgcagttaaagttattttcttttttgtgtgctttgtcagattttgacatcagtgttatactagtattttcatggcttattttattccattcttttattttcaacttttctatatccttaagcttaaaaatgtctcttttaaacagcatataattgagggcttttattattaggctttataatttttgtattttaattggaacatttagtttgtttaatatagttaatatattctttgctttctattttcctcaaagatttgaatagaacaaaaggctgacctcccccaagcaagagggaattctctggcagtctgcctttgcacttgaaatgcaactcctccctgaatctccagcctgccagcctcttctattatgagtcaattccttaaaataattctatatgatatatatttaatataattaatatataatgtggctactacctagtagaattaatgtatacttaatatgacatataatataattacagtagtaccttcttatctgggggaagcattatattccaagacccccagtggatgcctaaaaccacagatatatattttcctatacatacatagctgtgataaagtttaatttataaattaggcacagtaaaaaattaacaataactaataataaaatacaatacttataataatatgccagcatgttcctttttctcttttttcttgctttttggattgatagacttttttactatcctagcttttttccctcttgccaagttatagaccctgttcttttagtggttaccctacagattacaacacatagcctgcatgtataggaatgaaatacagtttacgtagggttcagtaccatctgtggtttcaggcatctactgggagtcttggaacatatccccccaccccccccccagataagggggtagtactgaaattatattaaatatatgcttattatattaaatattagtcatatattacatacatattatatagatttattttaagggattgattcacagtgggggaggctagcaggctggagacccaggaaggaactgcacttcaagttcaagggtagtctgctggagaattccctcttgcgtggggaaggtcagccttttgtgctattcagaccttcagttgtatggatgaagcccacctacattatggagggcaaccttctgtactcaagagtccattgatttaaatgtaaatctcatccaaaaaaacccctcacagaaatatccagaataacctttaaccaaatatctggacactgtggtgtggcccaaccaaattaacaatcacaagtctactctttatcaacttggcacccatacacatctccttaaaccattattaatctccaaataaagacagtaacaaagtcatacttctgcttagcatgaaagaactatcttgcatgtagccgaaaacacactattcctttctctaaaagaggatgcagattatttggttgatgtttactcttcttgatatcctgcaacttaaattctaaagtttaagaaaaagttaatacttaagtattatgatcagctgttaatctaattttttttgacgaaaatattttcgtatccattttctattgctgcctagcaaaacatccccaaatttaatattttaaagcaacaaccatcaaaaattggctcacaattctgtgaatatcaatcaatgctgggtagctgtttggttcctctactggtcttttttttttttttttttttagacagggtctcactctgccacccaggctggagtgcagtggcatgatctcggctcactgtaacctccgcctcccaggctcaagcaattgtcctgtctcaaccttctgagtagctgggattacagacacacaccactaccacctggctaatttttttatttttagtagatatagggtttcaccatgttggccaggctggtctcgaactcctcacctcaaatgatccacctgcctcggcctcccaaagtgctgggattacaggcgtgagccaccatgcctggcccctctgctggtcttgattgaagtcattcatgcaactgtaatcatctaatggttcatctgggactgagattgtctcaagcacatgtctggcagttggtgtcacttgttgattgggcctctctcttaacgtaaggaagtgagccaaagcttctcacattatgacagcagtgttcccatagagccaaatgacagctgtaagttctcttgaggtatcaacttggaagacacaccattacttctgcattttattggtttaagcaagtcacagggccaactcaaattaaaggaatggagaaataaacttcacctgttgataggagtggcagtgtctcactgtaaaaggcatgtgtacaaggatgggattttacgtagccatctttgcaaacagtctaccacagtgtcttttttcctttcgagtgcttaaaaaaattgtttttaaataattatttggttttcagaaatttcactattgtgtatctagacacagatttcctttttatttatctgtttggggggtgtttagggcttcttggatctgtggtttgatgtttttcctcagttttggagaattttcagccttcgtctgttcttcgaatatttcttctgttccatttctccctttccgcttttctgaaactgaaattacatgtaggttagatcatttcattgtatcctttatacctcttaccttctctttggtatttttttataaatctttttgcttctctctgcttcattctagatacttccttttgacctatttaccagctcactaattctctcttcaggtatattttacctgttcttaaatttatccattaagatctttttttcagatctgctattacatttttataccattcttgactaaaattcttaatgctacaggactgttcttcttgtctgtttcttactgattctcatgttgcctttttatggactagacactgtagttttaaaattatttatagaaatgacctgagacctatgatatatttttcaagagaggatttacgtttgtttctagctttgcctaggagtcttcaatcattttaattcagtttcagggactgatttgcttttaagcagggctgtagtccctacaggggtggtcaacttcatttcactacctaatatacctattatgtgtggagtactttgctagatgttgggtaggtcttgtgagcagagcagacctctctttggtctgtatggagcacggagcttgattataattggcaggtgtgtgtgtgtgtgtgtgtgtgtgtgtgtaaataaataaatatttatttatttatttattataggccgggtacagtggcttacacctgtaatcccagcactttatgaagtcaaggcaggtggatcacttgaggtcaggagtttgaggccagccttgccaacatggtgaaaccctgtctcttctgaaaatacaaaaattagccagacgtggtggcaggtgcctgtaatcccagctactcgagaggctgcggcatgacagtcactcaagcccgggaggtagaggttgcagtgagctgagattgtgccactgtaatccagcctgggtgacagagtgagactccatctcaatatatatatgcgtgtgtgtatatatatatatctatatctttaagatagatatatttatatagctaagtaattaataaatatattaagttctatgaaagcaatgagtaggctgctatggttgtgaatatttggactacacaggggataagaatgggtctaccataattagcagggacaggttttgtttaagccaaaaactaagagggcttagaacagaaaccgccaggcagaagcagttaccagtgtgaagactagatgacaaccaaaaaagtatgtgggaggagggaggggaggttgcgcagtggggagttgagattgacttagaactgtattaatgagctttccccccaacccccatttttctcccatttaccttcagaaaaattagtgatttggctaccagtgaatctaggctccaggtgtagctctgtagttttggactagttacctaattcttcattcacaacaaaacagaaggagagaggaaaaagagagcaaacatggaattgggatgggaagtaagagagcacatgaggagagagactatgtcaagtttcttcgtattccttttttaattacagaagaaaagatgggataaaaatattccatcttatttctctgtttaaaagaaagagtaggccgggcatggtggctcacacctgtaatcccagcactttgggaggctgaggcaggcggatcacaaggtcaggagtttgacaccagcctgaccaacatggtgaaaccccatctctactaaaattacaaaaattagccgggcgtggtggcgcatgcctgtaatcccagctacttgggaggctgaggcaggagaatcgcttgaacccgggaggcagaggttgcagtgagccgagatcacgccactgcactccagcctgggcaacagagcgagactccttctcagaaaaaaaaaaaataataataataaaataaataaaagaaagagtaaatgaatcaaaatgaagagaagccattttatctgcctcctggatgaagagtttcattgatgaacctgaaatgttttggttaacatgagaaaggagggtgagaagatgcctgagatgtgagctccttgaggacaggagctgctttctctctccagcctggcacaagacaaggaacttagttgaatgaatgagcaaataagtggttctctgctttgaaggaacttggactgtcattaccttgcaaatcaggtttaccatttatttgctttatataagttccagaaagaaactatttcctctcataatattactaccctaaacttctggtctgatctatggattgtagagcttaaatttcctcaaaccccaacagtcagagattgttacaccaagataaatagcatatttctcagcgccttgtattttctgtctttggccacagaccttaggacttaggctgatatttgagaaggaaaaactggaatttagtagaattatacttcctgtatcttaattttccaactcttatataaggtttgctttttctagagagagactaatctggaatgagaatgaattctcatcagtaaaggcaaagctttaagtgggtcatctgactttgcttttgtgctctacattcaccctgctcataaaaggtcctttcatgagttttctaggctttcatcactgccagcgtctccacaggcattgtgaaagtattaaacttcctaccctcccccatgcttgtctcatggactctttcgtagagtgcacagtggactgtgtttagctcagcaggaactctttgcaaacactgaatacatgaacaacccccctggaaagataagagatttcagtattgcttggtgtcatagccgcagaagttagtgtctgccagtatctgatgaatatggtgacttgcagcctaatttttgtgaaattatgaggccaaagtttaagaagtgttcatgttaaagttacttatatataaaatttgcctatcgataatttctgtcaataggaggttgatgaatgcttcacataacctagatactcctaattaactgttttttatttctttttttctaggacacatgttcaaagagcataattaactttttaaaagaagctagtaagtactgaaatagttttttaagttttttctacaagaatagaggaagaaaggaaacatggaattctgaagggctacttagcaagctgcttatggcataatctggggtgggggtgcatagtaaaggatttgcattttactgagaccgatacatgtcaagggaatggtatttaaaattagtgatatgtgttgatttttcaaggactatagcccatcaactacaataggctccaaaaaattctggtgaaattagcttcttggagccttccagtttacctactatgttattcccactataaaatattctcaacttttggggttttagccacttaagttttttattttctctaatgtctctagtatctgctttagtttcctgtcaatgctagactctgtggttcagcagttcatccattctcttcccagtactcaacctcgttgcttatagtttcattacattcatctagcaaaaccttaattctgtatgtttgccataccattagtgcttagagcattttttcagaaaagaatcctggaaaaatggatcttatctcacctgggccctcaggactgctgggctgcctggtgtcagcacttcccgccattttctatagcaccagtattattcttaatactttaaaaaaccaccaggcacggtggctcacgcctggaatcccagcactttgggaggccaaggtgggcggatcacaaggtcaggagatcaagaccatcctggctaacacagtgaaaccctgtctgtactaaaaatagaaaaaaattagctgggcgtggtggcgggcacctgtagtcccagctgctggggaggctgaggcaggagaatggcgtgaacccgggaggcggagcttgcagtgagccgagattgcaccactgcactccagcctgggtgacagagcgagactccgtctcaaaaaaaaaaagtaaataaaaataaaaaaccatatcccactatctcccccttctctctttgcctgtgatcttgctgcatacttatggggaaatctttaagatgtcagatttcagttctctcacttttctacaacttctcccacttttgcctttcttatgtaccttcccttccttcccatctgattccttatcagtatttacacatgattagttcttgcctaacctaatagaccctttcttgagtgcaaatcagtggctatttttgctagggtataaaaattacctatctaatcaccttgacaaagttaccctgttatttccaataacttacttcctatggattcttgtagattttcttttttttttttttaatttttttattttcagatgttttctcgctttgtcaccatgcctggcctaaattctcgtaggttttctatgtaaacaatcagattttctgcaagtattagtctcctttctaattgttataattttaatttctttttctttttaaaatttttcgtagagacaaggttttgctatgttgtccagcctggtcttgaactcctgggctcaagcaatcctcccatctcagcctcccaaagtgccattacagtggcatgagccactgtgcctggccaaatttcttttcttgttgcgaaggcagacttttcatacaatactgaatagaagtgatagtagattactttatttctgattttcaaaggaatgctttccgtttctctctgttgaagataattgcgtattgtttttttttttaaatagtaacttttatcaggttaaggaaggtttcttctatttctatttaaaaggattttttaaaatcttgaattcatatgtttttatctaatgcattttctacatcagttgaaatggttgtatgaactcttttaatatgggtgaattatatttatagattttatgttaaaatatccttgtatatcttggataaactcaactggatcatgatttatcttttttatatgctagattcaatttgttgatactttgttatgatttttgaatatatattattgtgtaaaagtgagcctgtgattttctttcttgtaatgtttctgtccagttttggtgcctggttttgctctctccttagaatgagctgggaactagtcactcttgttttctcacctataatagcatctgggtccagtgttttttatgtgggacaaatttgaacttgtggtcaacctctttaattgtaagaatattcaggtcttttgttcttcctgggctagttttttattctttttctagagattcgttcatttttcttagttttatttgcctataattgtggataatctgttttttatctgctacttctgtaattatttccacatttgatttataatattaacttgtgggccaggcgtcgtggctcacacctgtaatcccagcactttgggaggccgaggcgggcggatcacgaggtcaagagatcgagaccatcctggccatcatggtgaaaccccgtctctactaaaaatacaaaaaaaaaaattagccgggcgtggtggcaggcacctgtagtcccagctactcagaaggctgaggcaggagaatggcgtgaacccaggaggcggaggttgcagtgagccgagatcgcaccactgcactccagcctgggcgacagagcgagactccatctcaaaaaaaaaaaaaatttacttgtgtcttctctttttacctgtttgttaatttatcaaataactacttttggctttgtttcatttttattatacaataaaatgaaattcttttcattgtatttcttttcattgattattcctataattcttaaacaactttataattgatgtaacaataacctgtacacatttaaagtgtaaaatttattacattttgatccatgtatatagcagggaaatatcaccacaacaagagtgtgaacatataatctctccccaaagttttcttgtgtcttttataatcactgcctcttgcccctgcccactccctcatccttaagcaaccattggtctgttttctgccactatagattagattgtattttctagagttttatacaagtgaaatcatgtagtatagtattaaccatgtgtttgtttgtttgtttgtttctttctttctttcttttttttttagacggagtctcgctttgtcacccaggctaaagtgcagtggggcgatctcggcttactgccagctccgactccggggttcacaccattctcctacctctgcctcccgagtagctgggactccaggcgtgcccgccaccacgcccagctagtttttgtatttttagtagagacggggtttcaccatgttagccaggatggtctcgatctcctgacctcgtgatccgcccacctcagcctcccaaagcgctgggattacaggcaggagccactgcgcccagcaactatgtgtttctgatcctttgtcagggctagccaattcctagagacagtgaataactcactcataatctagctgcctcctttatgtcgctctcataggactttgacacctctctgctacaatccacctgccctgttcatttcaagatcaggtaccaggaaactcgggacatccctatgctgcagaactcactgaaattattcaaactagccagtcctaaacatgcttaccctgccttgcccattccttccgctgaaaccacataaaggctcttgcccatgttttcatcccattccattgacctccttactgaccctagctagtgcttcctcatgtggcccctgcatggcatggtgtgcaccttcctcttcggaactgcgagtaactgtcttgtcagcggcaatcatcttgtgatctgttggcctcatcatatttgaataacaataaaatctgttttaaggctgggcgcggtggctcatgcctgtaatcccagcactttgggaggccaaggcaggcggatcacgaggtcaagagattgaggtgaaaccccctctctactaaaagtagaaaaattagctgggcatggtggtgcgtgcctgtaatcccagctactcaggagactgaggcagggaatctcttgaacccaggaggcagaggttgcggtgagccaagattgcaccacggcactccagcctggtgacagagcgagactccatctcaaaaaaagaaaaaaaaaaaactgtcaaatgatactccaaaatggttgtaccattttatatttgcaacaacaatgtctgagggtactgattgctccatatccttgacagcacttggtatagctgatcttttaattttagtcactttagtgggcatatactggtattttatgttttactttttattttcctaatgattaatagtttgcagcatctttcatgtgcttatttccctttcatatatcttctttgataaaaatatctgttcaaatattttgcccattattttgttggaatacttattttcttactgttgagctttgagagttctttatatatctggataccaatcctttgtcagatatattttttgcaaaattttttcccagcctgtgatttagtttgttattctcatgtcttttaaaaaaaattgtagttaaaatatacacataatacaaaatttaacattttaactctttgtaagtatacagttttgtggtattaagcatagtcacattgttgtgcaaccatcaccgccatccatctctggaactttttcatcctccctgactgaaattctgtacccatttaaacactaacttctcattcccccttactccagcccctggcaaccatcgttctgttttccttctctatgagtttgactgctctaagtacttcatataagtggagtcatacaatattttcattttgtgactggcttattagtataatgtcttcaagtttcatccatgtggtagcatgtgtcagaatttccttcctttttaaggctaacattccatcctatgtatataccacattttatccattcatctgttgatggacatttaagttgcttcctccttttggctattgtgaataatgctgctgtgaatgttgttgtataaatatctgttcgagttcctgctttcaattcttttgagtatgttcccaaaagtagaattgctgggtcatatgttaatactgtatttagttttttgaggaattgccatactgatttctatagtagtggtaccatttacattccaaccagcagtgttcagggttccaatttgttaacattcttgccaacccttgttgttttctggattttttttattttggggttttttattttatttatttattttttttttgaggcagagtctcactctgtcacccaggctgaagtgtagtggcgcaatctcggctcactgcaacctctgccccccgggttcaagcgattctcctgcctcagcctccgagtagctgggactacaggcgcgcgttaccacgcctggctaattttttgtatttttagtagaggtggggtttcactgtgttaatcaggatggtctcgatctccggaccttgtgattcacccgcctcagcctcccgaagtgctgggattacaggcgtgagccactatgcctggccattttttatttttaaacaatagccatcctaatgggtatgaaataggttttttggtgttttgttttttttttttgagacagaatcttgctgtgttgccctggctggagtgtagtgacgtgatctcggctcacctcaacctccgtctcctgggttcaagcacttctcctgcctcagacttccaagtggctgggactacaggcgcccgccaccacacccagctagtttttgtatttttagtagagatggggtttcactgtgttggccaggctggtccacgatccatccaccttggcctcccaaagtgttgggattacaggggtgagccaccatgcacagccagggttttgttttgttttgtttttactatttttttttttttttagagacaagctgtctcccaagctgtagtgcagtggcaccattcgtatctcactgtaacctcaaactcctggacccaagcaatcctcctgcctcagccttccatgtagctacgtctacaggcatgtgccaccatacccggctaactttttttttttttttttttttgagagttttgctcttgttgcccaggctggagtgcaatggcatgatcttggctcactgcaacctcctcttcctgggttcaagtgattttcctgcctcagcctcctgagtagctgggattacaggcgcccgccaccacgcctggctaattttttgtatttttagtagagatggggtttcaccatgttggccaggctgggctcgaactcctgacctcaggtgatccacccaccttgacctcccaaagggctgggattacaggcgtgcgccaccacacctggcccccagctaacttttaaatgtattttgtagagatgaggtctcactgtgttggccaggctggtcttgaacttctgagctcaagtcattctcccacctcggcctcccaaagtgctgggattacaggcatgagccaccacacctggcccctttgcccattttaaaaattaggttgtttttgttgttgttgagttgtaggagctctttgtatattctgcatttcggttccttattggatatgtgattggcatacattttttcccatccatggattgctttttcattctgttatagtatccttgattcacagaagtttttaatattgatgaggtcctgcttagtctgtgttttgttttgttgcttgtgcttttggtgttatatccaagaaatttttgccaaatccaaagtcatgaagctttgccctctgtttccttctgagttttatagttttaggacttaaatttaggttttcgacccatttttagttaatttttgcaagtggtataagggaggggtccagcgttattgtttcacgtgtagatatacagttttctgagtaccatttgatgaaaaggctgtccattgaattgcttttgcaacttttatttgggcatatttatgtgagtctgttactggttctatattttactccattgatctatgtgtctattcctctgctaatactgtcttaaatatggtagctatatagtaagccttaacactgagtagatagatttctcccctttttttgttctttttcaaaattgtcactggtttgtttttattttttactttatgcagataatctgtactatactttggtttcatgtatcaagtagtttgttccaagttgtgctttaagcagaacaaataaattttcatattgttctttgtgttaatctgcaatataaacctataccaaattctattttgtgtatttgtttattgtagtaatctgactgactcttttgcctccagactcatctctttcaaggtccccaactgaatcttgttttaggtggaacttagaagcagtagaagttaagaatctatttcacagccttagtagtctagtttcattctctatataatgttgtctatgcaagtgagctgctctccagtgccttagtttcactaatgttggggaaggtctcttctcttgttttggacttctctatcacattgcctttctcaagagaagacatataatgaaagttgatatctggtgttctaggacttcttcagaagcttgccagtttttcaagctgatttctctcactggcaactcttcagagtgctgttcctactccaccctcccctggtggtatgtatcagttttctactcatcagcacccacctactcctgcctactgtgtttctcagatgtctgctgcctggctagctcattgctgcttttgtcactcatagagctgtcttcttccctttttttggctttctgcctgacttccagggcagctgctctgtcattgcctgtctgccattctgtcttttttccccctaccccccacagatacaacatctactctaataccacacattctccatgttcaaactaacctcatcactttccccaccacattccccaaaactggtcatcctccagcttatagcattgcagttcactgaagttagacatctgggccttgcttacctccaacatctcattagccttcgattctacccctataaatcctcttctcagtctcctttagatattcctgccctgctgtgagatccatctggtttattggctagattacttcagaaagcttcagtcagtgaccctccttacttcaaaccccaccagttgatccttcactctgccatcagtcattgcttctaaaatctaaattgttccatttaaccttgctgtgataaaacctttggtagttcttcagtgtgttcagtggtaagttaaaactttcactgtaatgtacaggccccttcatgatatgatcgctgcctcctcgagcctcattgtgtgcatttccccgccccaccctttcctcacccaccctagtctttcatgtctgccatttttacattcatttagcagatatttattgaagccccctgtgatgtccttacctaggtctttcttgttgccaggaccagacaggctttttcaagcttccaagtcatctcagtttgaaagactatgtctgacccttgtcttggccaattactctttatccttccaagttcaatgattgtcccactgcactccaaccagagtgagagagcaagaccctgtctcagtaaataaaaataaataaataaataaataaataaataaataaatcagccataatttatttaatcatgtctctctcccccattgatagacgttaagggtatttccagtattcttctcttgaaaacaatgctacattgaataaccttgtacatgggtcactttgaaagtatggatatgtatccgtggaataagtttccagaagtggaattgtgtcagaggggttgtgcatttgtaattctgatgaatatttatagattatatgagagtacctgtttactcaaactcttgccaatgcagcattatcaaagttttttatgttcgccagtgtgatagattaaaaaatggtatctcagccaggcgcagtggctcacgcctgtaatcccagcactttgggaggctgaggcgggcagatcacggggtcaggagatcgagaccatcctggccaacacagtgaaaccctgtctctactaaaaatacaaaaaattatccaggcgtggtggcgggcacctgtagtcccagctactcggaaggctgaggcaggagaatggcatgaacctgggaggcggagcttgcactgagccgagatcgcgccacaacattcgagcctgggcgacagagcgagactccgtctcaaataataaaaaaaaaagatggtatctcagcattgatttctttgatcatcagtgaggttgagcatcttttcatagatttaagagaactgtatggttttttgtgagttatgtttcatatcgtttacccattttacttttaggctggaagcagctgttttagtggaatggtggaacaagaagccagattgccatggagagacaactctttctagagatttggctatgaagcagagtagagacaatgatagctgaaggattgatgtagatgcaaagaaatttttcatcttctttgaaaacttaattgtgttaaaaactggtatgaaagggaggggttaaagctagagatggtggtagaaaaaaatgcagggttcctaaaggactgagattcctggatggaatttcagggaaggggaaaatttctggatatagtgactggggagttaagggtgtctagtccaatggcttttattttcttggaagggtaggcaaggccaacagccacatgtgtgggaggagatggttagaggggagaggaggtttgaaggcaccgctatggagaattggagagagctaaggaaagacagaaagactgcagaaagtgcttagggttccactgaagcggaaatagtgatttgtagtgatacaacccttatgagttatttgatttttttttttttttaagcagcatctggcagtccaagtatagggctgacagtttgggatttttctttccatgttggtgtaaaagaagaacagtgtagtgaaggaagttaggacaaaagaatgattgaactgacaccaagttttcttgatttggtagaaaaggaaataaagatagagcagagatattgaaaagaattagagaggggttcaagagactgaaggcctgggtgaggtcagagagcaggtgtggtagacataacagagagaactacaaggatagaaagtgtggttggagagtgggaaggcaagatttattcagtatgggggcttttctgggtgatgacagcatctggagtacagccattgtcgtgagtggcccaagtgtagcagagataaagcgttgttggagtgaaggaagtcaaggaactgagaggctggcctagatggggattttggttgtcatccatgaggatattgaagtcatccaggagaatagcaggcctgggggacaggaaggaaactgagccacttacagtgtcttcagtgataggaaagcacagggcaaaaagctttcaagaacagggactgttaagccgggtacagtggctcacacctataatcctagcattttgggaggccaaggcgggtggatcacttgaggtcaggagttcaagaccagcctggccaacatggtgaaaccccatctctactaaaaaaaaaaaaaaaaaaaaaaaaaaagaaatacaaaaattagccaggcatggtggcacgcgcctgtaatcccagctacttgggaggctgaggcaggagaattgcttgaacctaggaggcggaggtggcagtgagcctagatcacaccactgtactccagcctgggcaacagagcgagactgtatcaaaaaaaaaaaaaaaaaaaaagaacagggactgttagagcaggctccaggagaaatgctttgcatatggcattcttgaggagtgaggaggacctcaaccctacttcctgaaatggagctctgagatgttggagtagaaatttggaaaccagagagagaagtaaggatagtgttgttgcaaatgcattgtatatggggggtcgggaagtcacaggagtttgcctcaaagtctttctcggagacggatgaggttttcactgtgattttcctggtcgtggtctatggatatagtacctgttagtgacatggatcttcttaacttctgatgtgtcttttcctccctagtgtacgcataccaattctctccacagcttccatcaccatgcatttgttcttttcccttgttcttgtattacctttctggaaaggaatttttattgtaggctaattgttactcccaccagtatttaaccactggatatttcatatgattgatctcttctgatttggaaaataaaaatgtaatctcattatattcatttgattagtggggacagtcaacacttctttgtgtattttcttagctgttcgtttttctcgtctgtaaattatctgtttaggtccttcagatttttcaaaattggactgttatgttttcagtattgttatgagttcttgtttcaattatttatgacagttcattttcttttttaaaatagactttttttttcttagagaaataagaaaaaataaaaattaaaatagactttgtgttttagagagtttcaggttcacagcaaaattgatcaaaaagtatggagagttccggccaggcgcggtggctcacacctgtaatcccagcactttggaaggccaaggtgggcagatcacaaggtcaggagtttaagaccagcctggccaatatgatgaaaccccatgtctactaacaatacacaaattagctgggtgtggtggtgcacacctgtaactgtacctactcaggaggctgaggcagaagaatctcttgaacctgggaggtggaggttacagtgagccacagtcatgcccctgcactccagcctgggcaacagagtgagactccgtcctaaaaaaagaaagaaagaaaatatagagcattcctaaataccacctgtccccaacacctgcacagcctcctcattatccacatcctacaccactgtggtacctttgttgcaattgatggaccaacattgactcctcattatcacccaagctttggtgttgtacattctgtagatttggacaaatgtataatgacatgtgtctaccattgtagtatcatacagaagaatttgactgccctgacagtcctctgctccacctgcttactcctctctcccttttcctaactgcacaaccactgattttttttttttttttttgagacggagtctcactctgtcccccaggccggagtgcagtggcgccatcttgggtcactgcaagctccacctcccgggttcatgccattctcctgcctcagcctcccgagtagctgggactacaggtgcccgccaccacatccggctaattttttgtatttgtagtagagacggggtttcaccatgttagccaggatggtctcgatctcctgacctcgtgatccgcccacctcggcctcccaaagctgggattacaggcatgagccaccacgccctaccttttttttaaaaaacaaggtcttgctctgtcacccaggcctgagtgcagtgatgatcactcctcactgaagcgtcgacctcccaggctcaagtgatcctcccacctcagcctcctaaatagctgagactacacacacacaccaccatgcccagctaagttttgtattttttatagaaatgtggtcttgctgtgttgtccaggctggtcttgaactcctgagctcaagcaatttgcctgccttggcctctcaaggtgttgggattacaggcatgagtcaccgcacctggccttttttattttctttttttttttttaaccagtgatcttttactgtctccatggtttttcacattggcttctgtcacttagtaatatatgtttaagtttcttctacgtattttcatgtttttagcttatttctttttagcagtgagtaatatttcattgtctggatgtgccatcacttatttatccattcgcctgctgaaggatatcttgattgctcccagtcgtggcaattataaataaagttgctgtaaacatccatgtgcaggttttttttaagtggcataagttttcatctcatttggttaaataccaaggagcacaattgctggatcatatggtaagagcttatttatttttttgagagactaccaagctgccttccaaagtggatgtaccattttgcattcccaccagcagtgaatgagagttcctgctgctccatattcttacaaacatgtagtattgtcaaatgttttggattttaaaaccaaaatccattttcatagatgtgtagtggtatcccgttttaatttgcaattacctaatgacttgatgttctgtgtcttttcagatgcttatttgccgtactgtttatcttctttggtgaggtgtctcttcaggtcttttgcccatttttaatctggttgttatttttcttgttgagtttaagaattctctgtcctttgtcagatctatcttttgcaaatattttctcctagtctgtggcttatcctctgattctcttggcattgtctttcacagagtagacattttatattttaatgaagtccagactatcaattatgttctcatggatcatgcctttgatgttatatctaaaaagttctcgccatacccaaagtcatctagattttctcctgttatcttcttggcattttatagtcttatgattgatatttaggtctatgattcatttttagttaaatttttgtgaaagataataaggtctgatatggattaatttttctatatgtagctgtccctttccagtatcatttgttgaaaagactatcttgctccattttattgcctttgctcctttgtcagttgactatatttatgtgggtctgtttatgatctctgttccgttccattgatctgtttgccttttcttttgctaataccacagtcttaattaccatagctttaaagtaagtcttgaagtccaatagcattaatctttgactcttctttaatattgagttgccccttcagaatcttaatgtctctccatgtaaactttagaatcagcatttttatattcacaaaataacttgctgagattatgattgagattgcattgaatctataggcttatttgggaataactgacatcttgacaatattgagtcttcctgtccataaacattatttatgatgggcttcttctttatgtttaggagcttttgttttttctgtcagatattccacttctacctttatgatttcttaattgccttttatgcttagaaagtttttcctcatcctgagctcacatattcatttattttcttttaaaatgtgttttcaagcatttaatttttaaacctatgtggaatttattttggtatatggaatgaggtggtggtctaactccctcctctcaaatatgtagttatttttcccaaaaccattttctattaatttatcaagaatagacatgtatacatatacatatataatagtcagccttccacttgttgtttgacccttgtgaaggaaattgtatgagtttccaattttggattaggctcaggtagtaattgagctgggttctgccagagatccatgttaattcactatccaaacagagttataaaatgtaagttttatgaaaatctaacagtatatcactggtttaatgatcacagcctaggaagaatggggaaattgtcaaaatcttctgtggatgcacctgaaggccactgctgaacccatttccctgctaggcacggctgctggtaccaggggcaaactcctggagtatatatgaaccacctacatctccttctcttccccccctacccttgagattttcatgtgtcccttaaggatgtgtgtcctacttcccttggagagtcactaccacattgaacactttagactgtgagtcctgtgaagatggggctcatgagtgtattgctccccagttgtttctctagcactagctcagtatagggcataaaaatctgaatggatgaacaaaccactattactggtggggacatgctactatcttacatggttcgaggtggaataaaggttgagaacagctatataatgtgttccttgaagggcagcagtacatcagtgcaatcagcctaccttctccatacttctcactctgaaaactgtaaagctgcacctagcaatcaacttgggagctttaaaagggactgctccctagctctcacccacaaagctgtagtctagcacaggtgacttttttaaaaaagttttttggtccagatgtgatgactcacgcctgtaatcccagcacttcgggaggctgaggctgggaggtcacctggggtcaggagtttgagaccagcgtgaccaacatggagaaaccccatctctactaaaaatttgccgggcatggtggcacatgcctctaatctcagctactcgggaggctgaggcaggagaattgcttgaacccgggaggcggaggttgccgtgagccaagatcacaccattgcactccagcccgggcgacagtgcaagactccgtctcaaaaaaaaataaaaaaggagtcctattaagacttatttttacaggttggatatctctaatcccaaaatctgaaatgctccaaaatttgaaactttttgagcgcagacatgatgctcaaaaaaatgctcactgggacattttggatttcaaaatttggattagggactaggtgtgggagctcacacctgtaatcatagcactttgggaagttgaagcaagaggatcagttgaacccaagagtttgagagcagcctagacaacatagtgagacgccgtctctacagaaaattttaaaaattagccaggcatcgtagtacatgcctatagtcccagctactcaggaggctgagacagaaggatcacttgagtccaggaggtagaggctgcactgagctatgatcataaccactgtctccatcctgggcaacagagcaagaccctatctcttaaaaaaaatctgaaacactgctagtcctcaagataagggatagtcagtctttataaagactcaattagttattggatatctgaggaagcatgcatatcaggctcccaaaagatcattggtttaggcacacattttaatagcttggaaatccagaatactcttctggtgaccagctcagacatagtcctgataatataggacctcatctaacatgactccctattttccagataagcatggattcctggttcattcttgttctgctcggcagtggtctgatatgtgtcagtgccaacaatgctaccacaggtaaattgtcatttgataaggctgctatttgaaatgaaattttgctttcacatttaatgagccacatttgaaaaccgagatggtatttgaagaaaggaatataaaaattttattcaaagtgatggtaaaataggtgtcttcagaaatcttggaattgaatgctcagcattgtttttcatacatacataactgctttaaataaatcaaagagattatgtgttctttcctgaaaagtaaaataaattgttgacatttacaactctatatatggtttctgaggaactaagtgaagaatcttgtgtctttctcccttaaaccgtagtcctttggaggaggtaggaaaggtccagcatgagataaaaacgtagggggtgggtggtgttgagggggattggtctttgcttggtctccatatgtttgagagtttattaaggcttgctgctttgtgtctcacagctttttagcctcacattcttcatgtgctatttccttgttttttggtgtttgtagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtactagagatgattctgtttgttcttttgctctttgagtttagtcttccttttattatcttgtttgtgttttctagccttaaaatttcttcaaataagtaaaattgctcaagtgaagtaatgaaacctgtatgtggaatttttgggttagcatgagtgaagaggaaagaagaaagattctggagaatatctttctgctaggtgggatcctggttagattgagaggacttaaatgtgtttaaaggtagagaagaaggcttaaaaagacaagagaaatagaggagctcattgacgatgcaagagactgaagatgaaaagatacagagaatgagtaataagattaggtttggaaagggagggatccgtggagaccatggaaaggagaatgggtattgatgtccatgacagttagatgtgagatacagagaatgagtaataagattaggtttggaaagggagggatccatggagaccatggaaaggagaatggacattgatgtccatgacagttagatatggagtggcaggccagtggccaggggtggcatcaggctctgggaaatggttacattgcagtgccagttgttcagggcctcaggttgaagcagtagtcccaaggagaaaatcagagacgtggatctgagaccagggcaggtaagacaagtttctgacctctttgaaccttaggtaccttgtctgtaaaagaggattagagataccctcaaagggcttctatgaggagtaaaggaaataatcattacctgattgctatgtaactgtcatcccttttctagcaaaaatcactctttcctcttctgtgttcccagttagatggtgagtgcccctaagcagaatcacatctcgctcatgtggaacattcaggaactgtttgctcagttgattctcatttgttactacagatgatatcttttactgcgccttataactcagacccttcacctgccagcttttccccatattttctaccgtaaagacaagacagcatttgcagttaagagcacagtcttcagtgccacactgagtttgaatcccagctcttccataaaccagccatgtttatggcatagctggcttactttatctctctacctcggtttgttcatctgtgaaacaagaatgagtgatagtaatagttcttacctcatagaggagatattaggattaaacaagttaatatgggtaaagcacttataaaggtgcctacacatggtaagcactatttttaagtgtgagctgttagtattgttgtggttattgctctgatagttaccagtaaaatatatgaaggtacctttaatgcagatggcatcccactattcttgatgagataggggactgcagacaaataatgtctgatacttgctttgtgctttagagttaatgtagttttgtcatagttattactgtgtgctaggcatcgtactaagagttttctagaataatcctatgaattaagttctattttatgttttataggtgaaagtattttacaatgatgaaaccataatttgtggaatgtttttcagtgtacaggtcatgacacaattcatgaaatcactttagcaggccaccactagttgtttgttttgttttattttaatggatgatccagttccatgtttattcttttaatgttacatacaattttttgaaattttagtaacaacataaaatgttgggttgtggccattgcttagggagaaaggcaggataacttgtacaaactgtatgagtgaatggaaaaggtggagactgtaacacaggcctgactgactgaacagcccatgttctattgtgtactgtctttcatttaacagttctgtgacatgaccatggataatcatctccttttaacagatgcttgatttcagactgtatatagaggttaaatgatttgttttagatctcaaggctgacaaattaggcctatttctcacttttgcggtctttccactctgcttgtagggaacttagttttccataaactgacttaggtccaaattgtgccacagctaagaatctagttattgtacatttaacacagttcacgtcataggaggctgagactatgtttctctagtggcgtttattcaagatgagtaaaacacaagaaaccattatcgcacatgggaatttcatagtcttaaaccccacatcccacttatcaccaccatttaccagtcctcctgtaacagttacaattttttattaaatcagtatttgatgtatattattgtaattatgaaatattcattgctgagctataagtataaatggattgtttttcttgtacagttttttttctggatttaatacttaccttattttttgtttatttagttttctatttagtcaggccaggcacactggctaacacctgtaatcccagcactttgggaggccaaggtggacagatcacttgagctcaagagtttgagaccagcctggggaacatggtgaaaccccatctctacaaaaaatacaaaaattagctgggcatgggtgcatgtgcttgtagtcccagctactcaggagcctgaggtgggaggattgcttaagcccaggaggttgaggctgcagtgagctgtgttcataccactgcactccagcctgggtgacaaagcgagaccatgtctcaaaaaagttattgctactcaattcttaccatgctctccagagcctctcaaaacagctttctacaaagtgagatctgttagataatctatttcttttttacctctagaaattcctcctgagccctccattgtcttattccagtctaggcttgtcgatctctagggctactacacagatacatcagcctgagatttcccttctctgtcattctgggaattccccttgctgctgcttcctgacttccatattgtcttcctttttgtcttctcatcattcggtagattcctgagaaaaggggtccatgggaggcaaattgcatccttacatatctaaaaatatctttagggctgtgcatagaatttgaggaatatttttcccccagaatttttaaagtaatgccctaactgacacctgtttaccaggtttggaggattttactgctatcttaatccctaattgtttgtatgctttctaggatcttctctttatcatcagtatcctgaaatttcacagagatgtatcttgatgtgggtctttttcgttcattattatggatacttaataggccctttagagccttgatcttgcatttctgaaaattttctcccatttctttgaaaccttctccccctcttccttttttttttttctcaaattcttaatatttggatattggatgtatcctgaattaattctttaatctttaaaatttttcctttctgttgatctttgctttgagtctttttctccttttaaaaataaacaaaggccagctaggcacagtggcttatatctgtaattccagcactttgggaggctgaagcaggaggatcgcttaagcccgggagtttgagaccagcctaagcatcgcagcaaaacctcatctctacaaatgatttagaaattagcagggcctaatggctcatgcctgtggtcccagctactcagggctgaggcaggaggattacttgaggcctggcagttgaggctgctgcagtgagctgtgatcgcaccaccgtactccagtctgggcaacagagggagacctcatctcaaaaataaataggcctggtgtggtggctcactcctgtaatcccagcactttgggaggccaaggcaggtggatcacttgaagccaggagctcaagaccagcctagccgacatggcaaaaccctctgtctacctactaaaaataaaaaaattagtcaaacgtgttggcatatacttgtaatcccagctacttgggaggctgagacatgagaattgcttgaacctgggaggtggaggttgcagtgagtcaagtccctgcactatagcctggggaacagagtgagacccgagactctatctcaaaaaaaaaaaatcagtgacaagtaaaaaggtagaatacctttttttttttctttgagacagtctcaccctgtcgcccagtctggagtgcaatggcgcagtctcggcatactgcaaactctgccttcagggttcaaacaattctcctgcctcagcctcctgagtagctgggattacacatgcccaccaccacacccagctgttttttgtatttttagtagagacaggtttcaccatgttggccatgctggtctcgaactcctgacctcatgatccacctgccccggcctcccaaagtgctggtattacaggcgtgagccactgcgcccagcctagaataccttttaaaaataaataaataggccgggcgcggcggctcatgcctgtaatcccagcactttgggaggctgaggcgggcagatcacgaggtcaggagatcaagaccctcctggctaacatggtgtaaataaataggccgggcgcggcggctcatgcctgtaatcccagcactttgggaggctgaggcgggcagatcacgaggtcaggagatcaagaccctcctggctaacatggtgaaaccccatctctactaaaaaatacaaaaaaaaattagctgggcgtggtggcaggtgcctgtagtcccagctactctggaggctgaggcaggagaatggcgtgaacccaggaggtggagcttgcagtgagccgagattgcgccactacactccagcctgggcaacagagcaagactctctctctaaataaataataaataaataaataactccttttacaaaagcatatatattcattttttccatttataatataaataatagatatgctgagttgatttctgcatattgctttttcagttaccctatcatacttgctctttgttttagtaaagagctgctgtattgaaggatataccttaatctctttatccagtttccccatcagtggacactaagattgttttcagagtactcttataaacaatacagtttgtcatttcagacacatatgagaatattagcaggatgaattattttaagtctgcatttataaatttatggatattgccacatttacctctgctaggaagtctattcctattaacaatatgtcaaagtgcctatttttctaaactctcttcagtgtggtgaattgttaaacttggggatctctgccaatctgacaggtgaaaaataacatctcagtgtaagtttaatttgcattttgctgagattgagcaattttgtgtaatttaaaagatcatttatttttctgagcattctctgttgatattctttacccatttttattagagtgtcaaggttttcctgactcgtttgtagatgttctttgtacgtttgggaaatgagtcctttgcctatggtaaaactgcaaatgttgttccctaggtggtcatctagattttctgcattgcagaagatatcattagctatttttaatttttttaatttaaatatttctcagtttaggttttctaggaattgggtcatatctaggaaggctttccttactccaagattataaaaataattttcttctggacttctatggtttcgtgtgtgtgtgtgtgtgtgtacacgcacttaagtctgtctcgaatttattctgatgcagagtgagctatggatctgtttttccccaaatatctaacttgtcccaataccccttaataatttatttttcctcattgatttgaaatgccacctatcttatatattgaattcagatatttatttacctcttcatatgtatttgagtatttgggaacattcattttattttctattaatctttttctctgtccatgtgcaaagcctcactgtctcaataattgtaactttgtaaagtatttaatatccagtaaaatgagtcattccttgttaattttatttttcagaattttgttagcaattcttattataaacattagaattaacttgtctagcaggaaaaaaagtttgtattgatcatgttaaatacgtagattaacagagaaaatggcatcttacagatgttgagtctaactatccaagaatgcaatatattccattttctgaagtcttttttttttaaatcttctgtttttgtaattataaatggagcattttcttccatcagatcttctaactggctgctgttggggatatgaaggctactgatttttgtagagacattttgtactggccaccttaaactctcttagtattggaagtaattttcttcattaatttttatggcttcaagtcatctcatctgcatatatcttccaaatttttagaactttctttttcttctgtttaatcgcattgatgaatacctccagaacaaagttaagcagctggtaaatgcagacagcattctcttgtatctgacactaaggaggacactttcagtggtttttcattatacgtggtactgactcttgagttgagataaacatattttattgtgttcaggatttaatgagcgtttatgttaggaatgggtgttaaattttgccagttgcctgttcaggatcaatgagaaagatctgaatgattttttttctcttttggtctgtttctatggtggattctattcctaggtttgtttgtttgtttgtttattttgagatggagtctgttaccaggctggagtgcagtggcgccatctcagctcactgcaacctccacctcgcgggttcaagtgattcccctgcctcagcctccgagtagctgggactacaggcacgcaccaccatgcccggctaattttttgtattttagtagagacgtggtttcaccatgttggccaacctggtctcgaactcctgaccccatgatcctgcctcagcctcccaaagtgctgggattataggtgtgagccactgcgccctgccagtttttatttattcattttttagagacagggtcttgctctgaattaattctttaatcttcttaatttttcttttctgttgacctttgctttgctttaagtcttttcctttgagtcatccaggctgaagtacagtggcacgatcatggctcactgtaaccttgaactcccagacttaagcaaaccccacctcagacttctgagtagctaaggactataggcgcatgtcaccacgcccagctaatttttaaattttctcagaaacagggactcactgtgttgcccagactggtcatgaactcctggcctcaagcagtcctcagccttagccttccaaagcactgggattataggcatgagccaaggccgcccaaacatattgtatcgttcctgtaacaagctgttgcagtctatttgatattatttcttatttttttcatttagaattttctctgtctagatattctcaaattatctctaaatgagattgatctatgtttttcctttgtgtgtgtattctttttgataagttttagtttttagtgttttgttttgctacatggaaaggatttgaaagtttacactaaaaaatatgctttttttttttaagacaggctttttcactgttgcctagtgctggagtgcagtggcatgatctcggctcattgcggcctgcacctcctgggctcaggtgatcctctcacctcagcctcccaagtagctgggattacaggtgtgttccaccatgcccagctaattttttgtatttttttgtagagatggggtttcgccatgttgcccaggctggtcttgaactcctgggctcacatgattctcctgtcttagcctcccaaagtgctaggattacaggtgtgagccaccacatctggccatttcattcatgttttcaaatgtatttgaatgaggaaaagttctcccttgtgattatttattataatagcctacagagctattaatttttaaattttgtttactttatgtctcctttttttttttgtttaggctgaataaccatttatttcataggtttattgccttttttcttccaaagaacttgctattgtgcatttatagtccttttatgtttacgttttctatttcattgatttttactttctaccttctttagatttattttgttctttttctatcttcttgaattgagtgtgctttaattgcattctttccagttaattaacatatttagtgctgtgaattttgaacaagcacagctttagccacatcccataggtgtttctataggcagttgtattaggatgcgctataagctgctctgacaaagataccaaaattcagtgacttaaataagaccaaagtgtctttctctccccagttacattccagaggtagacagggccttcgtctcagtagggaccaaattcctttcctcttgtggccctgccatcctaacaatattgcccttatctgtttggttagagatagttctcaccattgggttctagttccaaccactgcgaaggacaaacaaagggaataggggccatttctcttccaaaagatgtgacctggaagttactcacattgctttagctcacatcccgttggctagaattcatcacatgaccacacctagcacaaaggagtctcaaatatagtctgccaggagagcttggtgctcagctaaaaaacaaaggttctgtatcaaggcaagaagagaaagagactgatctgaggggaggagagttggcaggttctgtcacaaaacttctcgtcattgttatttttaaggtatttttccattttgggttttttgtttgtctgatttttttttttttttttgagatggagtctcgctctgttgcccaggctggagtgcagtggcgtgatctctgctcaccgcaagctctgcctcctggttcacgccattctcctgcctcagcctcccaagtagctgggactacaggcgtacaccaccacgcctggctaattttttttttgtatttttattagagacagggtttcactgtgttacccaggatggtctcattctcctgactttgtgatctgcccacttcggcctcccaaagtgttaggattacaggcgtgagccaccgcgcccggccgtctgtttgatttttgagatggaatctcactctgccccccttctggagtacagtggtgtgatcttgggtcactgcaacctctaccctcccaggtttaagcaattcttgtgcctcagcctcccaaagtgctgggattaaagacgtgagccactgtgcccagcccattttggttttgatttttttttttctttgaaatagagtctcgctctgttacctaggctggagtacagtggcatgatctcggctcactgcaacctccccctcctgggttcaagtgattctcgtgcctcagcctcccaagtagctgggattataggcacccaccaccacgcccagctaatttgttttgtatttttagtagagacggggttttaccatgttggccaggctggtctcgaactcctgacctcaggtgatccactgcacccggcctcattttggttttgatttttattttcaaatgttttcttactttgtcaatttctaattttattgcattgggacaaaagaatattgtactctttctactgttggggtttataagggctgtggatatttcactcgcctttgaaaagaaggttttctctgttagtctgtagagtttggtatgtaccaattagattttattacttatcattttggtcttttgtatccttacttaattttgtcctcttgaattttaatggagcaaaagacataaagtcctctaataacatgcgttctgtttgcattctcatactttttatgaatattgatgctgcactatttgtgtacccagggagaaggccagaccactgtccaaagtttagtgaatctgggcagccttgtttcccagttgttggaggatgcctcatggaggaaagcattcctaatcctggagcttgttttgttgtactctaattgaattgtaatgtgtttctttaacctgaatgaatgtttctattttttacttattacacaggtaattctgactcgaaggacagaagaggtgagctgctcaccttatatctgttgttccttttacacagtgtacagtattcatttatttcctctgctcacagtctgtggtaaccgtgtgcatctgtggctgtgttgtttgtttactttcccttaagttatttccatgttaatctcatggagaagagcaatagaaacaagtactgtattcagtatgttttttaatatagactatggattctaacagctatgatgtattttaacaagtaacaaaatatatcttactttgacatgtcactttgttaacattactttttggtgatattaggtcataatttctataccattagttacttctgatttctaggccacagttccctttaaatattctttgtgttgtttttcccctagtgtataaaatgtcaaccctttgtggctttatatggattttatggattttcagcccttaaatgtaaagtctctatggcctgagatgttgtgtctgtggtttaagctggactgctgagtccctggtcactagagagtagggggacatgggtacttgtctgcagaagtgtggcacattttgcctagaatgacagtaaggctgctatcaaagagcatgagagaaagagaaagagatcatctaacattctaagaagtgattattacatttgagttttaaaaatgttactattcgaagcagtgtttttatcataattttctattttatcaaatcagacttgagttttttttctgattctgttatttaaccatacacaattttccctgtgtaattaagtaatggaacacttggaggcatatgaagtcccactaagtagggagcatttgagtcagaaaagtgggtactctcttcctttatgtgatgtccatctgccattgtatttggtaaggaatagtgaggtgttaccatactgtgtacagatttccctcacttttccacctctcactttcctaaacttgggaactaaacattggattaatacagtgtctttgctgttcagattcacttgccagattttatcaaatgtagacttaaataggttttattgtgatagatatttacttgctccctaaaactgctctcttaaccagccttacaataaagtcaaaagtcaaagtggtaggcttcaagatgaaacataagatctgttgactccttcctctatttagtatatattttcataatattcagccttttcttgccccagatatcatatctattttacctacccaatatttaagtagtttccatgttgtgattaagaaaacaaaattaccataattacctagattattgctaattgtgacatatgtaaagtctattaatgtaataaatctcctttcttaagtcaaaaaataattttgtgtaattccaaacaggaaactgaaaaggcataggtattctcagcagtctctaaagtcccaaaatctaatggcaattttaccagagcagatctttagaagtattgctataaatttggatatcccattctaattttaagccaaatgctttttgagaaataagccagctgtttggaaatgcttgtattataatcggtttgataagcagttatgtcttatgcagatgaattaggggctacctgtttttatgcactggtctttggggtgcttttgaacagtagtgtctgatgttttaattgtcaaagcaaaaagaaatgagagggagggcaacttttcttcctcttctgaagtccaggaaactggttattttctcatgcatattattttaaaatatattccagccaggtgcagtggctcacgcctgtaatcccagcactttgggaggccaaggcgggtggatcacaaggtcaggagttcaagaccagcctgaccaatatgataaaaccccatctctactaaaaatacaaaaattagccgggcgtggtggtgtgcgcctgtaatcccagctactcgggaggctgagtcaggagaattgcttgaacctgggaggcagaggttgcagtgagccaagatcgcgctcttggctgcgatccagactgcactccagcctgggtgacagagcaagactctgtctcaaaaaaaaaaaaaaaaatcagactcttaatatttgtaaagaagtagtccttgagctactacttaagtctagaaagagttgatattcttgttttaagagtgttagggcactttgggaggctgaggcaggtggatcacttgagcccaggagttccagaccagcctgagcaatatggggaaaccttgtctctactaaaaatacaaaaattaaccaggcatgtggtacgtacctgtagtcccagccacttgggacgctgaggtgggaggatcacctgagcccaggaaatggaggttgcagtgagccaagattgcgtgactgtactctagcctgggcaacagagcaagactctgtctcaaaaaaaaaaagggcggggattatcatagtgccattattattatgagtttatgatggctttctctaagcaccttttacattcggcatttattcagtacctattaagcatcaaggagtccagaaaaaattttatatataaatatatataaaatatgtaaatatatatatgcatatgcttccctatctcaggaaggaaatatgtgaacatcaggaaccgaagtctactcagttacatgccattggatatatcacacaaagtgctgagggaactcagaaggctcattatatctggggagtgggaaggaggcacagagatgtgctttgggaagtttaaattaaaatagcaaatggggaaaatgaagacacaccagacagggcacaagcaaagagacatgaaagagtaagtcatgtgtttgaggatctgtgcgcagttgacatgtgtgaggtgtggggagtgatcagaggtggcctcaacagaatgggtgtggtggtccactgagttcaggagttggagcatctcctgaagatgatggtgagtaaggaagtaacatagtcagattttggttttagaaagatattccagaggacttaggggagatagatggacaatagaaatttaggtttctgaataatttggctcaaaacaacggtgattgggctcaacccagtggttagattctagaggcaatccaatgaatattgctgtttttagagccaataggaaacatttaaaacaacattacaaccttgcctttgagagctgataaatacttgtaccaaaaagtgtggcaataggtaaatgggccataggaactggggctataggactatggctattcctttactgactagtttgtagttgaccagtgtgtgtctgaagtccttaagtcactcacctgtttagaggtgagcccttcaattaatatggccctttgttttcaaggaaagaagttatagcaagtaggtatctgttgtcccgggacaccattttagtggttttcattttcatgcttgctccctggcctgaatctagaaagtaaaactttgctggaatgaagttggggttgaaacagtttcggtttgtaaccatactgtctctgtctcatctactcagctctgcctttgtaatgtaaaagcagccatagatggtatgtaaatgaatgaacatggccatgttctgatagcattttatttacaaaaacaggcagtgggctaaatttgggctatagtttgccgacccctcttctaggcaaagaactgcctgagcgtaggaagctggactgaggttctctgctagtgtgtgaacttgtggatgccaaagccaatctcttcccttcatgtcagacactttgcaaatgttacctcttttagatctcccattaactctaaaaggtggagggtgctattatgcttccatttcatacattgttctaagagattatcacactactagtaagttaggatagtaggaatttgaacttcaggtctgtcagaccctaaaaccccatgccctggaaatggttttctaaggctggcctgtggttcgttggttgatttcaattagaatttaagaattttttcagaatacatctaggtgtaaagatttttttgtcaatattactccacaaactagattatttcttttggcctgataactcaggaactttcttgtattacttctctcccttcttactggtttcttctttggactctcctgttgcacaggtattggatctcctggacctatccagttcctttcttttctatgctgtcatatttttcatctcttattgctctgtgttctgggagcttccaggacagttgctctttcacacaactaatttggttttcagttatatcagttctcctatttagcctttctttttttggaggcagggctggggcagactcatgctctgtcgcccaggctggagtgcagtggcctgatcacagctcactgcagccttgacctctgggactcaagcgatcctccagcctcagcctcccgggtagctgggactataggcatatgccaccatgcccagctaatcaggtgtttgtttgtttgtttggtagagacagactaccagagtctcgctaagttgcccaggctggtctcaaactcctggcctcaagcagtcctcccaccctggcctcccaaagtgttgggcttacaggcatgagccaccgtgcccggccctgttaagcctttctatctagattttttccctcctaatcatgttggtgtttttttgtttgttttcatttttgttttgttttgttttgagacggagttttgctcttgttgcccaagctggtgtgcaatggcacgatctcggttcaccgcaacctctgccttccaggttcaaacgattctcctgcctcagcccccagagtagctgggattacaggcatgtgccaccacacctggctaattttgtatttttagtagagatggggtttctctatgttggtcaggctgctcttaaactaccaacctcaggtgatctgcctgcctcggcctcccaaagtgttgggattacaggcgtgagccaccatgcccggccagtttttaaagaactccttcttactactcagattactcctttttaaatagtggcttttaaaaaatatcaatgtaggctgggcacagtggctcacacctataatcccagcactttgggaggctgaggcaggctgatcacctgaggtcaggagttcaagaccaggctggccaacatagtgaaaccctgtctctactaaaaatacaaaacttagccaggcctgcagttccagctactagggaggctaaggtgtgaggatcgctcgaaccaggaggccgttgcagtgaaccaagatcacgccagtgcacttcagcctgggtgacggagtgagactccgtctcgagaaaagaaaaaaaaacgcaatgcagcagtggctcacgcacataatcatagcattttgggaggccaaggcaagaagatcacttgagaccaagagttcaagaccagcctgggcaacaacaagaccccctccccccatctctacaaaaaatttaagaaaaaaaatttttttaaatcaatatggcatcctgttgcacaaattgcagtatattttgaaagatttattctgtttcttttgtcacctccatttcccagggctactgttgctctgtttgagctatgccctggaccattgagtggcttagactgtgctcacaataggtgtcccttcatcccttcagaagacaaacatggacatacgtcctaaaccaggaaggggttcagtgatggctcaggaaaatcggggcagggtgcagttatcctctaggcgagctgccgttttctttttcctttcctctcttgtggttgcctagaattagcttgggcactactatggtttttttctgtctgcaggccccaggagaccttctgtggacccaatatacttaacaatcatatgcagtgtagacctgctctggtgtcaattctaaccaaaacaaaaaaaaagcatttatgagacactcagggaaattcaagcagtaactgaataatattagatgatactaaggaattagtgttactttttaaattggataatagtattatgtttatgttaagaatcttgatctcttggtgatacatacctaagtaattgcatttgaaatgctaggtctcggatttgccttaaaagaattcagttagaatggcgtgagtatagaccagtggttccttactgggggctatttcccccacaaaggcatttagcaatgcttggagatacttttggtcatcaaaattgggaatttgctacagacatctaataattagaggctagggatattgttaaatgtcctacagtgcacatgacagacccacataacagagaattgtatagcccaaaatgtcattagtgtgacgttgagaaaatatatatgcagcatatgttttgtaaaaaagaagcccttaccagtctctgtgacaaactctctactctgtgtagagcactgtttttccagctgagtctagatgggaagccccgcttgtcatttgggctgtgggtgtactggtgctgggttggcaggcctttgcttaagtaccatcctggtacctcaaggtccactttcaaccccagtcccaattccctctgagcttgaggtgtttccaggcccaaactggtagaactagtacttagttttcagctggaggctctttggctctgtttgatctcttggacatcgagtctggtctgttttgtcttccagaaatctctcaaagattctgatctacatatgccaccgtttgctgcctttcagatatgctgttgattcattagtatttttatatttcttctaccatgtcagtgtgctttgggggaagatgaagtaaattcatggatttagcccagtgtcttaagccaaaggtgcctaattactttcttcttcttctttttttttttttttttgaggcagagtctcgctccgtcacccaggctggagtgcagtggcacgatcttggctcactgaaacctccgcctcctgggtacaagcgattctcctgcctcagcctcctgagtagctgggaccagaggggtgtgccaccacacccgctaattttgtatttttagcagagacggggtttcaccatattggccaggctggtcttgaactcctgaccttgtgatccacccgcctcggcctcccaaagtgctgggatgtgcctaattactttcttataatacctgatatactgccccctgttgttggaatttaacaaagacatttagtgataaattactatttttttttgttctttggctcaacgtaatccattgtttgttttgtgcctgttatgtgtgagaccctgtgctaggttttaggtgtacagtgagaatgaagcagacatgtaatccttgctcttgtggaatttatgctataaaggagggatattcattaatcaacaaagtcaaatatgtaattataaagtgtgagaggtattatcaaggaaaataataaggtccttgccttacaaaaatagtataggaaataacagcaattttttttttttttttgagacagagtctcgctctattgcccaggctgaagtgcagtggcgcaatctcggctcactacaacctctgccccccaggttcaagcgattctcctgcctcagcctcctaagtagctgagattacaggcatgtgccaccacacctggctaattttttttgtatttttagtagagatggggtttcaccatgttggccaagctggtctcgaattcttgacctcatgatctgcccacctcggcttcccaaagtgctgggattgcaggcgtgagccactgtgcctggccgtaacagctaaaatgaagtacacactgtgtgctagttactgtgccaacaactttacatgaaagatctcatttaatacgcagaataacttatttcagaaatgaggaaactgagacttatgatcctaatttagtattaggaagtcagagaagacctgtgtgggaaaagtgacacacagagaaccagacaagtaggagataaccaggcaaagaacagagagaggctgtgtaaagcagaaggaataacatgctcaaaggcctgaggatgaatgaatgaaagcatggaaggacaccagtggctgaaattgagtgagcaaggaaagagtgcaagagatagggcaggtaggggctaaatcgagggggttgttagagtccaggataaggagattagatttcattctgaggcatgagaaactgttggagggttttacctaagagtgggacacaacctgagttgctttcctagagatcactctgctttgtggagaatggattggcaggggcagaggcttactgtgatccaggtgagagaggatggaggttgggactacactggtggcaataaaaaaaatgcaaaaaaaaaaaaaaaaaaaggcagacagatttgaagttttagatatatctccaaaatatattatttgcagctgtgctagatatagaagataagtgtgaggaagaaatcaagggggtttccacatttcttacttgagcaacagggtgggttggagtactagctactgaatggtgagggaaaggttttaaacacagaaagcttgtgttgcctatgaaatttaaagtggaggtggcaaataggcagttgagaatctggaactcagaaaagaggtctgatcaagcaaagcaactgtgggaattgctagcatggcatttatatttacagtcatctctctgatcagattaactagatatagagaagagtgccaaggacagagccctgaggaattcccacatttagagatctggtgttggaagaggaacagatagtgagggaaactgagatgggcagacgagatagaaggaaaatcagaggagtgtttcgttgtggaaagctaagagaggaaagtgcttcagagaggaaggagtgatcagccagtctgaacactcattttaaggtgagagccacataccacagtatgtttgaaacttaccattaacaaagaagcgtcatgtaatgtcttccatctctaaaaacaaaaccaaaaaaaacccatctgtccacctcactcacatctccctccatctgtcattcctttcctctgcatcccttaatgttaaaagtccccacgaaaggacccagtgtctcactgtcctttttctatctttatttcactccatttaggctttctcacccatattcaactgaaaatactcttggaaaggtcaccagtagccaccgtcttgtcaaatctggtttcacttctctgtctcatccttcttaagtctgtaggcagtatttgattgaattgattgctccctccttgaaaaactctgctcttggcttctatgacactacattcttagattaacctctcacctcatggctactgcttatgggtcagtttagcttttaacagaatgtaaatccagttatatatctcctctgttcaaagcccttcgatgacatagtgtttctcatcacactcagaattaaatccacaatcattacaatggactcccaagtcctaagtctgctggcttttgcccacctctctggcatcttatattgaactggcctttgtgctgtttcttgaacctgccaagctcctgagagctaccatgcttgctgttcccagtgtctagaaagctcttcacccagatctttgcgtggttcacttcacgttatttagagctctgcttgtatattacttcctcagagagaccttcccagaccactgtatcactgctccccaacctgtcactttctctctccccaccctgctttttattcctcatagcacttgtccctgtctaaaattaagtattgacttgtttataaacagtgtcttccttcctccccacagaatggaagctttctatcacttgtctccttgaacacttctctgttcctagtgtctcaaacaatggcatgcaattgctggcccacagatatttgaatgaatgctgctaaaaggttgaatcagatgaggatgggaatgttcctgttggatttggcaatatgccatttgttggtgttctggctgagcagtttaaacagagcactgagggtgggagtcagggcaaatagattaaggagaacctgaaggtaaggaattagacaagacgaattagacaactgtgtttcggaaagtcagctgagaagagagacgcgaggctggtggtagctgggggagggtaaatgaggtcaagaagacaagtctttgagttgacagcagtggatgtaatccagagcacacatgacaggatggaagagacttgtcttcccttttagcaggtaggaaaatggtgaagatagttaccaagccactctgatggtgtagttcatggagtcgggtggagggtgagagtggaggcggatgagtcagtgcctggccagctgcatgagaaaacaaggctaggtattgggtgaaagggagccaggccctgtggaatgaggtgggattgccatgtcttcaaaccagatgttgccatggttggggtcctggcaaaaggtgactaagggagcagggtgtggaaagaggaaaaaagaagcaaccagcagttttgttacatggtggctgaggatctaataatgtctccttgttttattttatttttatttagctggtctcaaattcctggcctcaagcaatccttctacctcagcctcccaaagtgctgggataggcatgagccgccacacccagctgtctccttgtttgtttgtttgtttgtttgtttgtttgtttgtttgttttgagacagggtcttgctctgttgcccagggtggagtgtagtgtacaggcccggctcactgtaatctccatctcctaagctccagtgatcctcctacctcagcctcctgagtagctgggactataggcgcacatcaccacaccggctatttttttaatttttagtagagatggagttttaccctgttgccaggctggtctcgaataccttggctcaagcaatccacccgctttgtcctcctaaaatgctaggattacaggcatgagccattgtgccctacttgtctccttgttttaattaggaacagtattctctgtgcccggaaaccatttgggtttatgataggaaaactgtctttttcccttcctctcccatcttcctctagatggaacccattgaggctgagagagtgtacagtgttggccctgcatacctaacttgccatcagaattgaatgtgttcatgcctccagatattccagtgctttttatgtgctaagtactgttttaggctcaaaggatatagcagtgagtaaaacaaagtgtctgcctttaaacagcttttattctaatgcagggagacagagtaaataaatgtatgatagtcagagatggggtgagcatgtcatcctgggccccatgctctctccccacctcacctcaatagccctggcatggcagtgggaggtgcacactcatactttcttctctgtttccatttcctggcatctgcagaaggactgaatgagctcttcctcttcagggtgttgccctgaatggctgacttaagccctccattgcacaacacagtaatgacttgttctgttgtcttgatttcagatgagacaccaattattgcggtgatggtggccctgtcctctctgctagtgatcgtgtttattatcatagttttgtacatgttaaggtgagcctactaacacttcacattctcttagattctgtttcaatatcccagtgtcccaatgaacccacacagtccagtagacagtaggatatacacaatgaataggatagagggggaatgacccatgatagtgctaaaattgaagttctacttagaaattatttaaaagctctacatagtcttccttaagtcctaagccctccctctttcttccatctgtccaagcccagtctcccaactccagtgcaagctaaagcccagaatggtagtttggaggttgaggtaagaaaccgcagtttgttattagtgacaggtgttacaggatctctaggtctagccctgctgaagcaacccctaaaagggccccagtaagattacatgctcaacaaaagcctactgtatttctggctggggctttgtccccagacccttctgggacccctggccctggcatgttgagttgagccatgtgagttgtgagttacaggatccctctttctaaccttctttcagggtcctctagacgttaccactcaagcagaagcaaggaaggggaacccaagggagagaagagggtggtgcatttattctcttcctgctaaagctactgccctgactaattggatttagccctgccttatctttggcctaaccaaagatgttctgtgctccctctgttcttctgcagggataaagagagaggaatcatgtgccccctataatttgtcatgtgtctctatcattctgcaggagacttgtggccaggactgtgtccacccaatccaaagctctgggcttctccctgggtctcccaggctacactgaggaaataccaagatttttgtttgatatatattgtctgtctcccccagctgtattccacccactcaccctctctctacctggtgtggctgtgctctgcagtgagccacatgagcctgaatatactgttggggttccctggttggattccagtgtgccaagggtaaacaggagtatcccgaggtactcggtcaccccagcatgctgctgcctcagggtgtgcatgacctgtctctaaaaaagcccgattatttttaaaggcgatttagaaaggctgaattgatgagcaggaatacagaggtgtgatttgcctctcccacctctgtgctccattcttcactgtgatcattttctcattaggtttaagaaatacaagcaagctgggagccattccaattctttccgcttatccaacggccgcactgaggatgtgggtaaggcattccttaatgtcatggggaaccttcacaaggaaggaaatcaagaaattaggagtttctccatccttttaaaagaataagacaataaaaagaggaaaaaagatttttgaagaaaacagtcctagttcttacaggcttggtccatgaggtagaaccccgtttagcctccagaagaggggctaggttctcagggtacctgactgaccttctcccttgtgtactgcagagccccagagtgtgccacttctggccagatccccaagcaccaacaggaaatacccacccctgcccgtggacaagctggaagaggaaattaaccggagaatggcagacgacaataagctcttcagggaggaattcaacgtgagtactttgttgaggctggtgtatcagcagggaagaaggcagacctaaagtcagacctttcagatctttggagtcatgaagtaaaaaatgggcttttaatgtttaagaggtgagaaatgttttaccaagtttatctgactccctgtatgatcatggataggaaatgaagtgagatttgcctcacctccctaatctacccatccattcagtcatcatcacatctcttacttcttttgtttaataaatacttagcaagcatctaatatttgtcaggtaatattctagttgccagtgatatgatgaggagcagaaacagatccaatccctattctcaaggaactcactgtccaggagggaaacctcacaaacaagaacaaatataactgtgtaagttcaaacagcagtacagcacatgaaggactggtgcatatttgtaggcatccatattaagaggttgcctttttgagtctagagcaggggtgtcagtgtttaaagtagacagtgggatagatcagtgtgggaaatgacgaccatgggagactgcagagcacaggtctcatcttgagtatttagattcacattttttataattcccacaaggaagcagaatatgtttttaatccaccagttggtgatcctagcctaccagttctgatcccagatcagaagagcttctggccagcacggtgactcacgcctgtaatcccaacactttgggaggctgaggcgggcacatcacgaggtcaagagatagagaccatcctggctgacttggtgaaaccctgtctctactaaaaatacaaaaattagctgggcgtggtggcatgtgcctgtagtcccagctactcaggaggctgaggcaggagaatcgcttgaacccaggaggcggaggttgcagtgagccaaggtcacgccactgcactctgacctggcgacagagcgagactccatctcaaaaaaacaagagcttcctcgaataaatgatattttaattgatacctaatcataggcaagggtggtggggacaggggattggggagccttccagccactggaaatagcaggagaattgtcaggagtgagtgtgctgaaggagggcacacccagaacatgacagggctgtgtgcagctgaagaccagagcttcaaaggaggataagaggtgaaactagtgtggccagaccacagaccttgcagatagtcatgagagaagtggcaagccatagagcagccagatttacatcttgaaaaaatgactcagctgggcacggtggctcacgcctgtaatcccagcactttgggaggccaaggcgggcggatcacaaggtcaggagatcgagaccatcctggctaacacagtgaaaccctgtctctactaaaaatacaaaaaattagctgggcatggtggtgggcacctatagttgcagctactctggaggctgaggcaggagaatggtcagaacccgggaggcggagcttgcagtgagccgagatcatgctactgcactgcagcctgggcaacagagggagaccccatctcaaaaaaaagaaaaaatgactctggcttctgtaaggagaatagcccatgggcagaccagaatagttgcgggaatacagttaggggttacaggtgttaatatcagaagtgctagtagattgacctaatgtcatgactaggaaatgggggatggatttaaggacacagaggagcagttccagagttggtaaatacatcagctggggcattgctaaaccatcagtttccttcacaactttccactaagccatgtgtcagctttgccttataggctggctccttttttatcagtgggaaaaattttcccaaaagcttctggagacttctcttgtcacatgctccttcttaaaccggtcgtgagcaagggagaaaataaggttactgtggttggctgagactagtccagattactcctgggtcaaggccaggcatgctagctcacacctataatcccaacactttgagaggctgaggcaggcagattgccttgatcacaggagttcgaaaccagcctgagcaacatggtgaaaccccatctctacaacaacaacaacaacaaaatacaaaaattagctgagcatagtggtacatgcctgcagtctcagctacttgggagatgaggtgggagtatcgcttgagcctgcggggtggaggttgcagtgagtcagattcactccactgcaccccagcctggacaacagagccagatcctgtctcaagaaaaaattttttttagatattcatgtgggatatggatggataacctcacagaataggaggtctggtaaaggaggaatggttattgggtcagtgggtcaccattcatatctgctccatgacagaagggcttagggggagtggtgagtgatgtcagatttgcattttgagaaaataactaactacaatatagagaatagataaaagggagaggcaagagttgaagtgggagaccatttaccaggcaagagttaacagaatagcttggaccctttttgggggctattggaaaaatagcaccatttaatgttcattattgattgataagatttaccacatcctgccaggcacagtggctcacacctgtaatcccagcactttgggaggccaagccaggcagatcacctgaagccaggagttcaagactagcctggctaacatggggcaatcccatcccatctctactaaaaatacaaaaattagccaggcgtggtggcacgtgcctgtaatcccagctacttggaagtctgaggctgaggcaggagaattgcttgaacctgggaggcggaggttgcagtgagccaaggtcgtgccattgcactccagcctgggcgacaagagtgaaactccatctcaaaaaaaaaaaaaaaaaatttaccacatctcacaagacagcactccagcctcagtaccatagctggatctgtgctaggcattgtactgttttgtaatctataatgccaactgcttctgggtgatggggtatgtgatcccattactatactttttttctgacaaattagttcttttctttttccataacattaaatttacataagcatgaaacgaattatttgtttggaggtaatattccctgagactccatggtaaggtatttcagtaaatccctggatggtgatggtattcctggaggcatgacaggtaaattcggatagatattgtggtgagagccatttgctgtgctaccatggcaaccgtgttcacgagctcattgggccagcactagggtagtgagggaaagggctgaccatcatcacctgggtttctagcaatgagtgccatcttgtgagcattcacatggaacataaatattttctttcttgtgctagttatccactacccagcgattggtttagatcctgacttccagtgagataagtggtgtgataatttgcttgaagttctcttcactaggagaatttctcttttatacacattcaaagccatcacttaagtagtataccccatagcagtctacttccagcccagcatgggccagcatgtttcaccaagcagtttatataccaggccggactttttcttcttcagttaactgttgatgtcaataggaagtcagaagtatctattgcggcagtgggttgtgtggtaggcattttatagagatcacttccagctgataatgggattctgctgggcatgtccaaatctatggctaattgaatctcataatacctagtttacgagaccggcccggtggctcatgcctgtaatccctgcactttgagaggctgagttggacagatcacctgaggtcagaagttcaagaccagcctggccaacatggtgaaaccccgtctctactaaaaatacaaaaattagccaggcatggtggcaaatgcctgtaatcccagctactcgggaggttgaggcaggagaatcgcttgaacccgggaggcagaggttgcattgagccgagaccacgccattgcactgtagcctgggcgacaagagcgaaactccatctcaaaaaaacaaaacaaacaaaaaaacccctagtttacgatggggagttgaagtcatttggatacctgtctgtgatcaggcttgcagtctctaccctagagcccagtactaggctaggagcatggtcttaccaataggatcatggtcttatatccatatccaaatattacgattcttctgtttaccttactacaaacactctagagctccatacaatctaccagagcttatttctctgtggcctggatcagcaggagcactttctcttttcagatcactcaataaattggtcagaggctgggcacagtggctcatgcctttaatcctcgcactttgggagatgaggcaggcagattgctttgagtccaggagctcaagaccagcctgggcaacatggcgaaagcctgcctcttcaaaaaattagctgggcatggtggtatgcacccgtagttccagctactggggaggctgaggtggggtattgcttgagcctaggagtttgaggctgcagtgagctgtgattgcaccactgcactgcagcctgtgtgacagagcaagatcttgtctctatgtaggtaggtaggtagattgattgattgatcagatggattagatggattaaattgagagatcagagttggatgcaaggataaggtatctgctgtctccaaaactcaaaatggcccagcaagcattgctcctctttgttagcaggagaggggtggtggggcaaggggcaacaagttgtcttttatgttggaggagataccctgacgtgctgcaggcctttgactttcagaaaatttggctgaggtggcaggccactgtatttttatgtctgacatgtacatctaagatacataacttcctgcttttcatgtctcacattgatgtcattagcatagttgtcaaggtaatgtcctgtgaaacagacaaaatcttgatgaaccagatcacaacacagaaaggtcaagatgatttatcactgaggctgctcttgccatgagcaagaaaaactgcttcaagtagtccacacaacttaaaaagaacacacacttacccctagcagtagtctaggtaccaggagttatatgttaatctgcagaaagtagagtacgtctggaaaagtaactgcaaatctgcaaagtcttctgtagcacttaagatcctgcggttcacatggagacttcgccttttgctaaagagatcactgctctaggagcttacatttgctctttctgtgatggttcttatccagtgggctagggaatctgtgtgtctttgggcattacctaatggccaatgttattgaaaatcaaggtggcacagagggaggtctagccaacttcacagagccgggagcatctagtttctttccctcccttttggaggccctgacagacaggcaggcaggcagacagacagatcgacagacaggtaagatagattagatagattaataggtcctaatgtgaagccacctcaggccaaaattccttccatcagctggcctgcaaaggctccgttctaactagcatatcttagcgacattctgagttcctagcaagtagctacctcaaggccaggacctagcagaccccaaaagatgcatttccctttacctagtacagttgccatggcaaatatctgcagattattaagaaaagatgaggagggaggtttataatatatgtgtgttaatgcgctgtggcagggttcctccttacagatgcctggcctccctgttattgaagggttctgggtctgaaatgacccaggcctacgagttggatgagggggccccctctctagcatggtggtctagtaggctgcctaaactgacctggaaagctactttccgtttccattactgggagcttcacaatgaattattcacagccataaacgtctgatcatggtctccaacagtctttctagcccacttagatcaggaatcccattttgaaatagtcccttccactagcatctcacgctgctgaggacagccaggaaagcacttctgaaagattccagtgctttcctcaccagtgtatagcctcagcaaggcatgtgatgtggatcccatcaagggcatactgaaggtgtcagtagaaggctgagcctttagagtccatatgccactctggtctcctctactttgtgcccaggtttttctggcttttcattatcacctcactaaatccagcattcagtccaggtttccactggcgagcctagctcaacattaaaaccatggccagttacctgagctgttacactacctgcagaagttcttttgaccataccataattagaaatttggctttatccaggctgggcacaatggctcatgcctgtaatcccagaactttgggaggctgaggcaggcagatcacttgaggtcaggagtttgagaccagcctgaccaacatgctgaaaccctgtctctactaaaaatacaaaaattagccgggcatggtggtgagtgcctgtaatcccagctactcgggaggctgaggcaggagaatcgcttgaacccgggaggcagaggttgcagtgagccaagattgcaccactgctctccagcctgggggacagaacaagactccatctcaaaaaagaaaagaaatttggctttaaccaagtcatactctcccttccttgttataacgtctccaaaatctatatcaacaattgttcctatcatttgtaatgatccagctcagtgaattcctgtagtttcttctggatatttattagctctttactttttttcccccgctgtagagacggggtcttgttgtgttgcccaggctggtcttgaactcctgatctcaagcagtcctcccaccttggtctcccagagtgctgggattacaggcatgagctactgtgcctggccagcattttacttttctaccttatttatgcattttaccctcaggtcatgttatgcttgcattctggtaatgtgtgggcaatgcaggctgggttgtggggcagttttcatcatgacagcaagatgcagtagagagcataatagagatttttggaaattaactttctttgggtcctctcttttatcatcatttctgttgtctcacttaaagccttatctttctcatgagcaacccaggaaagatgtgaattctgtggcattaaaattcagcaactcgcaaaatttggaaaccttaacatttcacttagcaaaatacatatatagtaatgtaaaggccctgagtcttgggttttcatttcaaggtgagcatttgatattggagctgggttatttcttgttttgttctctaatattgtcagaagtaatcctactccttggtttcaacatttcccctctccttttaattgggacacccctactcgtttaccaccagcttgaacacatcacaggtaattgcaagcaataactaaaatagtagttgtgcagctatgaactgtgagcagcttgctctttcccatcctggcaattggttgtcagtttctttccttccatctgaacccagtaacatcacccacgtttcccctagcagtctctcaactacaacccactctgatagtaattgctaaatcagttaaggtcctctagttaaaagcaagagaagtcacctcaactaaattaagcaaaaacaaacagaactattgatttgggaagacactggaggagctggcagaatcagaaggtaagttggagtaccaagtctcaggtagagccgaccttggtggctttggggcccttctagggaagcccctgcttcttcctagttttcaaaatcctgggagagaatctgattggctcagtatcagtcaggtatgactgtgtttggatcagtcagccctgggagagaagaggagaaataacacatagggcaaacaaaccaatttgtgtctactgtcatagaataatatttttagtaaccatcagatggggaaggcctttctaagctacttagaagatttagatgccagaatggaaaagtttgaaagatagcaaatatattaaaatgtgaaacatctttgtgacaaatgatgtcgtaaaaaagtggccaactgggagaatctatttgccataggtagacaaagaatgttccagaatatacaaacctgtgagtaaaaggtaaacaatccagtcaagaaactggcaatttacagaagaaatacagatggtctataaagatatgaaaagaagatcaactatatctagtaatcagggaaatacagattaaagctaaccattattttggacctatcagatttgaaaatttaaaaagctttatatcaaatgtggacaaaagtatggggctgcagagacttacaggtgggggagtttaaattggtattgcattggagggatgattctggcagtaccaatcattatttaaatgtttgagttttctgaccaagcttctgagattcttaacagaaaaagccatgtacaaagatgtttatgacagcattatttataatagcaaagaagataaaaacgcaaatatctgtcaaatagaatggccagatgatttcttatatccattatgatattctatactatcattaaaataaatgtgttcacatagatctctaagttatattgttatgtgagaaaacatatgtgggataatttcatttttgttttcaaaaatatgtatatctgtgtgtgtttgggtatgttaatgcttttttttttaagtctgaaagactacaaattgtcaacagtggctgcctacaagggggctggaagagaggagagacataatagggaactttgttttctactaaattatttgacttaaaacaagcatattctttttataatatttttaaagcagatttttttgaatatgggaaataaatctaatggacttagtttgcttcgatggatatataacatctagaataaagaagttcctatgcctagtttgaactgtgtcaggagtcttgtggtcaggtctctataaaaagggatatcaccaaatgggatgttgttctggagagaaactggaccatgggggtgaataactaaaggaacaacactcataggacatgacagctgttttcagatatgtgacaggctaaaaggagactgtagcatttccgtgaatgcccacctgattagaagttctaggctgtggctttcatcctaattacaagctggagcttttttgttcaccagcatttgtctttctaggaatcattgaatttattcaaaagaaatactttgaaaaaccactcagaagcccccattttcagggaaaattgaggtctttaaggcattatcaaggtttaaaaagaaacaaaaagataaaattgtgttagcttctggctgggtgcagttgttcatgcctgtaatctagcactttgggaagccaatgcgggaagattgaggccaggagtttaagaccagcctaggcaatgtagcaagaccttatctctacaaaacaattttttttaattagccaggcgtgatggcacatgcctgtagttctagctactcagggggctgaggtgggagaatcatttgagcccaacacttggaggctacagtgtgagctatagtgctaactttatagagctgcaggagctacagtgagctacagtgatcaccgcactgccctccagcctcctggctaccagagtgagactctgtctcaaaaaaaaaaaaaaaaaaaggcttagctcctgagaggaatgggataggagagaaagaaaagagggaaagaggtgaagccagtgaaatagtcagaatctgtgcgatgtgagatgtgaccttcctcaggacctcacatctcttagattgccaggtgaagaaggcatgtgtgtgtcactagtgatgggactgagtgtggcatctgagttgagatgggtgaaatcgcctctacattgatgagttgtcccaaaataagtgaatcagagtcacagtcctgtgggaattagcaggaactgtgacaagggctttggaattccactgtccagagagttgggagtttgcgttttgcaaggggcagaaaagatgcccgctgacatctgggttttacattgcttagtacgagggaaatgcaaaagaaattgtgtgtctgggtgttgggtcgttttaaacagaactgttccaagacctaccttggaaggtagtaaatttcccatcactctagtgttcagtcactggtgactattgggtgagagtattgaaaggagattcagacttaaaagtgaatgagattcagacctgtactggagatctaggcaagaaaagaaaggtataaggattgcaaaggaagggacaaaatataaatttttcacagaccaaatactgtcttcagaaaaacccacagattcatcagacatattatagaattaatatgacatattatattatagaattaataaatatgacatatttataatttattatatatgacatatttataattaataaatatgacattatagaattaatatgacatattatagaattaatattcatcagacatattatggaattagcaaggttgctagatacagaagcagcataaaaatttaatgcatttctatacataggccacaaacagaaaacctaataataccttttaaaaggtgccaattacaatagcatccaaatgtaaagtacctaggaatggatttaacaatttagagaaaattattaaaatgtttgaagacattaaaggaaaatagcttaaattagtgaagagataggatcaatggattaggaggctcaattttgtaaagatgtcaattctcccccaagatatatagattcaatgcaattccaataaaaatcccaacaggtttttttgtggaacttgacaagctgattctaaaatttatatggaggagaaaagattcaagaatagccaagacattcctgaagaagaagaacaaggtgaggagacctgccttaccagatataaagagattataaaattttagtaattaagacagttttgtattggcactgggatagacagatcgaccagtggaatgaaataaagagcccagaagcagatccatttgtaagtggaaacctatttatgacagaaatgctcttgcagtttgggtggggaaaagatggtcttcacaataaatagtgcctgggaccattggtaaccctgtgggaataaatgaaattgaatgcttgtcacatatcaaacacaaaaaccaattccagttgctgtaaacactgaaatttaaaggacaaaaatgataaaatgtagagatcataatgtagtaaaatatacttctgatctcacagtaggaaaggatttcttaagacttaaaatgttgataaaagggaagattgatgaatttacatgaaaatgcaaaacctctgttcataaatgataccataaagaagatgaaagggaaggccacaaccttggtaaaagataacacaggtaactgataaaggaagagtatccagaatatataaagaacttctacaaattgttaagaaaataagtaggctgggcgcagtggttcatgcctgtaatcccagcactttgggaggctgaggtaggcggatcacaaggtcaggagttcgagaccagcctggccaacacggtgagaccctgtctctacaaaaaaatacaaaaaaaattagccaggtgtggtggcgggcgcctgtaatcccagctacaggggaggctgaggaaggagaattgcttgaacacaggaggtggaggctgcagtgagccaagattgcgccactgcactccagtctgggtgacagaacaagactccattttgaaaaaaataatccagtaggacaacggggaaaccacttgactaggtacttcacggaagaggaaactcttttgaccagtatgctatggaaagatgatgaacctcattaataatcagagaaatgtaaatcagttaacacaaagtctgacagtagcaaatgttgataagcatacggaactggaacactacattgctggtgggagtataaattagtacaacttctttgaaaaacaatttggccttatctggtaaggttaaagatacctatacctgaaattcttgcacatatgcacaagaaagatacaaaaatgtgtctcaaagcaggacctttaactgtaaacaacccaaatattcatcagtagtagaatggataagtaaattttaacaccgtctcaaatggagcactacaaagtagctgaagttagcagccaggatgaatcttaggaacgtaatgttgagccaaagaaaaaagcaactcaccacttaatcatgattccattttcctcaaaaactagactagcaataataatacattgttttggatgtaaaaaatatgagatacaaataaaggaatgtaatgataattataaaacttcaggtttaccagtgagaggggaaggaagaggatataaggagaggagcccaaagagagcttctaagttaaattatgtgatggatactttttaaaaaataaatatcaacaaatgtgaaaaaaaaatttttttttaaccgacatgtctttaaaaaatgaatgagtacttagccttggttccagttaaggcttaaacaagagatgaaacggtcttcgatgccacctagtgtttctagagagtttaacattttatagacttctgctctagctgctccttcctagctctgtgagctaggtttttcagagtagaaaccaaaaggagtaggattcaccttgttttcatccgtgacgcaggctcttcattctgaacctttgcatctagcgctgtgttctccagggcaagccctttcttctctcttgttaaacaatggctcctgtttcttcctgactctttttaggagccttagtccacctggagacctagtttttctttatcatgactgagggagctagggatgctgatagggctgtgagatgtagtctttgttattcctgacatttttgtattgaagactgttttcaagagtcttgctgtccctacgtctgttctacattttagagaagggatgcacaggaaaactagtgcctctggattagccatcagggcttaaaaaactgacatctcatcctgccctgtacttgggtggaaacctgtggaaatcttatgtgaaggaagagaatgcaaactgtgggtgaactgagaaattctgatctaaaataatggtctctactgcgtgtgtaagagtccagcccaggaaaatcttttcttccttttgtggtattcacagcatagggtcaggggtaattgcctctgttagtaaaataacatgcagaacctccagggttttaatctgaaaggaaatctcttgagtaggtgagggcagatggattttgaggtcctaatttccctatctttgggtctttcactttaatttctcctatcactgtcatgctggtttccagtaaatatatttgctcctttcttaaagctcttgcttcccagcctgggcaacatagcaagatccacctctacaaaaataaaaattaaaaaattagccaggcatggtggtgctgtgcctgtagtcccagttactcaggaggctgaggcagtaggatacctccagcccaggagttcaaggctgcaatgagctatgatggcgccactgcactccagcctgggtgacagagcgagaccctgtctccaaaaaaaaacaacaaaaaactcttgcttccatctgacaaaaaattggttccctttgggttggcatttcctttattcagtctttttttaaattattatcaaagacagaaacgttcattcttcatttctgcctcttgctcttcccagtccacttttgccttcattccatctccaaatgtagtaatttttttttttttttttttttgagacagagttttgctctttctgcccaggctggagtgcaatggcgcagtcttggctcactgcaacctccatctcccgggttcaagcagttctcctacctcagcctcccaagtagctggggttacaggcatgtgccaccatacctggctaattttttgtatttttagtagagatggggtttcaccatgttggtcagctggtctcgaacaccagacctcaaatgatccacccgcctcggcctcccaaagtgctgggattacaggcgtgagccaccgcgcctggcccaaatgtagtaattctaattccagaatatgtctcaaatgcatccatttccttgtatcatcatttttccatgcttctcttcttgctcctctctagtccattttccatacaataacaagtaattctttaacatggaaaatggatcacactttaaaaaccttcaatgatttccttatgcacttaacataaaatttgaactccctattcaaggacctacctggaaatggatgatctgactttgccaggctcatctcttcctacttcctcctgccatccccatcaacctcaccttctgcgtgatacctgcactgattttcggttcctcacacaaccaagccttcttccacctctgggttaccacagatgctgttctctgtgtctggaatactattttctatactcatccttcctcagagagacccacctgtaatccaaatttggtgctttctgatacttcatctctagtagcattctgttctttgattgcattcatcatggtatataattatatatgtatttgttttatttgtttaatgtctgcttttcacccacaagtttatattgtccttgagggcgagaactgcacttatatttgattccccactctttgctctgtatctagcccagtgcctggtaggtacaaaatatatatttgttgaaagaatgaatgaaaagtaatgcatgaattgttcctctactgctgaatactacggttgttctcagttttgggtcattctaaataatgatgaagtaaataattaggacataaagatttttatttcctaagggtatgttctcaaaattgaagttgctaggccaaaaagtatttttgaaaagtttttttaaggctcataaaatgtaatttccaagtcacttactcggaattagtgttggaattttaaagtgcctccctttttgctttcttgtttgtttttatagtgtcagagtctcactgtgtcactcaggctggagtgcagtggtataatcatggccttgaactcctgggctgaagtgttcctcccacctcagccttctgagtagctgggactacaggcatgcaccaccatacctggctatttttttttttttttttttttttaatgtagagacgaggtcttgctgtgttgcccaggctggtctcaaacttctggcctcaagtagtcctcccacctctacctcccaaagtgctgggattacaggcatgagccaccacacccagctccttttttcatccttaattttgaatatatgaaacatacaagaggagaacagatcaaataataaaatttagcttcccactctgataaaactcatttatttgaatacttattctttgctacacatgagattatttccttatgtggcagatgttgttgttccaattttatgtatttatttattatttatttttgagacggagtctcgctctgtcgcctaggctggagtacaatggcgtgatcttggctcactgcaacctccacctcccaggttcaagcgattctcctgcctcagcctcctgagtagctggggttacaggtgtgcaccaccatacccagctaattgttgtctttttagtagagacagggtttcgccttgttagccaggctggtctcgaactcctgacctcaggtgatccacccgcctcagcctcccaaagtgctgggattacaggcgtgagccacttcacccggccccaattttacagatgaggaaactggacctagaaattttaacagatgtgctcaagttcatacaaacacagactatctcatgtcagatcattgtgtgataacctccctgcactaactaatctacatttgctccagaactgctgcaaatttaatgtcacctcacccaaatcttctgcttcttaactgctgcatctatatgaatgccctcccacccacccaccagtccttgcttccttgccacatgatgctagaggctggggtgccatgcccccttagatccctaggaagagattaaatcagctggccatccagaaccttcctgtgtggttcactctgagatgcatgtcatctttgtgtggtggtaattagcatgaggataaatggcccattccttcaggtatgtccccattccaatttacaagggtaggcccttttggcccagtatcataacaacaggctgctaaccacatagtaatcatggaaagagcatgctatacttacataacagaaagggcattctgccccctgaggattcttgtgttgttgaactctaaggagcttgtggctgtttcgggggagaggagcattctctgtgttaggctgcaggtattcacctgggcccatgtttttccccccaggaaaaggtagaacatgctaccaggtcagggtttggtgcagcagtttgcatgtttgatgtttatccctgctaataattcctctaatttctcttaacctttcaggctctccctgcatgtcctatccaggccacctgtgaggctgcttccaaggaggaaaacaaggaaaaaaatcgatatgtaaacatcttgccttgtgagtgtctttagtgtttcttgggatgtaacctgaaattacatctctggagggattttctgaagatggaaagaatcttgcaattgggcacagcagggtgaataacaagagtgcgttcatggcagtactcagtggctcatacctgtaatcccagaactttggaaggccaaggtgggagaatctcttgagcccaggagtttgaaactagcctgggcaatatagtgagacctcatctctacaaaaaccttaaaaaattagccaggcatggtggtgtgtgtctgtcgtcccagctactcaggaggctgaggtaggaggatcccttgagcccaggggggcagaggttgcagtgacccaagatcgtgtcactgcattctagcctgggtgacagggcaagaccgtgtctcaaaaaaataaagtaaaagaaatgaaataaataataataaataagataaataaataagagtaggttgaagactttgggctgaaagagcctttatggatcccacatactcagagtcaattaggatgatccaggaggatttttgtgtcaggcctaaagtttctaggaggtcctggagaacagcttcactaggatcaggcaggaagcagggggtaatggtggtggtagagatggttttttgtggtattcattgaaagaaattctaatgcagagttctctgtataaacccttcccagagttagccattgctaatcagttgatccataagctaacagacatttttctagtccattggtatccagaatgggatatgcataatttaatgagatatgagaggaagatgtttgaacctcacttgatttttatatttgcttttcaaaaaaaaaaaattcctaatcctcagaacctgtgaaaatgttttttttttaattttttgtagagatggtcttgctgtgttgccttggctgatctcaaactcctggcctcaaacagtcctcctgctttggtctcccaagtgttgggattacaagcatgagccagtgagcccagccagtatatttgccttttaaaaattcatccttttaaattttttatttcatttatttttttagagacagggccacccaagctggggtgcaatgatgtgatcatagatatgtatcctcgaattcctgggctcaagtaatcctcctgccacagcctgctgagtaactagaactacaggtgcatctaccatgcctggctgattattttttagacacagggtcttgctgtgttacccagcctggtctcaaactcttggcctcaagcagtcctcccactttgacctcccaaagaattgggattacgtgcatgagccaccacatctagaccctaaaaattttatatttcagggtatatcatacattagcatatgtgcataatttatcaataaatgagcatgtattagagatgcctgctcacatttttataagtgaagtatggaaccaaaaaattaggaccactacactatgcatttacagatacttttgtctttttcttttttctttctcgctctgtcacccaggctggagtgcagtggcacgatcttggctcactgcaggctctacctcctgggttcaagccattttcctgcttcagcctcccaagtagctgggactacctataggcacatgccaccacacccagctaattttgtatttttagtagagacggagtttcaccatgttggccaggctggtctggaactcctgacctcaagtgatgcaccgcctctgcctcctgaagtgctaggattataggcgtgacccaccatgctcggccttgtcttcttatttatgtgcacatgttggaggagggggatgtgtgtatgtgtgtgggtgtgggtatgtgtatatataatacatattttttaatatgattggtatactgtacacatttctctcttttaatagtatatattgtcagttcatctgtcaagaaactttcttttttctcaactacttagtattccacattgtagatgcatcttaatttatttaactagtcccctaatgatacttaaggtattcccaattttttgctgttatactgttggagttatattgttggagtggcatctttatacaagcgtgagtctgtgcacataggcacagatgtctcaactgtcctggttgcgtcaggttctgtgagaaataaattttgattttactgaaatattgttggtttgtttcctagatgaccactctagagtccacctgacaccggttgaaggggttccagattctgattacatcaatgcttcattcatcaacgtaaggatcgggtgctttccctgtcacttccctgcctgaccattgccactatctgttggctcctccccagctgtgtgttaggagaaatatttgtcatttcatgttttccctgacaagtctggtttttttaagtgactgaatttttttttaaggtcagtcaaatagttttaatcattttctatatttaccctgtcgtcattccctatggtttcccatgtagaaatctgtgtctaaatatgtattttgtgataagagtcagtgaatcctttattgagctgattctaattacaaacaaaagcaggccttgccctcaacagtaaaaataagggagaacaggacaagaatacctgacatgacaccagctatattatatatgtgtgtgtatgtatatatgtgtgtgtgtgtgtctgtgtgtgtgtatatatatatatatatgactatctggttagccatatatgaaccaaggcctgagggaagagctgatactaagaggaggtttttaaagatgatttagagaatgtttatagaacagtctgtatgagagatttgaggtttttgtttggttggttttgtctttggcagtagcctgaaaaaacacataaagagttaagaatatgttttataggtttgggggaagcatcctgtagagagagtgaatttgaacagaaaaaagagagagggaaagctggcaaaagcaagtctgactcctgatgcaaaatgcatgagaagactggataaaatttccacttgcatgtttatagcagcattaatcctaaaagccaggtgggagcactccaagtgtccattgacggatgagtgaataaattaaatgtggtacatgcatacagtggaatgttattcagcctttaaaaggaaggaaattctaatacatgctacaacatggatgaacctggaagacatcatggtaagtgaaataagccagtcacaaaaggacaaatattgtatgattctacatatagaatataaactatatatacatatgtagagtagtcaaattcacagggacagaaagtagaatagtggttgctgggggagggaggaatgaggagtgggtacagagtttcatctggggaagatgaaaaagttctgtagacggatggtggtgatggttgcacgacagcgtgaatatacttaatgctacagaactgtacacttaaaatggctaaaatcagccgggcacggtggcacacctgtaatctcagcactttgggaggccaaggcggtggatcacttgaggtcagaagtttgagaccagcctgaccaagatggtgaaacctcatctctactaaaaaaaaaaaaaaaacaaaaaaaaaaaaaacaacttagccgggcgtggtggcaggcgcctgtaatcccagctacttgggagattgaggcagagaattgcttgaacccgggaggcggaggttgcagtgagccgagatggcgccactgcactccagcctgggcgacagggtgagactgtctcaaaaaaaaagaagagtcaaaatggctaaaatcgtaaattttatgttgtattttaccacaagaaaaaaaaaggacactgatggagagattagtgtgaacataagaagggctgtttcttcctctgagagtgaagataaaggagaggacagaatggatagagacgactcgtaggtgtgggtaaagcaagttgaggcaactcacccgtgtgctcatggttgtgtactgaacaaatgagatgggactgtgacatgagagcttcgaaagtttagaacagcttctgaggtccctgagaaaaggataccaaagagagaaagcaaaggacatgtctagtgggatgtcattgatgggggtggggggtgctgagttgtgtgattttttttttcttcatctgcaccctgggattggtggtaaatgcagaggacatgtggtactcagacaaaagggaaggtcagtggctgcttcaagtagtcagccaagggcttcagtttcagtagaaaagaaaagcgttaggaagttgttaggaataaacaactattcctaaggtggtaggattgaggaactggagatcttgagaaagtgaaagaacaggaggttgtgtccaaaaaataggctattagatggacttcaaaaatggggcagtccgggcattctcactggagtgaatttgctgaagttcctgtatgtatgtttaacattaatggttacatgtttgtagttttaaggaaagggaccctgactagacaaataattgttgtagtcgataaggaaaatggagaaaggctagtaatcagcaggaattcctagaacttacatcgaagatcatgatgaagagattaggtggaataggttgactttaatgttatgcagaagagaagagcaagatcagttagtgtgtccagctgcgggtaagagaatactcaactaaaagttgtctagatgggaacattttttttttttctggagacagtctcaccccgacacccaggctggattgcactggtacgatcttggcttactacgacctctgcctcccgggctcaagcgattctcatgccttagcctccctagtagccaggattacagacatgtgccaccatgcccagctaattttttgtatttttagtagagacggtgttttgctatgctggccaggctggtcttgaactctgagcctcaagtgatccacctgcctctgcctcccaaagtgctgggattacaggcgtgagccaccgtgcccagctggaacatttatttgtctcatatactgtgaaagcaaatggagaccagttcttgagttggctgattccatgggtcagtgacatacttacaaaaccaggtgcttccatctttctactcagttatccttagccctgtcaacagtctcatggccacaagatggctgcagcagtcccaagcattcctcataaacacagcatccagccgggtgcggtggctcacgcctgtaatcccagcactttgggaggccgaggcgggcggatcacaaggtcaggagatcgagaccatcctggctaacacggtgaaaccccgtctctactaaaaatacaaaaaattagtcgggcgtggtggcgggcacctgtagtcccagctacttgggaggctgaggcaggagaacggcgtgaacctgggaggcggagcttgcagtgagccgagatcacgccaccgcactccagcctgggcgacagagcgagactctgtctcaaaaaaaataaataaataaaaaataaaaaaaataaacacagcatccagcacagaagaggaacatatctgcctatgcttttctctctgttagggagcaaggcttttcacggaatcctccccaccaccctgtcctcaggaccagcaggccaggattggatcacatgttcacatccctctctaatcactggctaggacattgagaatgatcatgatttacccctctgagcctggggaatgggcaccttccaagccagtgaaaggttaatgtccaaacaaaattgtggctctaatggcaaagaagaaagggaggaatggatttgagttagtaaccagcagcatctgccaccgtaaccagtttggtcccttcccacattgaaggtgaaaactgacaaaagttaattgtatgttaaggctgttaagcagctgagatggggatctcttcatggtaatggcacagtagaaagaaacagccttatcccttgaccatgtttatttagagcttacactagggcattccataatgccttgatggttattagacagttattagtaggcagagtttacatgaagagggttaaatgggggaccttatgaactcagtgaaggaacaaaagcagggaaaaacctgtggttaaccataagtgggaagcagggattaaagatttggatttcacagtttattaaactcagtcaacattttttgagcacctgctgtgtgccaagcactgtgggtaggcttaaaggttacagaggtaagatgtaatccctcatatactacacaggtagttaggttgtttcctgtaatgtgctacgtgtgcaaaggaggtattgccaggttctgtggagttatgagaaaaaacattcagcccagcctggtaacccagtagagctcattattgaagagtgagtcagagttcaggagaagaaagttgggcagaaacttcaaagcaaaggagaaacatgagcaaagtcacagagactagaaacagcagtcttaggttataaggtataagatgggaagtggtgggaaatgagacttgatcttgaaaggtagtggatgtcaagtgtgtccattggagttcttacttgcagactatagagtgtacttttcatccactcttttaagcagaaaggggtttattataagatactgggtaccttaacaaaacctggggaagagccagtgagccaagctcagatgctgctcagcaaagagcagagcagctatagatctatgcagcatgtgactgtcatagtgaaacctctgcacagtgctgcagaagaactggatgcttctactaccgtgcttgcccaaagaccagatttctagcacagtcgttatctcatgttgctcatttctaccccaagtcttgtgtgggagcatctgctaggaagaagctaggtctcgtggattgctgagctgctagggagtctgggaaatgtagctgtaagatagtcaagctagaagggagcaggagtgggtactaagtgaaccacctaatagtgtctgccagttttcagtacagctgagcggttttgatgaatttatctaggccgtggggtaccattgaaaagtgttcaaggcagggagtagtgtgaccacatttacatattgatcactggggctatcatgtacaacatggatttaggaggggccaattgggggctattgcaatagcaggtagatcacaaatgatgagggttgacaaggaagcggcgacaaagtgaaaactacgtggaggtagaatttagcaggaattggtggttgatttatatatgagagagtagagggtgatatatccatgtagatgtatccagcatacagttggtcatatctagagctgtggacttggaagtaataaaggagtgggccaagaacagagcccttgggcccacagcccctgccaggcacattgaacaggtgctcatgggtgagatggaaggagaccaagagaagagagcatctgagaaggcaaagataaagcatggctcaggaagtgtttggcagtgaagagggttatgtgcagattagagatcagtgggaaagaggaacagattttctttggacttagtgtgtagggcagcatcctttgctgaagcaaattcagaggccgtttgttgcatcctttttgtgggctgctagttaacacttatcaaaccctttttttcccctaacattgaggtataatatatataacataaaattcacccattttaagtgagaattcagtgattttttggtaagtttaccaagttatgcagccatcaccataaatgtcttagaacattttctaacaactttattgagatgtaattcaaataccatgtatttcacccagagtttacaattcagtgtttttttaagtatattcacatataactgcagcccatcaccaattttagaacattgtcatcccctcaaaagaagaaccttacactctagctgttgcccccttagttttagaacacattgctcaccccaaaaagaacctcagtgtctaaatacaattaatctccattctcaccccccggccatcacttaactttttgcgtagagaactgagaccacacacatggatcttgaagggaactaggcaccatggagtagtggtgaaaggcctaggaaagtggggtctgtagtttgggaaacacataggtcagctaacctaacactgttcacaggaggagatgaaacagaggcagtggcacagttggcaggtgggcttccagcctagagccttaggagaaaccagtttccttactcatttttagatgtctaagaatatataggatttttttttttttttgagacggaatttcactcttgttgcccaggctggagtgcaatggcgcgatctcactacaacctctgcatccggggttcaagcaattctcctgcctcagcctcccaagtagctgagattacaggcatgcaccaccacacctgctaattttgtatttttagtagagatggggtttctccatgttggtcatgctggcctcaaactccctacctcaggtgatctgcccacctcggcctcccaaagtgttgggattagaggcatgagccaccgcgcccagcctagaatatataggatctttagacgtgtttctttttagaggtaggaatgtagctaccacctagagcccactgagattcagctttcagaatctagagacatctcaggagccagggagccacatttcatctttcccttgaacagaacacaagatcagtggctttgcttcattctcattactctgtattagttaagcagtgccgccacatcactgtacaagcatgttttcaggaaggcatatgacgcactcctggtaagatggggcaggaagcactttggggctgggccttccaaccaggtgttcaggctgttcagggcccgcatgctgcaatgagaatttagcagtgactcctcatggagcaggaatatgatgcgcttaacgtattcttaaggacttctcagttttaattataagtttagtaatataagcagaatttaacatccagaattaaggctatttccatttccattctctaataaataaaaacatttgttgaaacttaaattgctcttctcaatgaaaactttaacaagtcttttgttgctgactaaacatatccatctctgaggcctaaagctttctccttctgtgttgggcagcaaccctgccctgcccttgtttgaactgaaattgaaagtggctcctcagaccaggcacggtggctcacacctgtaatcccagtactttgggaggccaaggtgggcggatcatctgagttcaggaattcgagagcagcgtggccaacatggtgaaaccccatctctaatttttgtaaaaatacaaaaattagccggccgtgatggctcatgcttgtgatcccagctccttgggaagctgaggcaggagaatcacttgaacccgggagcagaaggttgccgtgagccaagatcgcaccactgcactccagcctgggtgacagagcaagactccgtctcaaaaaaaaaaagaaagtggctcctcagatttaggccacttcttatatttggccactgccttgcagccttgtagttcacattgccaccctggtgttggtgtgacatggtgtcccatccctgaagctgcctcccttgttactcaccttattgctgtctgagaaaggaaatgggtgattcacaatccttaaatcaagtggctttctcttacctagaacttctgaattgaacatacatttaaacaatgacgttgaaaagatgtataactggagcaataaagactgaaaaagaaagctgcggccagttgttagtttttccgaggctccttatctgttgagtggcaccccaggctcccttgctcttgtcccccactgcctgtgatagagaagcctcttgttaaacactgggagctacttcaccacactcacaggctattcccagaaagattttgcacctgggtaaagcatccttgagaaaataacctgttttctttcccagagtgaacccagcttcatccctggaaccaccacatatgcttttcccctggtgggttcttaacctgttaacactgaaatctacattgttagctgctgataaagcatcagaaacatggtctaatctgggagtcagtatttggatttcttttttctttctttctttttcttttttttttttttttggagatggagtcttgctctgtcaccaaggctggagtgcagtggcgcaatcttggcttggctcagtgcaacctccacctcccaggttcaagcaattctcttgccttagccaccctagtagctggaattacaggagtgcaccaccacgcccggctaatttttgtattttagtagagatggggtttcaccatgttggccccatgctctcacactcttgaccttagatgatccgcccaccttggcctctcaaagttctgggattacaggtgtgagctaccacgcctggcctggatttcttattctagtatttattaataattcaatttgagaagactacctagactatttgagttttgtaatctctaattcctagctctaaagctaatcccttgtgaatatctagactggaaatccccgttaagtacctgcacattttcaggttttgttaactggttggagtcagactggagaatttcatttctattcatttttggttttctctttctttttctttccttccccacaccccagggctaccaagaaaagaacaaattcattgctgcacaaggtaaagtaatgacaacttttttctgttagatttaaccatgatcacataatgggtttggtttttttctcccaaatgctgagtggattaaccagaatgctgtagcttttctgtactttttaccacctgaaagaattataatccattatacaggtttacagctaacagccttcatcttgatgacttagtatccagggatccattaaaagaagtctttttgtgtatgtatattaaaaagactggaaaaggctgtatacacaaaacacagtctaataaggccctctgtccttggggctagttaaccttaggttccagccaggctgctcagagtttgaattaggaatcagtttccagagaggatcagccacctcacagggtccaggctggttctcccccagctcatgggcctgagcctcaccattattcacagatagttggtctaggaaccctcagatcagggacccagcaccatgtcctttatgtgttctacacacatttccaggcctgctgttctaacaactgtcttcactctttgaaccctagcaaaaatatctggatgtttgcagcattaaaaagtaattgaggccgggcagggtggctcatgcctgtaatcctaacactttgggaggccaagacaggaggatcgtttgagcccaggagttcaagatcagcctgggcaacatagtgaaaccccgtctctactaaaaattagccaggcgtggtggcacacacctgtgatcccagctacttgggaggctgaggcacaagaatcacatgaacccgggagccagaggttgcagtgagctgagattgcactactgtactccagcctgggtgacagagtgagactttgtctcaagaaaaagagtcattagggactacaagatttataaaaacaaagttctcctcccttttcttttcacttttttagtctaatgcccctggggcaaccatttttatctattggcttcttatgatagatgacatcatctgatccccttacagagcacctccccctcagtcagacagacgtgtacccacatatcctccccattctcccagaagagtcaaatcacaatttggggttaaggtatttattattattatgagtttacaaatattcacagccgaaacacacagtattatgttattttttgtatagtttttttcccccttcttttttagtcattgtgttttttatatacctactactgattttcctcccaaactctttaccagaagtatatatcttctctcagtacctttagatacatgaggtttaatttttttatcttgggatccttctagaatcttctttcttcagttgcattgtggattggttgctctctatcctctggcagagttatcattctaagaccagtaccctgggaattccgttagcctctctgctgtgttggatctcatttattttcctctgtttgcctctcatttttgtttagaattttctagtgactttccgaaaaaggttatatgggaggtaaattttgaattctagcctgaacaagtcatccaacctttctggggctgatgacacccacctcagagcataataggaaggagtaaatgccatatgaagcacttagctcactgtcaggtccataatgtaggtattctgtgagcagtcatgatttctaattcccaactgtaatatccttgggagacatcattcgtgttctgtttatatttttgacagccttccacccagccccatccttgtgcagtgcctggcacatacatggtagaaacatggaaaatactcaattagtaacggggtggatggatacatgggttagatatttagctggggacatttgggcacaagcttccaaaagtcaggaatggatgttcccagcctcccagcatctttcttcttggtgtatattctcttcatttttgctgttggctactttaggaccaaaagaagaaacggtgaatgatttctggcggatgatctgggaacaaaacacagccaccatcgtcatggttaccaacctgaaggagagaaaggaggtaagtggaaaaattggatgtgaacagcagaaggatcactctgcatataagctctgagtttaagcctggctgtctatcctttgtgggtgctgtaccagtagttcatccagaaagacacaggctgaagtctatcagactttgctatggcctggaagccccagatatgaacctcaggtgtgtgcctagagcacattccctgtatttggtagtcaaacaactcaccctggttccagaacagcctgaaagagactgacttgggccatcagctaaggaaaagccacagaggggttttttttgttgttgttttgttttgttttgttttgtttttttattgatcattcttgggtgtttctcatagagggggatttggcagggtcacaggacaatagtggagggaaggtcagcagataaacaagtgaacaaaggtctctggttttcctaggcagaggaccctgcggccttctgcagtgtttgtgtccctgggtacttgagattagggagtggtgatgactcttaacgagcctgctgccttcaagcatctgtttaacaaagcacatcttgcaccgcccttaatccattcaaccctgagtggatacagcacatgtttcagagagcacagggttgggggtaaggtcacagatctacaggatcccaaggcagaagattttttcttagtatagaacaaaatgaaaagtctcccatgtctacttctttccacacagacacggcaaccatccgatttctcaatcttttccccacctttcccccctttctattccacaaaaccgccattgtcatcatggcccgttctcaatgagctgctgggcacacctcccagacggggtggtggccgggcagaggggctcctcacttcccagtaggggcggccgggcagaggcgcccctcacctcccggacagggcggctggccgggcggggggctgatccccccacctccctcccggacggggtggctggccgggcagaggggctcctcacttcccagtaggggcggccgggcagaggcgcccctcacctcccggacggggcggctggccgggcagggggctgatcccccaacctccctcccggacagggcagctggccgggcgggggggctgacccccccacctcccggacggggcggctggccgggcagaggggctcctcacttcccagtaggggcggccgggcagaggcgcccctcacctcctggacggggcggctggccgggcggggggctgatcccccaacctccctcccggacggggcggccggccgggcgtggggctgacccccccacctccctcccggacggggcggctggccgggcggggggctgacccccccacctccctcccggacgaggtggctgccgggcagagacgctcctcacttcccagacggggtggctgctgggcggaggggctcctcacttctcagaccgggcggctgctgggcggaggggctcctcacttctcagacggggcggttgccaggcagagggtctcctcacttctcagacggggcggccaggcagagatgctcctcacatcccggacggggcggcagggcagaggtgctccccacatctcagacgatgggcggccgggcagagacgctcctcacttcctagatgggatggcggccgggcagagactctcctcactttccagactgggcagccaggcagaggggctcctcacatcccagacgatgggcggccgggcagagacgctcctcacttcccagacggggtggcggctgggcagaggctgcaatctcggcgctttgggaggccaaagcaggctgctgggaggtggaggttgtagcgagccaagatcacgccactgcactccagcctgggcaccattgagcactgagtgaacgagactccgtctgcaatcccggcacctcgggaggccgaggctggcagatcacttgcggttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtaccgtccagcttcggctcggcatcggagggagaccgtggaaagagagggagagggagaccgtggggagagggagagggagagctgttttgttttgttttttgagacggagtctcgctctgtcgcccaggctgaagggcagtggtgccatctcggctcactgcaagctccgcctcccgggttcacaccattcttctgcctcagcctcccgagtaccacccgccaccacgcccagctaattttttgtgttttttttagtagagacggggtttcactgtgttaggcaggatggtctcgatctcctgacctcgtgatccacccacctcggcctcccaaagtgctgggattataggcgtgagccaccacgcccggcccacagaggagcttttttcccctggtttctctagttccttatttccctggttttctgccccacctgctgaggcctttggtatatcctggatcagcagagggagctttatgaactgagaccctgcaagccaaagggaatttgaggccttggcctaatcctggaggcagcctcctaactgggccttttccttttgtggctaccaagtgcatgcctggcctaaccagctctatcactgggccacagccagagccaattctgggtcctggggtcgagccccagcgaggaatacctatttgttaccgtgtttctcaaggatggcccttgagtcaccttgatcctagggtatcgggtgtcatgatcaacagctccacagtggcatgggaagacagtgctagggctgggctttaggttagtttcctccaaccaaacctcttgctcttggaagctatccaaagctcaggcaacagaaaaagctctaggcctctcatggcaggtttacagtctgcatcagtctaccctggtggccccctcatagcagactgctggttcgaggggttcaaacaggctttctcctagagcatgacctgaaatgttgtgaaagtgcagattttgtaggtaagatggcttcagattcgccctgaaccaagggagtgtgggtgggaaacattgagaagtatggggctagggctgtgtgtaagttaggagactgtgctcaataggatggcggctaaggaacttgagaaaagggcaaatttgaataagtaagtgtgcaactgactgagatagagaagaggtcaaagggccttctgggggactttaatctgggctttgtgggctcttccttccaggccctttgcatctgccatgggcaggaggtctaaggtcagggaatgtatgtctttttctttccagtgcaagtgcgcccagtactggccagaccaaggctgctggacctatgggaatattcgggtgtctgtagaggatgtgactgtcctggtggactacacagtacggaagttctgcatccagcaggtagtgtctcctctgtcctttctcagttcttatgttggatctgctgaccagtaagagggaacaggctggatcatcccgctgtggtcaggagttgctgagtatgcagtatgtgaattctgaaaccagatatccgggctcaggggaacttgtctgtcaaagctaaaggagcagtattttcatgactggtgaaaaattacctgttgagatgaagtctgatcatttagatatgaccaagcactgtggaaagggagcatggggaggcagtgcagtctcctaggtgcttgactcacctttctcctcctttcctactccaaagactcctgacatcaaggatgtgatgggcctgcccctggccctccaggcaaccctggagacctgagcaaaggtcaccttcagccaaggggcagtgtggtactgcgaaaagaggacttagctgggagcactgcattttagttctgaccctgccactgactagttgtgagaccttgtgtctgtggttaactaactcccctgggtacacttacttttccattgtcactgacaaccacagctgtcaccttccctcccctggtactgcccacccttgggtatcagggccaacacacaggatctcctcacttcacaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcaggtcagtgtggcctgacccttgtacccccacccccacatttcgcccccatggccagagcaggggaacagcacaagggccctggctgaggaggctggcacagagtagatgacctactggggcaccagcgcaacagccagagactccaagttctagtgcagggtggagaatatgacttgaggaaggagggtagggcagtcctccaagattaggagttgggagaccctgctatgaagccaaaagactgggtcaagtgctggccatgtatttttgcagccttcggacccttctagctggaggtcaggattcaggacatactggagttgttggctcctggagagccccagctctaccccattcagaattaggatttagaccctgaaggaagagcccctgcctgtgttgcccctccctatctgctcccacaaggcaggctggccatccctataaccccctgctctctggctacagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatgtgagtgatctgtgggtcaggtgagggtggggggttccaggactaaaacatctgcccacattgaggattcactcagtctcacaggttattgtaaatgattactatagagtgtgattgtgggggaaagaaagatagatcacactgttaccgtgtctatgtagaaaaaggaagacacgagaaactccattttgttctgtactaagaaaaattcttctgccttgagatgctgttaatctgtaaccctagccccaaccctgtgctcgcagaaacatgtgctgtattgactcaaggtttaatggatttagggctgtgcaggatgtgctttgttaaaaatgtgtttgcaggcagtatgcttggtaaaagtcatcgccgttctccagtctcaagcacccagggacacaatgcactgcggaaggccgcagggacctctgcccaagaaagcctgggtgttgtccaaagtttctccccactgagatagcctgagatatgccctcgtgggaagggaagggtctgtgctgaggaggattagtgaaagaggaaggcttctttggagttaagataagaggaaggcatctgtctcctgctcgtccctgggaatggaatgtcttggtgtaaaacccgatcgtacattctatttactgagataggagaaaaccgccttatggctggaggtgagatatgctggcggcaatactgctctttactgcactgagatgtttgtgtaaagtcagacataaatctggcctacgtgcacatcaaggcacagcacctttccttaaacttatttatgacacagagtcctttgctcacatgtttttctgctgaccctctgcccaccattaccctatagtcctgccacatccccttagccgagatagtagagatagtgatcaataaatactgagggaactcagagacgagtgctggcgcatgtcctccgtatgctgagcaccggtcccctggcccactgttctttctctatactttgtctctgtgtcttctttctttcctcagtctctcgtcccacctgacgagaaacatccacaggtgtggaggggctagcccctttcatgtgatgaagggctcttataaattatgtattcaaagaaatcgagcacagaggaggttgtggtttcatgcctgggagagtcaggaaggcagatgacaggttactggacttcaaagattagggaacaggcagctgaaagagccagtgcccagagacatgatgaagctcggccacatctgggagcagcagtgagattggctctgcagttggggcatagcaccaggagggaggcagggaccagactatcacgggctttgggtgtctccagtttctgacagccccttcagactattaaatctgcactctcagaatgaacaggaattgagtttgtccttctctccaggcgtccaccacccccaagatagacctggacccttcttcccaagtaaagcacccccacagggactcctgcatttcaagtcccacttcactaaattgggataataagagggagtccttttattcctgctaggatcaaaggagaaatggactggagtgaagtgggggtgggaacaggtgatctggcatgagaactatgttgtatgtaaccaagaacttctgtgtcattcatgtttcagatgcagtatgtcttcatataccaagcccttctggagcattatctctatggagatacagaactggaagtgacctctctagaaacccacctgcagaaaatttacaacaaaatcccagggaccagcaacaatggattagaggaggagtttaaggtgagttggagctggataacctccttcagattgaaggatccttgtaatctggggaacatgggatgcctgactgtgcatttgccaacagtaaatccccttgtgaggcatgccagtggttaaggagatggtcctttcctcgtactctggtaactctcaactcatcctgcacgttggaatcactttggttgtgttagagtagggagaagcaggcaacagtattttaaggcccctagccctccgaggtgattatgatacacagcaagagcagttttttctgtaagagccagataataaatattttaggctttgcagcccacatggtttctatccagctacttagtgctgtctttgtaacacaaaggcagccataaccaataggtaaatataatgagtgtggctgttttataaaactttatttgcaggcagcaggcagcaggccagatttggcctctggaccttagatcactgatagctcctatatgccactagacaatggttctcaacacacctaaggcatatgtcacactgtcatcagtaaaagtgctctcccaggctgggcacagtggctcacgcctgtaatcacagcactttgggaggctgagacaggtggatcatgaggtcaggagttccagaccagcctggccaatatggtgaaaccccgtctctactaaaaatacaaaaagtagccaggcatgatggcacatgcctgtagtcccagctactcaggaggctgaggcgagagaattgcttgaacccggaaggcagaggttgcagtgagccgaaatcatgccactgcactccagcctgggcgacagagcgagactccatctcaaaaaaaaaaaaaaaaaaagtgctttctcagaagcaggagattctgggttggggtggggaggaccacttagagaagttcttctcaaatatagcatgtgcacagatttctttgggatcctgtcaagatgtgggttctgccaggcacggtggctaatgcctgtaatcccagcactttgggaggccaagtcaggcagatcacctgagctcaggagttcaagaccagcctgaccaacacggagaaactctgtctctattaaaaatacaaaattagccaggcatggtggcacatgcctgtaatcccagctacttgggaggctgaggcaggagaatcacttgaacccaggaggcagagattgcagtgagctgagattgtgccactgcactccagcctgggtgacagagcaagactctgtctcaaaaaaaaaaaaaaaaaagatattaggttctgattcagcaggtatgagttagagcttgagattctgcatttctttttttcttttctttttttttgagatggagtttcactcttgtcacccgggctggggtgcaatggcgcgatctcagctcactgcaacctctgcctcccgggttcaagggattcttctgtctcagcctcctaagtagctgggtctacaggcacgtgccactacccccggctaatttttagtagagacagggtttcaccatgttggccatgcgggtctcaaactcctaacctcagttgattgcccaccttggcctcccaaagtgctgggattacaggcatgagccaccacgcccggcttgagattctgcatttctaataaggtgaagccaacgctgctggtgtatgggctacactttgagtagcaaatgtcaagaaggagcctcaatcgggaagggaggatgcaattctgaataagtttttttgaagagccttaggcagcctctgggggtggaactgcagagtggacacactccctcctacgatgctggaatcccttgctccaggatcacaaaattccaagccaggagaatctcaagagagtccacaggagcctggaaggtagcatttcccaaacagtctcttggcttcagggttccagctgaacatatgggaacagaggtcagggccctggtgagaagagcagtatggagccagagtggcctggaggtgcaggccaagggacaggcataatcttgtcaagttcagttactgggatcagtaatgtttcccctccccttcccaattcagaagttaacatcaatcaaaatccagaatgacaagatgcggactggaaaccttccagccaacatgaagaagaaccgtgttttacagatcattccatgtaagagccctcccgccactccaaagccttattgccccatccctcaattccctccaccccttccatttctcaggtactagttaatgattggcgtatagacaagaatcatggcattgcctcttgttgcacccacttaacaacatggcgttgccttttgttgcaccttagtggcttctggaaataacgtaaaagccaaaggctttctccctaatgagctaggaacagacatgtccttgcccagctgggattctgtctgcccagggcctgaggtgggagcaatgcaaggagagggagaggacaaatgatattggctagccataagccgctattcttcttacagatgaattcaacagagtgatcattccagttaagcggggcgaagagaatacagactatgtgaacgcatcctttattgatgtaagtggtgggtgtgacccctgagcccccaacaccccgtggagattcagccagcacttgcagtgcctccctcccatacctgctggggaggatcatgtttgaatcagtcaacaaatagtgaattgatactcacccacccactcaccctgtgcattaggtctgtccagctccatagagcagaaggtgggggaaaacagatggcatgcagtagtataatacctggaagaaaaagttcacagagcagaccacagccaagaggaacctggctgccccctgatctttcccattcctgccctcttcatcctagctctaatccctgttccacttccctgtctcttacagaaagcaaccagcttgtcagatagggtttcgtccttggccacaggggagctctgcatgggctgagtttgcctccgagcagtccccattcccttctagtggtctgtcttctccactagtccctctgtgattaaaccatctcacccttgcaattaacctggcctgtgcagggctaccggcagaaggactcctatatcgccagccagggccctcttctccacacaattgaggacttctggcgaatgatctgggagtggaaatcctgctctatcgtgatgctaacagaactggaggagagaggccaggtgagttcaaaaggtcctgggtggtgagagacagagacagcatgaaaagatgtgtgtgtaaatggggacgttgggaaggcaagaaggtgtttggaccttgtctttgacttatacggtccaaagagtacgtttgcatagtataagtacatacttaaaggtatataaatacatatgcatttccaggattgcccagcccgttggtgtctaagcagtcattagcttctcccaagactagaaaagcaatgtgatctgagcctccatgttattcccagacagctcacacccttgcactttctcctgaatacagtccccctagcctagcctttgcacagtgccccaggcggggggggcaccctctccttcccagtgccccaggcagggcagataggtcaaggttctgaggtggacccaatatgagtgtccctaagaagggattgcctcattgctgactacataaaataaagcagtagaatttgagaaattatacaaacaagaaacttacagtctaatattcagtaataaggaaatcttttaaagaaaaaagccctcaggtctattaaaaagcagagctgtccggaaactcatactaaaaagggacactagcagtcccctaggtcaacttcctctcagtataggaaacctcctaatattgttcctgagtcagaatcatacagcctctactaagcacattcaatctcagggatatctccctcaccccccacattatggggggacccagtctgtgttctgacaatgcttattcttttaaaaattatttctgttgaggttgcacattgcagcaaatgagcggttcactatgtctggggtgtcacttagcagggatgagaatctagagaatgggcctggagagaagctagcaaggcctggtgagaaaattccttctaagccacagtgaagagtttggtcttcctaaagcaattgaagagcccttgacaacatcccatttgtgttttttaaaaaatccctctggcagcagtgagaaggactcattagaaatgcgaaagctgtggcagtaatgctggtggcctggactcgggtggtgagagggtgctgtcccagaaagggtgaagtgaggaggaattaaggatggcacccactcatgactcattgaatttatagtcaaacatttaaaatacaaagtatgttttacattagttgtctcaagtcactagttgttccccatctgtacttgtgttaactttggtacaaggctttacacatattttctcaccctgatgtttcattacatcaggattttttttttttttttggttttgtttgtttgtttgtttgtttgagagagggtctcactttgtcacccaggctggagtgcagtggcacgatcttggctcactgcagcctcaacctcccaggttcaagtgatcctcccacatagccctccaagtagctaggactaaaggcacgtgccaccatgcccagctagtttttgtatttttttgtagagacagggtttcaccatgttgcccaggctggtcttgaactcctgggctcaattgatccacccacctggttgacccaaagtgctaggattacaggtttgaaccaccttgcccggcatttttttcaattttgatcagtcatttaactcattagctattcttcctagacttgtatcatgtacctaatcaacagacatactttgtaggtcttcatcatcttttttttttttttttttgagacggagtctctgtcacccaggctggagtgcagtggcacaatatgggctcattgcaacctctgcctcccaggttctggcaattctcctgccacagcctccctagtaactgggattaaagacacccaccatcatgcctggctaatttttgtaggcacggggtttcaccatgttggccaggcttgtctcaaactcctgacctcaggttatctgcctgactcagcctcccaaagtgctgggattacaggcgtgagccactgcgcccagtgtcttcatcatcattaataacaatactgatgaggtgggaggttcggttaaggtgcttggctttgcactcaaggaagcacacacctgagtaacaaaagctgtttaggaaatgagccactgtgttctcaggagctaggtgcctgttcctgccgtctctgatcagtcgtgatggaacctgcagatcagaccagggccctacctgtggttccttctgcacccctgcccttcagatctgtgatgggcaggaccaaagagcaggccgaagagctggaaccacgagcacaaggaccatctcggcccactgccctgtgataaaatgtggcccagtgaacatctccgcctctgtccagtcagatgcaggctcttccatccttgaaaaggacctagtgagagtaaagggcagggggcaggaagcatttcatgtgtgtggcggtggggagaagagtcgtgcgcacacaaattctgctgcctgttgagtgaggcctctccctctgccttccactgtagcttatgctctgtcttcctaggccagtgaagcagacagtagtgcttgccctcaaaagcttctgagtggattggaacaggatgttagtgatgttctttacaaggcctcactggcccccaagttcactttctgttccattcatgttgtcaagtgtagctcccagaagtaattaacgcactaagcctaaatgatgcaatgaaaggtgcctacacttatacagtgacactaccatcctcacctacaatattaagttcccagagaaaaaaattcgatcccataatataaattctgtacttacaaattaaaatctcgaaggaattaaaaatttttaattatctccctctgctttttttttttttttttttttttttttgagatggagtctcactctgtccaccagactggagtgcagtggcacaatctcagctcgctgcaacctccacctccagggttcaagtgattctcccacctcagcctcccgagtagctgggattacaggcatgcactaccatgcccagctaatttccatagtagagacagggtttcgtcatgttggccatgctggtctcaaactcctgaccccaagtgatccgcccgccttagcctcccagagtgctaagattacaggcatgagccattgcgcctggcctccttctgctctattttaatcaaaagggtccaccaggatgcctgggttccctcagcagctgcagcttggaccatcatcagcctgggcagacagagcagtgccaggaactcccatgctgggtcaaccctaggcctagcccaaccctaggcctcatcctgcttctctaaagcatagtgaaacctgatagcattagtcttcacaaagctgtgtgtccccatcaccatgtccgccttagacctcataagagacataagacataagagacttcatgctatctggtggaaagacaaagtaggagaaaagacagaaaaccttccctgtttcacttctttaagatgctattatctagaggccgtaacgtgaacacacaaatctgagatgaaactccagtccccagcttttcttctactggtcttgaatccccattccccatcttctgtccctcacccactgatgactttaacacctggcttactgctccttttgagcccctgttcctgactctgcttttggaggcatcagtcaccatgtggatgatccatctatcctcaatctttctattcctcagcttcctcagccacctgatcccatggtcaagtcaccatctgccctgtatctgcactgcccttggaatctcaacaaggcatccgccctgtttactgcctccttcctcccacctcagtattctcttttattccagtcatttttgtcttcatcaagtccttagagttattgatgcctccactttctcaacatcagtcacaccgaacatgtcctcaccttcctccttactctgtgtgtttttgagttctgtttttgagcgtttgagttttctgatttgagtttttgtggtatgtcattattacctttccttattccctcatgctttcttactttcatagcaaactctctagtaaaacccagttatatgcctctatctgatatagcaaacatcactgggcaaaaacacaaaacagtgccaaatgctctcacactgaactcatgaccacaaatctcatagaggtaattggtgccacctagcaatgctattgctctttcttttcttcctgaaacctccagcatctgctcttgcctgtcccatcatactcacaccttagcttgtgacctggcctcattcttctccaagaaatcagacaagaacactgtcatcctcccacccccaaacaaccagcctcttcaaatctgtaccaactctattctctcttgttacagtggaaaagggtttctgcatctctcaatccacctgtccactgtgctcttggccccattccgtcctgcctgctcagggatgttgctgctataaccatcttctctcccacctccatcagcagttcccctctttaaccactactctcatcagcctatacatgttacatttcctatcttttaaaaacaaaaaatctgctaatctcactttcccttccacctactatcctatttctctgcaccccttcccagcaaaactcctttaaagagttggctttcggccgggcgcggtggctcacgcctgtaatcccagcactttgggaggccaaggtgggcggatcacaaagtcaggagatcgagaccagcctggccaacatggcaaaaccccatctctactaaaaatacaaaaattagctgggcgcgatggtgcatgcctgtgatcccagctactcgggaggctgaggcaggagaatcgtttgaaccagggagctgaaggttgcaatgagccaagatcgcgccactgcattccagcctggtggcagagtgagactccatctcaaaaaaaaaaaaaaaagagttggctttctccctgcaagttctctgttcgctctgttccttccaggcttggccccactgggactgctttagtcaagatcaccagtgactgtcctcttgccaaatccaaaggtcatttctcttttctgatttttttttttttgtccttacagcagcatttgaaagagtcagtacctccctcctcttcctcagaacacttacttccgtagcatcaccccactcactaacctggcagctcctttgttatttctttgtgacctcctcctctaaaacattggagtatactagactcgggcgctagcccactctgttttcttttgacacactagcccttcaggatctcagccagtcctatggctttaagtacaacccatatgccagggatcctcaatctgcgtctctaggccagtcacctgtcccccttcccaatgtgggctcctgatttcctccttcccccgacaccagtccaccccactcttagccatctaaataaatagtaccaccttctgcccagttgctcatgtctaaaatccgggagttaccttccttcctcccctctcctcacccctcacatccagtctgccactgagtcctgatacaggcagagcctccccacttttctccagcgtaactgctgtcatctgaacaagccctcgtctctcactgcttgcccgtgggactgtgggcatgactcatatgcgcagcctcgtctgcagtggcctggcaactggtcctcctgctctcatcctaacccacttttagtttttcaaatggcagctgctggtccttttgaaaatataaatcattgtcactccttgtcttacaaatcctgtttgaggccaggtgcggcagctcacgcctgtaatcccagcactttgggaggccgaggcgggtggatcacctgaggtcgggagttcgagaccagcctgaccaacatggagaaaccccgtctctactaaaaatacaaaattagcgggcatggtgatgcatgcctgtaatctcagctactggggaggctgaggcaggagaatcacttgaacccgggagccggaggttgcagtgagccaagatcgcgccattgcactccagcgtgggcaataagagtgaagctccatctcaaaaaaaaaaaaaaaaaaaatcctctttggtcttccagagatcttgagagaaaatccgcccatgtatacaaaatttagagacttttgatcagatgtggtggctcacgcctgtgtaatcctaccactttgggaggctgaggcaggtggatcacctgaggtcaagagtttgagaccagcctggccgacatggtgaaaccctgtctctactaaaaatacaaaaattagctaggcatggtggcgcacacttgtagtcccagctacttgggagtctggggtgggagaatcacttgaaactgggaggcggaggctgcagtaagtcaagatcatgccactgcactccagcctgggcgacagagcaagactctctcaaaaaagaaaaaaaaaatgagactcttagtgttgatacctagtccctagacttgatatgtatttctgtctgagagatcatgctcaattcctccagcacacacacactgtggctcacacccatggggaccttatggttctgatggttttaaaggcccagtcttcatcccagctgagacactgtgtaaagcagtgttgagaaggcactgtggtagcaaaatccattccacccaccagtgccataaaaactaatataatgcctgatcgaggtgagccttaatgagaatttttttttttttttggctgttctggttgaagagaggcccagggcaccgatccctgaggcatccccagggcttctagagaacatgggtggaaaagcactagtccagggcatgttcttgattcaacactttaataatcatgattttatttggactgtgagactattcacaatttctttttctacttaatttttttccaaatctttcaatgacattatatgtatggttgagaatttttcaattgccagtagtgaagaatctcagatcttacccccaaattctctaaagaaatgggcagcataactgtgtgatgttatatttatgtatttatgccttggcttgttctgcagacattgaacaaattcatttaccagatactgagagcctaccatgtgccaggcattgtgcaaggtgtggggaatacagagatgaaaagagacgcagccactcccacaaggagctgtagagggaagtgagccaggtgcaagcaaagacagacagtagaccacctcctgctcactagcaaggacagaaaggcgagtgctagcaacttgaaggtaccttgcagatcaaagagataaaggtaaaagggagaaaggatactgtggcctgggcggtggtgaagcccatggctgtgtgggaatgtgaattggttctgattttctgaattagcagtctggcggatgtaagcagcattaaatatgaaaacaccccatgggagaaaaagaaaggaattggaacaaagattttcactcgtcctcctctccctgcagccaccaagtattggataccctgtgagcctgtagtcagagtcctttacagaccccggcagtgttttagatggtctctggtgaggatcggaggttaattggaatgatgtgatataatgatcctgcaagttttcaataccttggggacgaagcgtatcagcgtaagaggtggctgtactgagaggggtcaggctgctcgtgggcagtgctgcttctacacatgtggtactctgagctcctcacctctccaacctgtctctccaggagaagtgtgcccagtactggccatctgatggactggtgtcctatggagatattacagtggaactgaagaaggaggaggaatgtgagagctacaccgtccgagacctcctggtcaccaacaccagggtaagatgggtcgtgggtggactctgcccacaggaaaagcagggttacccctgcctccctgatccccttttttccaaaggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcaggtatggctcacccttgccctcagcgggagagagaaagcgaggaggggcagataggggaagctgatgaccatgggtcagactgaagaaagccatacaagagcaagatattggtgagcacatagtagttgagattgatgccaagacaggattggatgctaagagagaggaccttggagcttgaacttggcacaataagtgctaggggactaatgttcagatagtgggcaggagagcagcaggggagactggcagtggagaccccggttgtgctatgaacagagggtgaaagagaagaggagtcaagggtgtctcccaggtttgagcctgggttggtgtgaccagcagaagagagacagtaaagaggtttgtttgaggggaaaagttgaattttgtatggggcatgttgctggaggttacgttttagaaaaaatgcactcctttacttagaatcctaacaacagcttacaaggcccaatatgttctgaggggtccctggccagggccgggagaggatggtgtgcaccatgggctggctctgagcacactcctgccatgggcctgagatgccagtttcccaggcagccacagggctttgcccaagccttccctgagtaccctgccagaactcccactcctcttttctctttccttaccacacatcttcttgtctggggacattgctaaaccccacagtccctgcctcagagtaggcactcagtgtctggtgagtgaatcagctgatgacattgaatagggggatattgtcaaggtcagagtctggattccgtggatttgggaagaaagtgaaagacatggaaaggaatcagcagatacacaccagtgtagggagtggggtttgtcagaaaaagggaaagacaggactagagctagttctaactgagcgaacagcaggtcagaacaacctaggccagcatgtgcaggtggacagcaatggctctgtgctggtggggtgtgagtgaaggtcgtcccccacggtccaacaggtgagtccctccacagcacatggggccatgcaggaagggcacagggtacactgcctcccgacccagaacccctccaggctggtgggtccacagggcaaaggcgagcaccagctgcctgcccccacctcttctgccactcaccactgtcactcacccccttgcacagagggccatcacaggtgtggtaaatgtgtctgctctgttgcagcgccggggcaggaaggacggggaccttctgtgccctgagcaccgtcctggagcgtgtgaaagcagaggggattttggatgtcttccagactgtcaagagcctgcggctacagaggccacacatggtccagacactggtatgctgcccacatatttgtccctgccaccacaccacctgcagcccttctctcagggaggaggctcttcagaggggcccacccagtagtcagaagactgtctaaacacagacctgcccttgccctcccaaggtgccccaaatacacaggaaacattgggaggcaggatggcagcaatgggagcatagcccctgttgccagaggttgggccaggttagaaggggtgtctgggtgccccacagggctcatctgtacttctctgtgggtcttgggtaaggaagatccatgaagagtacctgcctttgggcttgggctccctgttaagaggtctgactttaataagccgcacatccacagaggttttcctgaatcccatggagctagaaatgtttggggggtaaagaaaagtgaatgttaggaggtttgggagacgaggttctgagagccagggtgcatgctagcctggcagccatggtaagcgtgggccatgctcagctgcactgtctcccagcccagcacatgcctgtctgacctctgtggggcctgggtcagctctggtcagctctgcttgtagaaggtctgctgcattcagcccggaaggggaatgctgtcagaactctggcaggcagatcagagctcaggtgaaagttcaaaaacattcagttcctcttgattttccatcttcaacaaaaaaatgagtctgttaggaattacaggtactgtgtgttcttcagtaaccctgactttttccctacctttcactctccaggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctga

SEQ ID NO: 2567 - DNA, 174476 bp, Homo sapiens
ccacgctcaggggagcaggtaccccttctcctaaagatgaagaggagcaaactggcactaagcaaggccatcgagagcggggacactgacctgggtgagggcaaggctggggggcccctgggctaagtgggagcctggctggaattcccactccaccttactctcctgcagtgttcacggtgttgctgcacctgaagaacgagctgaaccgaggagattttttcatgacccttcggaatcagcccatggccctcagtttgtaccgacaggtgtgtgtagtgggcagggttgtggtgtagccttctgagcacttgagttggccttgctgactgattgcctgcctgtggccccagttctgtaagcatcaggagctagagacgctgaaggacctttacaatcaggatgacaatcaccaggaattgggcagcttccacatccgagccagctatgctgcagaagaggtctgagatccatggggcgtgtggggcgtgtggggcatgtgggctggggctgttggtccggttccttcaggaatctaggccttcgtgttgggtgcacactccatctggtcctcactgtgagggagactctgacgtgaggccaggatgggggttagtgtcagaggagctagccatccctctaggacatcagagtggtgcacctagcaggcaaggctgaccctggcgaccctgggcacagggatgggggagaagactgtagcctgggtgaggagggcgagggtcctgcatgctgtgagttcaggccttccttcttgtctttatagcgtattgaggggcgagtagcagctctgcagacagccgccgatgccttctacaaggccaagaatgagtttgcagccaaggtttggcccacctttttccaagagcctcctcgtctcctggtcttccctcctggtccctcatccccatcatgcctcattatccgggtccccaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtaggtgagggcccaggctgcatgtgggtcccaggaccacctgcctctcctgcaacacctccaagcccagctttcctgcaggctctggtggctgaagctgactgccctggcagatttggaagattgggaagagctagagaagttttccaagagcaagaaatcacccattggctacctggtgaggcagggtcctccctccagcccacttccagtgagggtagtcttcgggagagagggctaggcagggagacagataggatggcccgttcatgctcctgttcagctgcccgcatagttagcgagtgcttcctgtatacacatttgtgggcaggcatcatctgctgtgttgggtgcactggaggatgggtccaagtttgcctgcagatgttacggggagagagaatgagctgctttccccagggagggccacagggggcactatgtgctagagggaaagtcttgtctgaggagggtggagggggcacagggagggtgcatatgggaggcagtggagatactgagggctgttttctgtggtgggtagttcagaggtgtatagggcaggtttgagaatgtcaatcacaagagaacacaggaaatgtgagggctggtggcaggaacgcctgttgcaaggggtaatggtgggtggtagagcagaagcgtggaaataattggtctcaagtctctgacagagctttggtttaggtgatttctgccctaagaatgttgagatcacaactgtctgtgcatgggggttgggggattatatgtactgacgggtgtatacatatagaatatatatggacgatgtatgcattgcgcctctgctcgtaagagagaggacaggagggctgtgcattaccttctccctccacccgcttcctctcctccaagccttttgtggagatctgcatgaaacaacataacaaatacgaagccaagaagtatgcttcccgcgtgggtcccgagcagaaggtcaaggctttgcttcttgttgggtgcgtcaactgagggcctgtgggtgctgggtggctgagctgtgggctggtgagaggcagggtttgtgcccttgagcagccccaacaccacctcctctcttgctcaaaccacagcgatgtggctcaggctgcagatgtggccatcgaacaccggaatgaggctgagctgagcctcgtattgtcccactgcacgggagccacagatggggccacagctgacaagattcaacgggccagggcacaagcccagaagaagtgaggagtccatcctgtacatctcaagcaaggggttcctcccctagcacctgggcttggcagaagggccatagttcatccagctcctcccctagagcaatgctgaggagcgggggcatggtagcagggctgtctggttttaaataaagttggaacacttcacagtgcttgtcttacacagtccagcctaagcaaaggcaagctcaagacaggatcctccagacaccacagcaaaactccatgtgttccgttgtgttgggaccggaggtgggggcttctccagccatactcgcaagaaacgtgtcctctccacagttaccaaggaaagctttctctatctcacagctcctaggaagattatagggagagatggcacaaaacttaagcaccagctcaccaagaacatactgtaaagcattctgtgtgtgtgcgtgtaaacacgcaagaaccacgctaaacacttttgctgcctgtacttcctttattcctcgtgacagccctgtgaggtaacatcaccccactttacagaaaggagattgaggaccagggagttcgataataacaaatatgtggcaaaacagggatttgaaaccccgggccaagtgcaagctggaactggaatcgggccctctgtgagaagggagcctgaggcaaggccccaatttgcactgcagtggtgattggaggactaatgagaagtgtgtggcctgcgggccataggggtcagggggtggtggcctttggaactcttgcccactgaactgtggtgagcaattccaagttgtctctgggccaaatagagaaggaggatggaagatttcaattctgccaaaaagaaccatgaacaccagacccgcaatcagtaggagtacccgcggggccctctgctctctctatctagccttccgttggcactccagtgcaccccctctgctctccctgtctagccctccgttggcactccagtgcaccccctctgctctccctgtctagccctccgttggcactccagtgcaccccctctgctctccctatctagccttcccttggcactccagtgcaccttggcttcatgcccagggccccacccaacactgagggcattgccttttcctttgtcgcccccactttgtctacaaggaggaaaccacagccagagggagtgcaggcctcactggagcttcaggcctctccctatttaacacccctagggccgaccatgcttttagaaagacagtgagagactcagggcctgagaaggtatttctttttttccttttcctacctgacttgtaaatgaaagtttgtgaaagtccttcaaggagatataagtcaaatggtaaaataactatcatgctcgccattcattatgtgggtcaagaatttggacaggttgtaacagggatggtttgtgtctgtttcatagtgtctgaggcatcagctggaagactaaaaggttgatagctaggggctgaaatcatgtgaaagcttgctaactcacacacttggtgagtgacgctggttcttcactgggaccttagctggggtggtctgccagaacacctgcaacatggtggctgggtcccaaggacaagcatcccaagagggtgccaggtagaatctggactgccttcctaacctagatttggaagttacgtggtgtcacatctgctagagtatttgtcacagcagtaatacaggcccaccccaccaatttcaaggggaaatagactccacctcttttttttttttttttttttgcgtggtagagatggggtctcgggggtctccttatgttgcccaagctggttttaaactcctgagctcaagcagtcctccctcctcagcatctcaaagtgctggggttacagcatgaaccactgaacctggcctggactccacctcctgatagggagtagcaaagttctggaaatactgtggctaggttttggaatcacaatctggcacagcccatcagctttcccttttggaatcagcagacaagaggaaaggaaataatccccaatgctgggctcatcattctgggcttttttttttttttttttttttttttttttgtccccagtcttggccccacaattcctcactgccctggtagctctttgatgcctttaaaaaatgttttcccagcttttcgagttctcaatgaaaaaggattgctatcaaacaacccagttttcctctctggaaagggaggcttgaccagtgcttttagaatgtacacaatacaaaacccacatctccaaagtaacatacagtatatttactcataggctatgtaaacaaacactgtacatatgaagttttagaaatatgtgagaaataacttttaactgatgacaaatgtatatcaacagtgatttcaactttataaaaggtgtgtgtgcatgtagagaagcattggaattgtctatggggagagttgctttaaaaaggcagttttgtatacttttttgtaaagttaatcactgatttgccccccacctccacagtttattataaaaactttcaaacatacagccaggtagaaataattttacagtgaacatttgtgtaactaccactggattctaccattagcatcttactatatcacacatctgttcatctatccattcctctatgtcaatccatcgtatttttcatatatttcaaagtaagttgcagacatcagtacacctccccctaaatacttcagtatgcatttcaataactagagttcatttttggtttgcaattttttttttcttttcaggcaaaatctacatacattgcaatccacagatcttaaatgtaattttctaagttttgacagatgtataagcctatgaattgtgacatttaaaaaccagaactgggattttcttttttcaaatccttgcttactcaattgaaattagtgtgagatgccttctgccctgagcagtttgtacagcaggcctatgcctacatgggtgggcagggccaagtttcgtccaatgtatgacgctaggattggggctaggaactaggactgtgtagctggaggcaaagaatctgggaacatttcttcttgtatcagtggtagccagtgcagggagaatcagggcaaaggctgggcgcagtggctcatgcctgtaattccagcactttgggaggcttaggtgggtggatcacctggggtcaggagtttgagaccagcctggccaacatggtgaaaccctgtctctagtaaaaatacaaaaaaattagctgggggtggtggcgggtcctgtaatcccagctacttgggaggctgaggcaggagaatcgcttgattgcttgaacccaggaggtggaggttgcagtgagctgaaatggcgccattgcactccagcctgggcaatgagtgaaactctgtcttaaaaatatatatatatatatcgagcaaaggctcctacaactcaccttctcagggtaaggggctgtatgtccagtctcttagatacaaagttccagtgaaagactcttggggttggccaggcgcagtggttcacccctgtaatcccagcattttgggaggctgaggcaggcagatcgcctgaggtcaggagttcaagaccagcctggccaacatggtgaaaccctgtctctactaaaaatacaaaattagccaggcgtggtggcgcatgcctgtaatcccagctactcgggaggctgaggcaggagaatcgcttgaacccgggaggcagaggttgcagtgagccgagatcgtgccattgcactcaagcctgggcaacaagagcaaaaactccgtctcaaaaaaaagaaaaaaaaaactcgggtttgaacagtgtggcctgcaaagggacttggctctcatttacttcacctttctatcttattgccttgctttattttcatttcagcatttaggaaattttcttgttcttttgtttattgtctgtgttcctatccagaatgtaagctcctgagagcagaggcctcttctgtcctcttctgtcttattccctgctgtgtccagcacatggtctgcactcaataagtatttgttgcgagaatgactcattgttccatttactagaaggggaaaggaggccccgagaggggaaatgacttgcctaaagaaacaggagtcctttccccccatcctccagctctcctgatcctctcctttgctcataaaccctgtgactgttggggcacctgtggggtggctgcgaaatgcctacctgtaggtatgtgctcctgtgggttgggactaatgcaggactaggagtaggagggctctgcagtcccccatttgggtaggcttgggcacaggaaactgcctcctttcccttcctcagttctcttctcttccaggataaccctttactctgtgatgatgatgggcgagggagctcaggacactctgggagccaagtaggatggagggctgggcaggtctctacaggcaggcagctgaggagggggctctgtcttcttccaatggaaacagcatctgtgtggttgctgagctgaaccctccttcccagggtctccagggtctgtagttctccttggtctgtagttctgtcacccctgtgcacaccccacaaatgctttgaccatagtgcagctgtctcatggggagagaaagaactttcatttcctgagaatgggttacttgccaagctgaacatgcctaattctcaatacagccctgggaagttccaggaagagttgcagagggaggctcaggtcacccagcacatggtggggctggaaaccccgggctctttgactaccacgcccaacaacaatttttccaagtgtggtcatatccaaaaggggtccttcagataatctcaaagatgaacacttactgcaatcactatttcagttatattaaaaatataagtagcatgtcaaccccttctagggtaatacaaataaaaagtaaaaaaaaactaatcaacaaaaagaaacatattaagaaataatagtgtaaattagatataaggcaaaagtaagctggtggggtttggttctagagcatagggctgctatcccagctactgaggtacctcctgcgtttgcagtcattacttgttaggggttttcacactttgacttcctgcttttcacttttccattcggtgttgcgggatagattgagtttggacttaaggggatatgtgaatgttgggcgtggggaaggatccaccctcactggggtctgagcgttaggagagtaggcgtgtggactctgggcctttgggctggagtgtctattggtcagaggtgtcgggttcggccatttcaccctcacctctaggctggccctgctgagagggagagagagtcacaactcccactcaaggagagacttccctgctggggaggggacggcctgaggcccgccccacccatattcccaggccctggctctggttagcatggactaacttattccacaatacggaggagtggggcacagagtccctaactggcgccccaacagaaggcggtggtggggaccggagatggtaggactggagatggtaggggctgctgatgtgagcccacaatacggaggagtggggcacagagtccctaactggcgccccaacagaaggcggtggtggggaccggagatggtaggactggagatggtgggggctgctgggagccccttttgcgccgcagtgtttcctgccatgaagagttgccgccggtcacaacccttccccgggggcgccccgaatgtgggactccttccggcctggggtgcgtgagggggactcaggggttgcccggtctggaggagagactcgccgccacctaccccgggaaccgcagactctgggtctgggataaagcgtcccctacccgcaagctcggtttgtgcgctactgtgcaatctgtcttttgcctgcagacgcccagccgctcgccctgcgcgggtctcggaatgtccaggggtccctactggggatcacaacccggcgaaatgtcgcatttgccaccacctatctcgactgcgtaatcggctttcagccgcagacgctcaggtcctgcagcacccgcggggatccgtgtaggaacctgctgccgctggatggactgagcgattgcttcgcgggtgtcacgcaccagacgccgtgccgggagcgccgggaagggggtacgcgccccaaccccggccgggggagggcgcactctggctcctctctgcgttttgagcctcccctcccccgccaggcgtatcgcaaaaggcacctccatcgcagagcaccatgtgttgtgcttctactcagctcggtggcgagcggggccccagcatgcgcatctggaaagcgggggagattaccctggagctcgggtggggacggcgtgggctgacttgatataagacgacacccacggagccagatccgttctagggacttggcaggttcctctccctccccagtgagatccgtcgttctttgcagcaattaggggagggaaaaaaaagacccacagtatcacgtttggagagggttaggaagatggctctcgagttgcaggccgccctggtggctagacattggtgtagtttgtgcctggcctcggtttcctgatctgtaaactgggaagaaggcccaagtcatgaggcctgtgactgtagaatggctgaaggcactggtgcactcgcagccggtccttccggggtccagcttcccgaaggactgggcagccccggggcgaacccctctggagctaccaggagaacgtgcgaccgggttcggcgccccagccggcaagtgagcgcccagcggagcgcaagggcggggcccgcgcgggccggagacgcccgttcgctgtcggccaaccagcgcctgtctctgaacagccaatgaacacgcgtcttacagccaaggccgggtcgggagcgaggctgcggcgagtgcggcgctgacagagacgcgcgcgcgcgcgatcgcgctcggaccccggccgctgccgccatcactgtcgcccgcccagtcgcccctcagccgcttcccctcgccatggaggcgaggccgccgccgccgccgcggggctcggagccgcgggccgggcggcggccctgagggctagtggcggcccgaaacgccgccgcggagccgaggcggagccgctgtcctcgtccccagcggtcccgcccaacgcccgactctgtgagtgttcgcggccgctgcgcccgggtgggctccggaagggggagcggctcccgggggcggtgggaggggtcccgggccacagcccagagcccggagcccgaagccctaagccatcttttccgggtagaagcctgcgggcgcctgcaggttgattgtgcatccttgcgggtccgtcgcggggagggggtccccggaaacgtgccggcccgagtgccgacccctcgcgactgcccaggaactttgcatgcgtccttctgggaccaggccagggcactgccagagttgattctcagagaagaaacttagaacggcgagaacagaatttgctcaggtccatttaatgggaggaaagaggaaaactcttggcatgagaaaatttgcttttgcagtgaccaacttttctttcccttcaagtccacctccctcggtcccccggcccgtctcccaggcccctctccttgccgccctctcccaactgttgaggctgtttaagaagggaaataagggctgagagctgcccagaattcagaataggccaattgagaacgcaggtcccctccctttttactttcggtaaataaaaaattttttttgaaaaaattagttactaattatatctcctgaagattaaaaaaaaaaaatagcagagcagagtcctgtcttgagggtttcgtttttatttttgagatcactgatgatatttgtaagacaggaaaagaagaatgtgcaaatccaccctctgcagggtgaacgccatcagaagcctttgctcaggagagggattccggctctagaaccagtccacatcaccctggagatggcttcgtttgccacctgctagctgtgcaggcagcctgagaaacagaagatggtgggcgagaggaggactgactaggaaagggcgaacatcttcctgcctggccactcctttcagaaacagatctgatgctgtcacttgtttacttaaaaactccctcgcttttctttttcccatgggatgaatgaagcctaaaatgccttatcaggtcatacaaagcccttgacaatcttgcctcaatttactcctttacttttagcctaatcggatcctccaattctccttcccctcatcccgcttgctggctagtattcagagctgcttgactgccccctcacatgttgggatgtttttgttttatgtgatcctctttcttccccacctttacctgccaagctccactttttcttttaaagttcttctcatttgagaagcttcttgcgggcaggagctgtgtcttgcccacctttctatctcccgtggtgggagaatcctccaagttgtcttgtagattctttccaatctcttctctcttatgcctaggctctgtttatttcccggtatccacttcccaagagattttttcgtgttttgaaggcctgcttggagtacatgcccaggacttttagtatttctgattcccggcttccccatgtccatcccacccagcccccataagcagtcagcaggtgggaactggtaggtcccatatcccactggcctccaaaaaactgtctctgaaagactaaaagcccttcagtctcttttcacctctgcctgctcaaagtgacctggctgataccgtgcattgtaaggcatggtgggatcccggggcctgttctctgtttagccacttaacatctgggtgaaatacagaaccagaaaaaccacccctctgacttcagtacattcatgtgtcttccctttgccaggtgaattgcttgggatacaaaagtgaggaagtcagtccttaacctttgaggaactcagagtctaatgtaggacaggtggatataaatacatcacaggtgctataagattgtgataataataatagctattttttatttgccttgtgacaagctatgtaatgttttccatgaattccctcagtcttttcaacagtcataaaagggcttattcctactctacagggttggaaactgaggccaaacagtgggcaaatgagggaatagtcaagatttgaattttggccgtgtatttgcagagcctctgccaggctgtgtagggagcatcccctgcctgggtgatttgggaaagctttcctgggacgggggggccttcggatcatgaaggatgcataggagtttgcgcgtggtggactgcacacataggcaagagggagcagcacaagcaaacttggtggtggaaggaatccactgtccttggggaggagggaagaggttaatcatagctggatcaggtaaggacaatggagagctactagaggatttaaaggaggtcagggacttgggctgaaagaattttggaaagatcatttgggggcaatatagggccaaatgcagatgcccctgcaatataggaggcactggttgggtctgacagaggtagagtcacagcctcttagacccagaggaaggtgtagagagaatcctgctcaattttgggaaaagataattaatgcagatgagagaaaaattcaaaagttctagcaatacaaaagagtatatagagaaaaatgtccctcctaccctggccccaagtctcctgtctccctaacctcctccccagagatggctgaagttttcagtttatatggccttccatagacactgttgctttataaatatgtgcctgcttatccatactcctcccaccatgggacgtaccactcacaccttactgggtttttttacttaacatatttaggaaatcattctattatcaacatatatagagagttatttgttctttctgttgacatgcttttacttatttagttgtatggctgtactgtaacatctttgggttaaatatttgtttccaggttcttctcttacagcaatgaatgtccttgtacatactgtgttatgtgctcatttgcaaagttatctgaacaatatgcttttagaagtagaattactgggtcaagggatatgtctgcatttttgatttgcagacatggagccaaactgccacccgtttctggggggttgtaccaatttatcctctcccccaaagtgtatagctggatagatgatctttggagaattcaggaggatcaactacgatgctttttcagctattatatgcctacttttcctccacaaatcctcccccaccctatgcgattctagccagtttctttgaatttacagagggagatgttgaggctcagaaggataaaagtaacttgtgcaggatgatcagtgcgggtggtggtgggtgttttgttttgtatttttgcacccctcatgtttgtatttgccagcacctttcattggaggtgctcagtgtcagtttgtaaacattattgcattatttttctccattttcacatggaaaaaaatgagatgcaggggaagtttgagttatgagagggaaactggccaaatatagaatcttgtcattttacttccagtgcaataataaatgtttccaaatgacaaagctgaagagatgttttttgtttgtttgtttgtttgtttgttttttgagatggagttttgctcttgttgcccaggctggaatgcaatggcgctatcttggctcacgcaacttttgcctcctgggttcaagcgattctcctgcctcagcctcccgagtagctgggattacaggcatgtgtcactgtacctggctaattttgtatttttagtaaagacggggtttctccatgttggtaaggctggtcttgaactcctgacctcaggtgatccgctggtcttggcctcccaaagtcctgggattacaagcatgagccaccgtgcccggtgaagaaatggttttttagtgagtctgagtacaacaaaaatagcaataatataacactaacttaataaaactgaacagcaggcccaaaaatagcccaacattaaaatttattttaatgtattctctatggaaaagagaatccattaaatgtaaaactatttattttactctaaattcacatccatttgtgtcagtgtacaagacataatttttatagtagcagtcagtacatatagaatatgatttttgaattcttcaatagcataaaatattttatatttactcatttaagtatttgttcatttaaaatcacaggctgggtgcggtggctcacgcctgtaatcccagcactttgggaggctgaggcaggtggatcatgaggtcaagagatcaagaccatcctggccaacatggtgaaaccccatctctactaaaaatacaaaaattagctgggtgtggtggcgcgtgcctgtaatcccagctactcgggaggctgaggcatgagaatcacttgaacccaggaggcggaagttgcagtgagccaagatcttgccactgtactccagcctggcgacagagcgagactccgtctcaaaaaaaagaaaaaaaaaatcacagtatagtattccatgcatcgacagctgtagttttttttaaatttgtttttgtttttttgagacagggtctcactctgccaccctggctggagtgcagtggcatgatcacagctcactgcagccttgacctcctgggctaaatgatcttcccatctcagccacctgaatagctgggactgcacaggtctgtgccaccacgaccagctaatttttttattttttgtagagacatttttatgttgcccaggctagtcttgaactcctggactcaagtgatccacccgccttggcctcccaaagtgctgggattacaggtgtgagccaccactctcagccaacagctgtagttggtgcaatcctttttattcttttatttttttctacctttttgctattataaatggtacttttataccccttgttcaaatacttcttttggattatttccttggactcttactcccaacctgggctcaccaagtcagaggatacagtttcggtgcctaattgcaatctggaaaggttgaactagtttccagcactatcagcaatttatggggccatttcttgacaacccatctagtgctattacaaagaaatgtaatgataccttgaattaggtttaatttacattgctttggaaaaagagaccagtagctgatttagattttttgaaagaagtacagtgctgtgatatagattatctccaagatttatgtaactgaagccaacttgtggttgaagaaagatttggttgatgagattgaaatattgtggaagtttagaataggatcatagcagtataaaatataaggctagatgctgttcagttggaaataccaggcattgtgccggaagctggggacaccccagagtaacatagatgtgatgtctgtcctcatgacacttttaggttagtgcagtagacagacattaaaatcacctatggtaattatagatgtgatgaaaggggaagaatagggtgtcgggagtgtcagagaagttcagcagctaaacaacatttgcagttaaacatttgtgaaggccctgagctgagaagggatttggtagctcagggcagcgcttcgctaacttgaatgtgctcatgaaccatctgggaatcttgttaaaatgccaagtcctgaatcagtaggtttggggtgggacttgggattctgtgttactaaccagctcctgggtgaggcagatgctgctggtgggtggatcacacttggtgtagcaaggcctaattgagagcttggtgagcacctaaaactggctgaccatggtgagcaggaaggggcaggtggcttgcagtgacagagtaattctctgcctaggctgcactttagattcacctggggaacttagaaaaatcagggttgcaaatgccccacccgcagccattttaatttaattggtctcagttggggcctgagaatgtgtatacagtcatgcacagtataacgatgtttccatcaaggagagactgcatatgccacagtggtcccataagattataatccataattttactataccttttctatttttagatatgtttaaatacacaaatactcactgtgttagttacttacagtattcagtacagtaacatgctgtacaggtttgtagcctaggagcagtaggctatacaatatagcctagatacgtagcaagctgtaccatctcattttgtgtaagtaccttttatgatgtttgcagaattatgaaatcacatcaggactcatcctcagaatgtgttccattgttaagtgatgcatacctgtatatatattttaactccccaggtgattctaatgtgtagccaggcttgagaactagagactaaggacagtgttgagactagagaatggcaaggagcagagttgagggtcctgtatggcatgcaaggattttggactctatcctgaaggcagagctaaatctttgaaggatttttaagcaggagagtgaactgatctgatttgcaattgttaaaaagttcactgtggctgtagtccagagcagtagttttcaaattgaggtagataagatgatccaggggaactggaagaaaatttagaactttttattgtttttatctaaaagataagataaaacatttaatttaggaattgtctctggcatcttcttgggtctataggtcaaacagttaatgtgttaactgtagaactttgggtgtcctgaaggaagagactgaattctgcagtgagcagagacatatttatacatttgttctccatgtattgcaacatgttgttaacagtttatattaaccagttctcattgaactagcctttacaaaatggacatgcagagaaaccagtgatcaaagaaaatactaataatacaagcacaagcaaacaagttgtcagagctgacacttgtccaactcctgtgatgaattcttggtgagctattcaaataagtcagctcttactaaattggaaagtatcaggaaatttataagaaacatgaactttcgtgctctgtcattaataggaatcttgctttaagattccttttaatcgtatgtagaacccagctgcacggtggctcacacccataatcccactgttttgggagcctgaggtgcaggaggccaggagctcaagacaaacctgggcaacatagcgagaccccatctctaccaaaaataaaaaattagccgtgtggtgtcacgtgcctgtagtcccacttacttgggaggctgaggcagaggattgcttgaacccaggagttcaaggctgcattgagccatgattgcaccactgtactccagcctgggggacagagggagactctgtgtctcaaaaaaaaaaagaggaggaccgggcatagtgggtcacacctgtaatcccagcactttgggaggtcagggtgggtggatcacaaggtcaagagatcgagaccatcctggccaacacagtgaaaccccatctctactaaaaatacaagaattcgccgggcgtggtggcgtgtgcctctgggtaatttcagctactcgggaggctgaggcaggagaatcctctgagcccaggaggcggagtttgcagtgagccgagatctcgccactgcactcaagcctgggtgacagagcaagactctgtctccaaaaaaaaaaaagtatgtaaaaccttgagatattaaataataaaatatgaggctgtcaccagtatgaagacatttgaaaaccaaaaatttggaacataaaaagaacctctacattttttttgcagtgatgtttaaagataaaggatattccatcagatgctttacaaaattttgctaacttcaattattaaaatttatattttgagggttttttgcttttaagagacagggtctcactctgttgcccaggctggagtacagtggcacaatgatagctcactgcagcattgaactcctgggctcaagcgatcttcccaccttggccttccaaagctctgggactacacatgtgaaccaccatgcctggccagtttttaagtttattgttcttataaaagacaaaatggggccgggtgcagtggctcatgcatgtaatcccagcactttgggaggccgaagtggacggatcacttgaggtcaggagtttgaaaccagcctggccaacatggcaaaaccctgtctctactaaaaacacagaaattagccaggtatggtgggcacacctgtagtcccagctactcgggaggctgaggcaggagaatcgcttgaacctgggaggcggagattgcagtgagctgaggttgcgccgctgtactccagcctgggagacagagcgagactgtttcaggggaaaaaaagaaaaaagacaaaaaaacacatacccttggcagattcttcctgccccacccccaaaaggcccacttaaacaaaaaatggactgatgtactacatggaaaataattttgtcaggaaatcaaaatactgttggaagatgtatagaaaacattgctgaatatgtgaacaaacaatattagaacaaattttgcagtgtgggaagtttggtatacggttataaaagtacagaagcttctagcatgtctcagtatcgctagatactcttttttttcttttctttctttctttctttttttttttttgagacagttttgttctgtcacccaggctggagtgcagtggcaccatcatggttcactgcagcattgacctcccagtctcaagtgatcatcctacctcagcctctcaagtagccaggaccacaggcatgcaccaccatacctattttttttattttttatttttaggagagatgaggtctcactatgtttcccaggctggccttgaactcctggctcaagcaatccacctgccaaaagaccttccaaagtgctgggattacaggcatgagccaccgtgccaactgtgccaggcctagattaccttttaatagttacatccaagaataaggaccacttcttttgtgagctactggaagaaagttgtactggagaagacatatttttaatagtaaatgattgccttcataagaacattactatatggaataatagactgaatgtaaattaatggaacagctgctttgactgaacaaaagaatgaaattcattcattacttctctatgggcaggctgttgagtccacttatttgttaattatcttgtggtagagttgttgatgagttttgcatttttcttttttaaaaaaatgccaactttttgttatggtaagtggctacagtttgagtaatcctaatatgaaatccaaaaggcttccaaatccaacactttttttttttttttttttttttgagacaggttctcactctgtatgtagcccaggctggagcgcagtggcatgatcatggctcattgcagccttgacctcctgggctcgggtgatcctcccacctcagcctcctgagtagctgggactacaggcatgcaccaccatgcccagctaattttgcaaccagtaggaataatgcaaatagtacaaaatctgaaaaatacctaaatctgaaacacttctggtcccaagcatttcagataaggaatactcaacctgaacctagcaaatatcatttgaaaaaataatatcttaatctgtctcttcaagtaaaagtattatttaaatagtgagtgaaaaaggaactacttcttttcttagaaagaaatgtgcaggccgggcgcggtggctcacgcctgtaatcccagcactttgggaggccgaggcgggcggatcacgaggtcaggagatcgagaccatcctggctaacacggtgaaaccccgtctccactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaagaaagaaatgtgcaatggtagagcgttttcctcgttggaattttttttacatgtaatcattataagctataacttacatattataaaattctcctttttaaaatgtacagttctgtggttttttgtatatgcatagagttgtgcagcttttgccactgtctagtttaagaacatttcatcaccccaaaagagaccctgcacccattagcctcacttcccattctctcctccctccagtccctggcaactactaatcttcctgtttctttggatttgcctattctggacatttcatataaatgaaatcatacaatatgtgaccttttgtagctggcttcttttacttagcataatgtttctggggttcattcatgttgtatcatgtatcagtacttcattccttcttatggctgaataataatccattatattgatatacgacatttggctaactggttcatcaattgatgaacatttatttgtttctactttttggctttatgaataatgctgctgtgaacattcatgtataaatttttgtgtagtcataggttttaatttctcttgggtatatatatatacctaggagtaggattgctgggttaaacggtgactaactttgaggggctgtcaaactgttttgtaaagtgactacccattcccagtagcaactcacaaaggttccagcagcaatacaataggggtccagtttctcccagcaatgcttaggggtcccaatgtctcccatctttgccaacatttgttactctctttttgattatagccatcttagtgggtgtgaagttgtatctcattgtggtttttatttgcatttccatgatgatttatgatgtgcatcttttcatgtgctgttggccgtttatgtatgttctttggggaaatgtctgttcagatacttggctcattttaaaatttagttattgctctttttattattaagttacttatatatttttagatataagtcccatatcagatatacgatctgtaaatattttttcccatctgtgggttgtgtgttcagctgtttgcgtggacatatccttttgggtagatctaggagtggaactgctgagtcaaatggtaactctctggttttttttgttttttttgtttttttttttttttgagacggagtctcgctctgtcgcccaggctggagtgcagtgacacgattttggctcactgcaagctctgcctcccaggttcatgccattctcctgcctcagcctcccgagtagctgggactacaggcgccccccaccacatccagctaattttttgtatttttagtagagatgggatttcacagtgttagccaggatggtctcgacctcgtgatccgcccgcctcggcctcccaaagtgctgggattacaggcacaagccactgcgcccggtttgaggaaccactgactttgttgaggaacagaaagaacgcctgcacctttttacaatcccagcagcagtgtatgagtgtatcagtttctccatatccttgtcaacacttgttgttttttttaactgtagccatcctagtaggtgtaaagtggtattgcattatgttttaatttgcatttccttaatgactcatgatctgactgtgattttgttgcatctataaaattctcataatttgacacatgaaaaccttagaaacaattttgtaacctaataaaaatctccaaatgtgtttctaaaaacatttccagatgatctaatgaagtaaagaatctaggcattggtcaccagtggctgttaaaaccattagggaactttataataaagggatcagtgtgacaatcttctgatcaatcataacatctctaaaattgggacaaccaaatcttatattctttctatgtgatactaggaagaacatatcattcatgaaatagtcttgcttgccccaacaaacagagtcaaaccttcctctgattagtgtagatctgattactggtttataggatataattggcaaatttagaatgtgaaaaatattataggacaaatgaacccatttacttcaaatgaatggcaagaaaaaaaaagtacacgaactgctacagattaaaaaagacttgaggctgggcgtggtggcccacgcctgtaatcccagcactttgggaggccaaggtgggtggatcatgaggtcaggagttcgagaacagcctgaccaacatggtgaaaccccgtctctactaaaaatacaaaaattagctgggcgtggtggcacgcacctataatcccagctactcgggaggctgaggcaggagaattgcttgaacccaggaggcggaggttgcagtgagatcatgccaccacactccagtgtgggcgacagagcaagactctgtcttggaaaaaataaaaaagacttgaatgaaacatattaattgaacataagtatagatcttgtttagatcctgtttcatgcaaaccaactgtaaaaagttatttatgagcccattgggagtaatttaaatttgaaaaccacttgtatattagatgatttttaaacaattttaattttttaaaggttattatagtagtatggttacattaaaaagaaagactcctttctcttacagataggtactgaagtattttggatgaaatgatgttgatatctggaatttgctttaaaataattcagcatgtttggaggattacagacgagacaagaattgccatacgttgataattattgaagctggataataggtatataagggtttattatagtattttctctactgttgtatatgtttgagaattcccatagtaaaaaattaaaagagaaaccactgtaagggaagagttttagtggatttcatgtccatttgttagaaatagaaaaatgtggccaggcacggtgactcacacctgtaatcccagcactttgggaggccgaggcgggcggatcacctgaggttgggagttcgagaccagcctgaccaacatggagaaacccccgtctctactaaaaaaaaaaaaaaaatacaaaattagcctggcatggtggtgcatacctgtaatcccagctactcgggaggctgaggcaggagacttgctttaacctgggaggtggaggttgccctgagccgagatcgcaccattgtactccagcctgggcaacaagagtgaaactctgtctcaaaaaaaaaaaaggaaaagaaaaaaaagaaaaagaaataaaaaaatgtagtatctttgattaattttcaaaagtatatcacagaagatagatatttgctagccatatttaaaaggaaatatttgtataatgggggtgaaaaaatgattatcacagtttagtaaacacagccatagtgcttcttcctttggattcatgtttctttttggttatgatagcattaaaacttggaatcaggcttttaaattgctctataatatattaaaatgagatttttcaaacataatgagaaatatttaatcatatggattgcactaaaatatttttaagatgggttttacattactattttaattgatggaagtaccattattgtgatcattatgtatttcatttgaaatgttttgtagtatttataggtattagtacctgtgttctgtttataaatgaacatgtgttggggatgtatactcttatttattggtggatgtgcagtaaaaggtttgtttgtggagaacggactgggcagggtatagagacttatttgatgtttattagagcaaatgtggccagtgatgatggtgttctggattggcttagggtgggaggagtggtgatagggatggagatacatggacaagtatgatttaagcagtagaggcattagggttctagatttctggctttttggaagagatgattgctagttaatgaactgagcttttgtgtgtgggaagaagttgaaacctggcccctgtgaattgtgcaagtagttcttaaatattgattgacaaatagcttaacgagcaactaattttcaaatattggttgacaagtggcttattacaatattgtaaatgcattgatactaccattagtaaagagaatgtcttcctttgataatgttagcagcactgttaccagagcagtgtgggatagttccaggactttcactgtctaaaaggaactggaggcccaagcttttacggggatacttctgctctcctggttcccatgtccccagtgatgtgaatgtccctgactcagtgcctctgctcacgctgtctgtgagatcactgccttccagtgcctcttacctcttgggcctgcccactttgttaacagggacagatttcacagtgatttccagccagtatttctctctccccagtttggggtgttagctagaatggtccctcaaagccctcaaacacggatgagaaatagaagaagctcagggagactatacctgggctaggttcttgctaccagctggtggaagacaaagaaaaccccttttcttcctgtatttcatgcccagtgagcagtagtgccatcagcagcagttgtgaacccctaaatcagtgattctcaatatgactgacatggtggggaagacgtaagtttgaaaatgcattttcaggctaggtgtggtggctcacacctgtaatcctagcactttcggaggccaacatgggaggatcacttgagcccaggagttcgagaccagcctgggcaacatagtgagaccctgcttctacagaaaaataaaagctagccaggtgtaatggcatgcacccatagtcctagctacttgggaggctgaggtgggaggattgcttaagcccaggagatcaaggctgcagtgaacataccacagcactccagcctgggcagcagagtgagacccctgtctcaaaaagaaaaagcatttaaaaaaaaaaaaggtttgttagtgtttgtctcaaaattttgcttaatttaaaattatgtatatatttgaataatatgtgtccatgttaatagttctaaaagtatatatagtatatatagtaaaaggtagttttctctccccctgcctttcagctttccctttccataggcatccacaagtactatgagcaatacttgtgaaaccatgctgaaatactacatgctcataaaatgtaagttacttaagtttggtatttcaagtaacaataagggaagataggagagttttatgtttatcaaaaggggtgaatgttatagcagattgagatgagatgttcttacctttgggtgggatcttaagtggagctcaattcggtttccccaatgttagtgggagagattacttaaaccatccatacttatccagttgtacttggtaagttttcaaaggttctactttgaagagggcttttgttgagcaagtagtggttaatagagcagctcagttacatgtgtaagttttttgatgtgggaaaagggcttttgtatacagaaggactattttaaaattatttgggctttaaattaacatgtattaaagtggtaaatttaaaacccagttttcttttagtcttgttattgtacttgtaagcataggcattttgtatagaaataagaatagtaattttcacctgcttgtcaattaagttaatataaatttaacagatttaattgctccaggccccttacttagtgaattaaatttccttagatgtttaaaatacatttacacagtcagtctgtcaggcacagtcagtccttgacaggtcagagttaccaccttaaacagaaacttcttaagctcttgggcaatctgtgatactaagaaattaaatttgtaaatgtagtaaaacaggttttggttaagacttccagtgcttttcattagctgaatctgaattaccaacatttaaaaaacacataccctaaacttaacgcaaaagtactactagtaccatgagtttgatataccatacctcattttattgctcatgtcttttctttctgggattgtgatgccacttacccaattaaggaggacagttttatcatctcagaaagccatggttatcagattaaaaatacagaatcatgatacagttattattggtcagagatttgagactgggaaagggaactaaggggtctgtgtttccaggataattctactcaagagatgctgtgcctttccttatgttaagagtcctgaatgtggcatcaaagggggaatccatgttcagagtttgttttgcaaccccccatacctttttttgagacaggatcttggtaggttgcccatgctggtgtgcagtggtgcaatcatggctcactgcagccttgacctcctgggctcaagtgatcctcccgcctcagcctcctgagtaagtagctgggaccacagatgtacgtcatcatgcccagctaattttttgattttttttttttttttgtagagatgaggcctcactatgagcctaggatgatctcaaattcctggcctcaaacagtcctcccgcctcagcctgcccaagtgctgggattacaggcataagccaccatgcctggccttttcttcaaaaataacccttcaatcaattttttttttcctggtcaaattggattttgtgtttcttttatatattccttgtcaggccctacagttattttaattttgggtgttggatagactagggttcatattccatgcctgccatgctttttgtgaacttgggcaaaatagttagctcttctgagactcacttttgtcacctagtaaatgggttcagctgtagtactctatgtatttgtttgttttaagcattagatagtgcgtggtaaatgcttagcacagttcttagcacatagtaaatctttaataaatgttagaaaatataatgatcttgattctctgtcttccctccctagtagttgatttggggcacagtgtagcattatttgaattatcacagaataactttttacctttctgattttaacaggggagagtgtgtaaaggatgggagagggaagagagaaaaaagctgagtaaatgtgatcaactttacagtctttattccctgaactatctttccctgagttatgtgacacattctccttgttttcctctttctatctttgtggccactcctcagttccctaggcccctcttctttgaccactccttgtttgagttaccaaagattccatctctggccttcttgtgttgattctacacgttcttcctggaagcacatgtccatggtttcagcttccttgctaattaggagaaactttgtcctcagaacccatctggattacagccaacagcctactggtctccattgggctatctcccaggtacctataacagtctcagaactgactcatcttccttttcagcgtgttatttttataatctctatcttgatgaatggcacaacacagtgacccaaactggaaacttgaatgttgttcatctggttggtgatctgttcctaactgttttacatctgtaacatttctcaaatttgcctattttccaccatttctcctatcccttaattcaggctgcttctcacctagatgactgctgcaggttcccttgttgtctactcattattagtttctcattccaagtcattgattagatggctgccaaaagtgatctctttaacttcccaactttagattctgtgaataaaatccaaactccttaacagagcaggccctcatgatccaactcctcttaacgttggtagccttatcttttctctgagcccactgccgcttgatccttggtggtgctgtgctctttcttgctctctgtctttggttggactgcccacctccctccttcttacttgacattataatttatcagatagagatcagctcctccagtcagcatttccttactgactactccaagtctgacccagtgtagattctgtgcttatatctgtcaagtcacttattgtatgataattcatacacttatatgataattcacacattggcatgtgtagattaaacatttatagtctcagaaggatcctgatagtccaaaaggtatagtaatgcagttgtctcttagtatcttcaggtgattgattccaggatcccccccatggagatcaaaatccagggatactcaggtgccttatataaaatggcatatttgcatgtaacctatgcacatcctcctgtgtactttataggccctaaataatctccagattacctatatggctaaaacaatgcaaatactatgtaaatagctgttatactgtatttttaagtttgtttcttattttatggttttatttgtttatttttttgatctgtggatgtgcaacccacagatagagagggtcaactgggccgggcgcggtggctcacacccgtaatcccagcactttgggaggctggggtgggaggattgcctgaggttaggagctcgagaccagcctggccaatatggtgaaaccgtgtctctactaaaaatacaaaaattagccaggcatggtggcaggtgcctgtaatcctagctactctggaggctgaggcaggacaattgcttgaacctgggagttgaaggttgcagtgagccaagatcctgccatagcactccagcctgggcaacagaatgagactctgtctcaaaaaaaaaaaaaaaaaaaaagaagagagggccaactgtatgtaatttactgaagcatggattcacattatagatggtccctgatttatgatggttcaacttatgatttttatactatgatggtgggaaagctggtgtgatatacgtattcagtagaaattgtacttccaattttgaaatttgatcttttcccaggctagtgatatgcagtgtgacaatttctcatggtgctgggcagaagcattgacccacacctcccagtcagccatgtgatcaggagggtaaatgagtatactccatggtgtactgtgttgccaggtgattctgctcaactgtatgctaatgtgagtgttctgaacacatttaaggtaggctaggctaactatggcattcggtaggtaaagtgtgttaaatgcatttcctacttaaacgatattttcagtttatggtgggtatattggaatatagccccattgtagggcaaggagcatctttatttacccagttgagtttagtggcagcagaactaagttcggtttagctgttcagtgagccaagcctcacttagcatctaattctgtctttattttctgctttagataggccacagctctcctgaagggattaagactttctgtgtgaaaaatggtattcagaaggaagccagcattaattctgtttttatacatttatgaagatttgaaggaatttcactgtcaattctgtcttaattgtattctgtataataaatcataatggtatccaacggctcttgaaaggtttggtttttgtgaacatttctttgaatgtcaaagttgtattagtttgtttctcaattaaactgggtgctctttgagggcagggatttatgggacttgtttgttttgcagttttatatctccagctgctaatgcagtgcctggtttgtagtaggaatgagagatttactccaatagaaccatactaaagatcttacacttatggattacagttgatagctttgtagagtgaactggtattccctttaaatgagacgacatgacctgagtataaagtataatcaactacatgactccagcaagaataccatgtgtccctcagatagcatagctggcagatggagttatgcacatcaactggacatttaagacagctggagatttcttacatttagatgacagtttagattagaaatatttaatcttagctgtacttaatatattatgtagctatatgatacatcatgtatatatggtatatcatatatatcatatatttaatcacatttaatccttagctatattttcatccccaaaatggtatatggatctgtttttattgtcagctggttatttattgttgcttatccatggctcatgaaaatcttcatgttacttgggaaatctttcactctgccttttgaaggacagcccagaaccatttccttcttggcacatgaccttctaacccagtgaccaaagagtatgtaaaagcatggtacacactgcttttgaagattacgtgtgtctattctagatgtgtcttatttcttgcagatatattgcctacaaagattttgatatatatatatacagtagactatactatataattaatatttataccagatattaaatatataagcattctactagaactaaagttaagaatttgaaatagtctcatgtgagtaattaaaataacaatagcatctttttcaagaaagttttttttaatatggtggagataatgacatggaaaaaagtagttaattatttttggtattcccgtatttcatcagtaggttgccatagaacataatagttatataatcaaacagcagaataattttatatgaggtttattgatacagaaatgtttggttcagtgtttgtcttccagttttgcagattttcttttcgattttaaaactggagaatacattaaaaccagaaactttcagcctctataatgccctcaaaactcagcaggttttgaaaatgcctcttccttctcttctcctccccataatcctgcttatttttggcattaagtgagtcaggggttccaaacccaaatacgtttttcaaggctatgtagtcagtgtgaatgagagaagtaaatctgttgggtcctgtgccacactggagtttccaaggctggtctaaatgagttcaacttcagtttttttgtgtttttttagagatggagtcttgctgtgttgcttgagctggtcttgaactcccgggctcaagtgatcttccagccttggcctcccaaggtgctagaattataggcatgagccactgtgctggccaatttttttttttttagcccactgtgctaccagtttgtgatcttcactttaactgtgaaaggactgtcaaagattgtacgtataagatttagtttgagagccaggcctggtggctcatgcctgtaatcccagcactttgggaggctgaggcgggtggatcacgaggtcaggagatcaagaccatcttggctaacacggtgaaaccccgtctctactaaaaatacaaataaattggccaggcgtggtgacgggcgcctgtagtcccagctactcgggaggctgagacaggagaatggggtgaacccgggaggcggagcttgcagtgagcagagatcacgtcactgcactccagcctgggcgacagagcgagactccttcacccaaaaaaaaaaaaaaaaagtagtttgtctttctctttgaaactgaattcattaaacaaaagcctaaataactatactattacttgttatttatttatttatttattttagacagagtcttgatctgtcagcaggctggagtgcagtggtataatcttggctcactgcaacctctgcctcccaggttcaagtgattctcgtgcctcagcctcctgagtagttgggactacaggcatgcgtcaccacacccagctaatttttgtatttttggtagagatggggcttcaccatattggccaggctggtctagaactcctgacctcaagtgatccacccacctcagcctcccaaagtgcataagtgctgggattacaggtgtgagccaccacacccagcctactacatattcttttagacccagctgaaatatcacgtaattgctgaaggctcctgaactcttccagatcagggattgattttcctcattttaagattgtcatgacaactgtagtattgataactgtattttattttattttattttttttgagacagagtgttgctctgtcacccaggctggagtgcaatggcacgatcctggctcactgcaaacttagcctcctgcgttcaagcaattctcgtgcctcagcctcccaagtagctgggattacagatgtgcaccaccaaacacctggaattagtctggctaatttttgaagttttagtggagatggggtttccccatcttggccaggctgttctcgaactcctgcctcaagtgatccacctgccttggccttccaaagtgctgggattacaggtgtgagctaccgcacccggcttattaaccaatttttaatgttcagcacaacttgatcatgatgtacaatgtcttttttatgttatgtgttgatggagtcaaattaccgatattttggttcagttttttcaataagagatcaggctattttctgattttcattctgtttttttctttgatctgtatgtatttataagtgtctcttattttcaaataggttttttctagttatctttttgtaacggatttatagattatacattgtggttaaagaatatggtctataggctgggcacggtggctcacacctgtaatcccagcactttgggaggctgaggcagggggatcacttgaggtcatgagttcaagaccagcctggccaacatggtgaaaccctgtctctactaaaaatacaaaaaaaatttagccgggcatggtggtgggtgcctgtaatcccagctactagggaggctgaggcaggagaatcgcttgaacccgggaggtggaggttgcagtgagccgagatagtgccactgcaatccagcctgtgcaacagagggagactccgtctcaaaaacaaaaacaaaaaacaaacgaaaacacacacacgcaaagaatacggcctacatgcactttcagtcctttggaaattgttggtatttatttgccatttggcctagtttacccagattccacaggttgttaatgttgtacaattgcgtcttctctttctcacttcacccatctatgtaatttttctgaatcatttgagaaataagttgcaaacataatgctgtattacccataaatcagggtgtgtttcctgaaaacaaggatactctcctataaaatcaggaaataaatattgatataatactgccatctgattcacagaccctactcaaatttcactgatcttccaattatgtcttttatagcaaaaacaaaacaacagaaaccaacaaaattccctcaagaaaacaaaagcagaaaaacttccctttccccttcacttatttctgattcagggaccattcaggattatgccttgcgtttagttgtcatgtctgttcagtctcttttaatctagaatagttctcagtctttccttattttcagtgatcctaatatttttgaagagtagagaattattttgtagcaagtcccacaatttgggttagtctgatgtttccttttgaatagatttaggttatgcatttgtggcaggaataccaaagacacgatattatgttcttctcactgcatcgtatcaagaggttcatgtcaatttgtccaattactggttatgtttaattttaccacttggttaagatgttggctggcaagtttttgtaaaattagtttagaggtatttcatacttactggttagtaagtaataatgcattttgtggggtgatgctttgagactatataaatagcttatttctcatcaaatttttgcttgctagttttaccatccattggtgatttgtgcctgaatcagttattatagtggttgctagatggtaaatttaaaaaatttcattatttcttctgaattcatcacttggcatttctttttttttttttttttttttgagacggagtctcgctttgtcacccaggctggagtgcaatggcgtgatctcgtctcactgcaacctctgcctcccaggttcacgtgattctgccacctcaccctcccaagtagctggggttacaggcacccgccatcatgccctactaatttttgtatttttagttgagatggggtttcaccatgttggctaggctggtcttgaactcttgacctcagatgatctgcccaccttggcctcccaaagtgctgggatcacaggcttgagccaccgtgcccagccaatcacttgctatttcactctaaggaaaagctttctctctctggtttttgtctttgtttttgtttgtttaaaaatcttttaaacatatgagcacagcctcattgattcttattttgttcctttttcatgtattttttgatattcaaattgtcccaaatttggccagtgggaaccctttcaggctggctcctgtgtcctttttccatgtcctcatcattctttttttttttttttttttttttgagacagagttttgctcttgttgcccaggctggggtgcaatggcgtgctctttgttcactgcaacctccacctcccaggttcaagcgatcctcctgcctcagccacccaagtagctgggattgtaggcacctgccaccacacctggctaatttttctatttttgtttttattttttttattttttgagacggagtcttgctccgtcgcccaggctggagtgcagtggcgcgatctcggctcactgcaagctccgcctctcgggttcacgccattctcctgtctcagcctccaggcatgcgccaccatgcccggctaatttttttgtatttttagtagagacggggtttcactgtgttagccaggatggtctcgatctcctgaccttgtgatccgcccacctcggcctcccaaagtgctgggattacaggcgtgagccaccgcgcctggcaatttttctatttttagtggagacaggatttcaccatgttggtcaggctggtctcgaactcctgacctcaggtgatccgcccgccttggcttcccaaagtgctgagattataggcatgagccaccacgcctggtcatgtccccatcattctttgatcactttttttcttactttttggaataataagattttctgtgggctgggcgaggtggctcacgcctataatcctagcactctgggaggccgaggctggtgggtcacctgaggtctggagttcgagaccagcctggccaacatagtgaaaccttgtctctactaaaaatataaaaattagccgggcatagtggcacacacctgtagtcccagctgctagggaggctgaggcaggagaattgcttgaacccgggaggcggaggttgcagtgagctgagattgcgccactgcactccagcctggatgacagggcgagactccgtctcaaaaaaaaaaaatttctgggctcatctttacttttgttatctcagtcgtggaatcaataattttatcagggaaccctggttccttttattagtgaatgtacttagaaaataaaatatgtgcactactagatatgttctttctattggggtgttcttccttttaggctctatgtgaggagagaactagaatattgttttaaaatgtaccaggtaatcccagcactttggtaggctgaggcaggcaaggctggcagatcacttgagatcaggagttcgagaccagcttggccaacatgatgaaaccccatctctaccaaaaaacacaaaaagtagccaggcgtggtgacacgcacctatagtcctagctagagtgagatagagtgagaccctgacttaaaaaaataaacaaataaataaaatatactggaatttaatttataggtatgaatgacacagagaggccaatattattgaaaatgtgttactcacagttcttctgaaacagcaggcgcaccatactatgcaggaccacatggggaagcaccagggtgggtcaggaggcagaaggaaccagaggaaaggatgggtgagttttttttttgttaaagtgctagaaagttgttaggtgggacatcccctattgagcagaaagagaaacacaaatgttgagatttgtggttggacggtttgtaatatgatttttgtgtagcctcaaaaacacagagatggtatgaatgtaaacaactttggtcgttaatttggcccatcctttcaagatgccaaatcatcaattacagaatatcaagaatgattatataggtatgtatgcatgtctatacatacatatatacatctgtatcttcctgtaaataatgaaagccatggtttcattccaatactcttaattctagtccaacacaatagggtttcttctggtgtttcccttttctgacattgaaaaatctgaggccaggcacagtggctcttgcctgtaatcccagcactttgggaggccaaggcaggtagatcacttaaggtcagttgctcgagaccagcctggccaacatgatgaaaccccatctctactaaaagtacaaaagttagccaggtgttgtagtagtggtcgcctgtaatctcagctactcgggaggctgaggcaggagaatcgtttgaacccaggaggtgggggctgcagtgagctgagatagcgccactgcactctagcctgggcgacagagtgagactccatctcaaaaacaaaacaaaacaaaacgaaaaatctgcctcctttttttttttcattcattcattaattctttagatggggtcttgccctgtcacccaggcggtagcgcagtgacacgattatagctcactgttgcctcaagccatcctctcgcctcagactcctgagtatctgggaccatacaggcacgtgccactgtgcttggctctcacattgtcctttttactcaccttcctgttggtgacaatctcctgactatgtaggccattttcttgcccccagccccactgaatgagctggctgatcactccttcaagttccatgagccattgttacatacaggtagtactcagtttgcttggttttgatattcataaatttccattgctgtggtttaattaaataatgccagtcctcaaatagcagttaatgaaatacaaaatataacctgtgatcaagaaaagcttctcaggtgggcgtggtggctcatgcctgtaatcccagcactttgggaggccggggcgggtggatcacctgaggtcaggagttcgagaccagcctgaccaacatggtgaaaccccatctctactaaaaatacaaaaaattagctgggcgtggtggcaggtgcctgtaatcccagctactttggaggctgaggcaggagaattgcttgaactcaggaggcataggttgcagtgacccaagatcaagccattgcactccagcctgagcaacaagagcgaaactccatctcaaaaaaaaaaaaaaatagcttctccaaaattttaaaaatttaccctgaccctgaaatagttgattgttccctccctagacatcattcagttggagctagcctaattttgttttttttgttttgttttgttttgagatggagtcttgctctgttgcccaggctagagtgcagtggcgcgatctcggctcactgtgacctctgcctcctggttcaagtgattctcctgcctcagcctccagagtagctgggattacaggcgcgcgacaccacacctcgctaatttttgtatttttggtagagacagggtttcaccatcttggccagactggcctcgaactcctgaccttgtgatccacctgcttcggcctcccaaattgctgggattacaggcatgagccaccgcacccagcctttttttttcccttgaggagaattacagtctgcactgctctcagctgaactttacacagcttttacatttccctctgtcagttcctcttgtaatggtgggtgggtagctgaagggaggatatgtacaataatgtatttttagttcctttgaacagagaggttgcttcagccattgctattgatggcaggaagtatatttatagctccagggaaggaggggtagtacgactgctggtttaagaaaacctgggagattgtatttaatatatgttgttaaaactcatttgtactttattgtaagttcttgccttagaaatgcagctgagatgaatgaacctgttacttatgttatattgttacttatgttatatatgttatatgtattattgtaagtatattgactctgctccctaatttggaaaaatcttccgttttgaaattttacaatatacaatacctaaaacaaagagtacttctagagcatacaggatgtatgtggagaattcaggtgttagcatgcaattgaacagtaaagatactgactagcagtataaatatcgtccccatttagatattttattcataaagttcttgttggtgtagcttttattgtgattttttcttttttttttttggatacagagtctcgctctgtcacccaggctagagtgcagtggcgcagtcttagctcactgcaacctctgcctcccaggttcaagtgattctcctgcctcagcctcccgagaacctgggactacaggtgagcattaccacactggctaatttttatatttttagtagagatggggtttcaccatgttggtcaggctggtctcgagctcctgacctcaggtgatgcacttccctcggcctcccaaagtgcagggattacaggtgtgagccactgcgcctggccaattgtgatttttttaaagattgaaaccaaaatattttatacagatcataagatattcttggtaaacactaagcacctcataactttaccacaattttgattgcacaactttcacctgtggttatcatgtgcaatgggcacattcaacacaaatcaaattattctgaagcttgctttctttcttttttccctactccctttcttaattgaggggagcaaaaagttggtttccagggatatgtcttctctcttatgctggtcccagattgatgcagtcatggaaactaggcagtaaactcattcttggcagctgccggcactggtctgattctttcttttaaaagcatgagattctttaataacacatattggaaagattgatgccaagtgattccaggtcatcctagaggaggcttgggaacattgttgaatagatttaaatgattcagttaagtgagtgatttaacccaaggtttgtgtctaatttaaacaggacctataaaatatagaacaattggtttgtttcttttttagaatattgaagattagattttaatttgagaattttactaatttgagggttttattttttgtttttaagcgttcaaaatgttgaattgtagatatgctgagttttataatgagcacaatgaaggtttttcaactggcccgttaaagccaacccactaatgaaatgaaaatatgaaatattatgactccataatatttcatggattttgaagctgggctgcctgggttcaaatcccatctctgctactttttgggtacgtaaccttgtgccagttacttaacctctctgtgcctcagtttcttcatctgcaaaatgggagatagtgcagtttgagtgttcctaatctgaaatctgaaatgctccaaaatctgaaactttttgaatgcctacatgactgctcaaaggaaatgcttattccatggagcatttggatttcggatttttgggttaagaatgctcaattggtaagtaagtgtaatgcaaatattccaacatctttaaaaacctgaaatccaaaccacgtctggttccaagcattttggataagggatactcaacctgtaaataatgtctgtttcatggggttgtgatgtggagtaagtgagcaaagttgtgtaatgtgcctagcttatagggaacacttagcaaatgttggctattccatttatatataagaaatagaattattggctgggtgtagtggctgatgcctgtaatcatagtgctttgggaggctaaggtgggggattgcttaaggctaggagttcaagaccagcctgggcaacatagcaagactctgactctgcaaaaaaattcacaaattagttgggcgcggtggttatatgcctgtagcccttgctactcaggaggctgaagcaggaggatcgcttgagcccaggaatttgaggctgtggtgagccatgataatgccactacactccagcttgggcaatagagtgagaccccaacttaaaaaaaagaaagaattattgatgggattgtaaaggctgaatattaaataaattcagaggaggtttttacggaacttatttgtgaaatatttttaaaggaaggaaggcatgtttgttttaggtttataagagatggcagatttaggaagctcctccctactccagatgaataagccatctgtttttctatcccttttaaggatttgcttggtgggtttccataacttttttttttttgagactggatcttttacccacccaggctggcgggcagtggcgcaatcatggctcactgcaacttcaatctcctgggctccagcagtcctcccgcctcagtctctcttgagtagctaggaccacagacgcgtgccaccatgcccagccaatttttatttatttttttgtgtgtgtggagatagggtctttctatgatgccccggctggtcttgaactcctgggctcaagtgatcttgctttggccttataaagtgctgggattacagttatgagccatggcgcccagtctatgtattcttacaaaattaaattcatgttaagtgctacactagcagaatttttaaaatttttaaatgatgcacaaatagagaagagagagtgcaaattaacgagaaataggcaagactaatttgaagaaaactatgaagctttactgaaggatttttttaaagatataaaatgctggccaggcgcggtggctcatgcctataatcccagcactttgggaggccgaggtgggcggatcgtgaggtcaggagatcgagaccatcctggccaacatggtgaaactccgtctctactaaaatacaaaaaattagccgggcatggtagcggatgcctgcggtcccagctactcgggaggctgagctggaagaatcacttgaacccaggaggcagagttgcagtgagccgagatcacaccactgcattctagcctggctagagagcaagactccgtctcaaaaaaaaaaaaaaaaaaagaataggcaaataactagagaaaaatagtccagaaacagacctgaatatatataggaatttagaatatgaaagtgtcagtgtgtaggaaggagtgaaatgaaaaaagaaagaaaaaaggaatatgttgaaagtggcattcagaaatcagggagaaaatgatcgattactaagaatgatcctgtaacagtgggctgtttggggaaaaatacgtaaagatttctaatttagactatattcaaataatcaccaaattatatagagcagggatacccaacctccaggccacagaccatcctgttaggaactgggccacacagcaggatatgaactttaggccagggaacattacacctgagctctgcctcctgtcagatcagcagcagcattagattttcataggagcacaaaccctactgcgaactgtacactccagggatctaggttgtgtgctccttatgagaatctaatgcctgatgatctgaggtgttgcagcttcatcccaaaatctgaaaccatatcctccacccctccatttcatagaaaaattgtcttccacaaaactggtccctgggtgccaaaaagattggagaccgctgataatagagtatatataatcaaattacagaaataaccacactctattcttcctctagaatatactgaatgtttcctaagaaaagttgaacactcatggctggttggctgctctctagcacatcttgccttcgtctctcactagttgaattttacacttccaggggtcagtatgtttgttccaaatctgcttatgccagttacatttagtactgtaattttataatttaattaaacattaactaatgaaatatgactgcaaaaagtagttgtttttaggaaaattaagttgtagatcttgaacaaattggataaatacaaatccccttttccccttttcaccaaattactgtcttactaattgtgggcgtgaatattttgaaagattgggggtggaaatcataaaattcttttttttttttttttttttttttgctcttgtttcccaggctagagtgcaatggtgtggtctcagctcaccacaacctctgcctcctgggttcaaatgattctcctgtctcagcctgccgaatagctgggattacaggcatgcgccaccacacctggctacttttttgtatttttagtagagacatagtttctccatgttggtcaggctggtctcgaactcctgacctcaggtgatccacccgcctcggcctcccaaagtgctggtattacaggtgtgagccaccacacctgacctcgtaaaattcttaaacgatctatactcagttgtcttacagttgcctagattcttgttccatttaaagaaactgaaatttgaaatcacaaatgtggattatggatatgatgggttatggatatgatatatttgtaatgaatatgcaagagagaacatttgaaacattaattagtagaaatgtacttaaagaagaggccttggttttttaccgtaatattggcaggtgacatgtatttgttttgagtaaaaatcaaatatttcagttacatttttaaaattacctgatatactgtactttttcatgtaaccagtcagccctgagtcctatttgtgttagataagtttttaccaatcccagaaggagatagaggacaagcttttatatgcttcggctgaagaaaacctttctccaaagaagtaattatctgatcctcctataaagggccagatagtaaatattttagattttgcaggctgaagtagaatcaagggtaatacgtacgttctgatataacaagagagaaaacaaattttgagaaatttcttaattgattaaattcaaaataataaacacaatttattgaaatacaggtatactaatgagaagaatggagttcttttcggagtgataacattttcttaattggagttcagagttagtgcttcctattcaataaataatcatcaaaattgattgcaagtatttatctattaatgcaggtctgtaatgaggttttatatatttcatctttgacatgtcttcacacatacatgtcaaataattgataccagcccataaacatatgattttaattgagcatattaataactcaggaagcatttatagaattaggtttttcttataacatttaccttttagtatattattcattgctgcttaattacttccaatggaaggttagacagaagctccacaattgcactgttaaatagatactgaaatatagatatttccttgtgcattaaggtcctaaaaattattctggaaatgtagtgtgagctaagaaactatatccactgcaaatttgtttgggaatggagatctcacttcttgttttaacttttgatagcatgtaaagtgtataaagcagctcaacgttgcttatgattcaaaagttagttgtctaaataacaacagtttaagtttcatatataagtgttgttctgtcctgtaattttaagttgaatttactattataaaattagcaaaagctaattctcaaagccatttattgtttgatcatagtgtctgaaagcagtcttattgttgtgaaaaatttcaatctcagttccaagctgaaaagaaaaaaaaaaaagcatgataaaactttagtacagctcagccgtcaaactgctgtgtgcctgggcaagtcaggttattcagcttctgtttctgacaatggttaagcccatggcagtgaatgaaattcaccattaacatggttggtttaataattcatgataaattcagatatttttcatagaatatctattgataaaaaacatgaataaccaccttacattttcacgttttataaatcacccaactaagcctttttctgcttcacacatatttttaccattatcaatgataacgtatctgagattccactttaggttatatggaattagtactttttcaccttcttgtttgtagttgttcaacacagactattcatagaagctaattcttcagttgttttaaacttggcactgactccttgaataaacatctgaacagtgttgtaacatctatcaaactcattcaaaagagatggaaatctacttaacctcaattgccttggttttttttttaaacagattattgatcttgctcctaatattttcgacttttagagcaaatgattttgttgaaaggctaatagtctttttttctttttaaattatcttatattaaatttaaaaaataatttttttgttacctgtctggagaaagcctagagaaaggctaattaatactcttaaacaagtttattttctctggatacatttcttcagcttcttcatgatttaattcacttatcactagaatattacttttcttgctttgctaacaaatgagctacttagaaacttccctcctttacaaactttctattccttaccttccctccttgctgtaatgaaatattccactttaaattttcaaatttttctgaccattgctttcctgtgaatcggaaatactgtgatcggtccttagtttggtaacattgatgtattttgaattcttttagcacagacagacagttgactccttgaacaacgcagtttcaaactgcacaggtccaattatatgagaattttttttcaataaatacaatcagcagtttatacatatacaaccaaacgtggatcaaaaatacgttatttgaggaaacccccagatacagaacagtgaaatttttgtatcctctgggccactgtgggacttgagtgtgcatagattttggtatccacggttgatccacagataccaagggatgaccgtagagtcattgcataataaacaaaatgcttccctatcttgtcttgataaaataatgcataccctccactgtgccttaaaagcatgacattcaggctgggtgtggtggctcacacttgtaatcccagcacttttggaggccagggtgggaggattgcttgagcccaggagttcaagaccagccttggcaacatagtgagagtccatctctagttttaaaaaaatacaaaattaaaaaaaatgaaaaacatgacattcaaagtgcatttgtttttgtttcgacatgatggttatgcactaataactaatgatagttatgtactaataaaatgtcaaaataataacgacttttagttactgataacagttatgcattaataaaaaataaaatgtcacagtatgacaatatgcatgtgtggcaccaaacatgctgttgagttataactttgtgactgtgatttgtgggatactgagcagcagtggaaagctatataagccactccactctgccagtcagtacagtggctgattaccaattatggataaccagaacacatcaaaaagcagttcaacaaggatcagaataataacatgtaagtaccatttattaagtagttatgtgtaaggcactgtgtcagactgtataatgtacattatttaaccttcaaaagattgagagggaagatcccttgagtctgggaggtcgaggttgcagttagctgtgattgcaccactgcactctagcctgagtgatggagcgaaatcctgtctcaaaaaacaaaacaaaacaaaacaggcctggtgcggtggctcatgcttgtaaatcccagcactttgggaggctgaggctgaggtcaggagtttgagaccagctgggccaacatggcgaaaccacgtctctactaaaaatacagaaattagttggtgtggtggctcacacctataatcccagctactcgggaggctgaggcaggagaattgcttcaacccaggaggcggaggttgcagtgagccaagatcatgccactgcactccagcctggatgagagtgagactccatctccaaaaaaaaccaaaacaaaacaaacgaaaactacaaaagattgtctgaagccagccacagacaatagtaaatgaatgagtgcagctacattctttcttatttatggatgcagaagtttgaatttcatataatttttccgtttcacttatatataaattatatattatatattacataatatataatatatattataagataatataatatatattagataatatatataatataagataatatatattagataatatatataatataagataatatatattatataatataattaaaatatattaattataatatataatatatgacatatatatgttatatattgttatatataatatgtgtaattatatattataatatatgatatatatataatctatcatatatcatatatataatctatcatatatcatatataatctatcatatatcatatcatatataatatatatcatatcatatataatatatatgatgtatagtatatatgatatataacatatatataatatatgatgtatagtatatatgatatataacatcatatatactatacgtcatatataatatgacgtatagtatatatgatatatgatatatatactatattgtatatgatatataatatgtattgtatattatatataatatatatataaggcacagtggagggtatgcattatatataatatgtattatatattttatatattataatatatattttatatataatatattttgtatattatatattttatatataatatattttgtatattatatattttatatataatatattttgtatattatataatatataaaatgtatattatatataagtaaagtatatattatatataatttttatatatactttttttttttttttttttttagactggatcttgctctgtcacccaggctggaatggagtggctgggactacaggtgtgtgctatcatgcccagctagttttttttttgttttttttttgttttttttaattttttttttttttttaagacggagtctcgctgtcacccaggctggagtgcagtgacatgatctcggctcactgcaagctccgcctcccgggttcacaccattctcctgcctcagcctcccaagtagctgggactacaggcacccaccacacgtccagctaattttttgtatttttagtagagacggggtttcactgtgttagccaggatggtctcgatctccggacctcatgatccacctgccttggcctcccaaagtgctgggatcacaggtgtgagccaccgcacccggcctactttttattttaacttttttttttttttttgtagagatgtggtctcactgtgttgcccaggctggtctcaatctcctggggtcaaacagtgctcctgcctcggcttcccaaaatgttggtattacaggtatgagccactttgcctggctatcttataaataattttgatgttaggaatttttagttgcttttatttttatttttgttgttttaaatatttattaatagaagcaaggggtggataaatcttctagatcaaactcttccttaaaatagttctgcttttggtaggattccagattttcctagttttgttaagtgtttctaatgatgtttggcataggtgttaacttcatgggcctgttgtatacaaaccaatttttttcttgctctgagtgaacagtaacagaacctggtaggtgagtcacactgatactgcattcactgaagttactaagctgaatgataagagatgagaatcctttgcatttgtattcaaatcaagagttgtagaatttgaaattcctgttttgatgaactatgtgaagcatgctgtcattcttctctgctagtctatgttgatgatgtcattaaactagtctttgacttttagttcttggcttaaaatattggaatgattatataataaataggtttatttcatgtggaaaaggaataatgtgtttgccctgaaatagtctgatctgatcaggaggatattatgctgagcatggctggaaataaatttgtagcaccaattaaatacactgtagcagctctgagagggaataaaagtaaaatataaatagtaaatatgagagaaagtgactatgggatctaactatgtaagagcagggtgggagtatgggtagatacgtacatgccccctagattttaggaaagcatatttcaagaagtagagaagacatggatatcaatcagtggaaatcgtatactaaaacggaagtcagtgaaaaaaaaagactgctctcaaactaaagatagatggttgcttctaataggtaggtattcagattcgattaagaaattagaaggccgggcatggggactcaggcctataatcccagtactttgggaggtcatggtgggcagatcacttgagcccaggagttcgagacaagcctgggcaacctggtgaaaccccatctccacaaaaaataccaaaattaattagcagggtgtagaggcacatgtctgtattcccagctactcaggaggctgaagtgagagaatcacttgagcctgggaggttgaggctacagtgagccgagatcacaccattgcactccagcctgggtgacagagtaagaccctatctcaaaaaacaaattttgaaaatatacagaagtatagaaaaactgaagtaatttaatttgtgttaaaatctgtttggtattaaaactaatgtttggccgggcatggtggctcacgcctattaattatcctagcactttgggaggccgaggcaagtggattgcttgagctcaggagttcaagaccagcctgggcaacgtggcgaaactccgtctctacaaaaaatacaaaaattagctgggcatggtggctcacgcccgtagtcccagctcctttgcaggctgaggcaggaggatcacttaagtccaggaggtggaggttgaagtgagctgagatcgcacctctgcactccagcctgggtgacagagtgagaccctgtctcaaaaacagacaacgacaaaaaaccctaatgttttatgaaaaagctctttaatttttcgtgaccaaactgctattctctagacctacactgtccaaaatgatagccattagccatgtgtgctactgtgttggacagcacgtatttagaacatttccaacatcacaaaagttctattgcagaatgctatgaaaatgagatacactttcattagaaaagctagtaaaaataagtaggggtaatggggtactttgactatccagaaattttactaaggaagaattagatttttataatactgggacattagtgtgcactttttttgtcgtaattgcattttgttttttattttgaaataaatacatgtacagaaaaattgcaagaatagttacagagtcttttcgctccctgaaccattagagagtgagccccatcagccccaaatactttaatgagcattaaatctggagtttggccgggcacggtggctcacgcctgtaatcccagcactttaggatgacgaggtgggcagatcatttgaggtcaggagtttgagaccagcttggccaacatgatgaaaacctgtctccactaaaaatacaaaaaaatgagccgagcttggtggtgcacacctgtaatcccagctactcaggaggctgaggcatgagaatcacttgaacctaggaggcggaggttgcagtgagctgagattgtgtcactgcattccagcctgggtgacagagtgagaccctgtctccaaaaataaaataaaataaatctggagtttaataccagtacagtactaccagcttatcttcaggccccattcgagttattctagttgtccccaaaaggtgaaggatccagtttaaaatcacacattgcatttagttgtcatgtctgtctttgacttgatcgccttgacacttttgaagattacaggctcattattttgaggaagtcattaacatggacctgatgtttcttcatctttagattcagattatgcattttatcagaattgccacataaattgtgctgtgttcttattttatccatccaggtactacataatttccatgtgtcccatttttcttgatgttaaccttggtcacttgattaagattgtgtctgccagttttctctaccatacatttaactattttttcctttataatcagtattttatgaggaggaggaggaggtactttgagacaatgtaagtatcccattcctcatcaaactttcaccttctagttttagcacccattgaaatttttttgctggattattggtatgatggctgccaaatgatgattttctaatttcatcatcccttctacatccattcattgacatttcattgaaaggaaaaactgttttcttcccatttatttaacttatatcaatatggacttacggattcatattttattcaataagttatctattagtgtactttggtactttgatgctgagtttgtcccagatttggtcagtggaaaccctgtcaagctggcttctgtatccttttgacattgtcctatcattctttgatcactttcctctttctgggaccagatatgatcaaagcccttcttatacttttcctgccctacctctggaatcatttcaccaaggtaccctggttccctttattgaagaatgtatttagaggttaggtctggacagtagatggcattgttccactgaggtgtcactgctcctagactttctcagcagacagagctagagcatatatgcatgtatatacatacacaaacatacatccacacacatagactcatttttttatttcttgctctgtgtgtgtgtgtgtgtgtgtgtgtgtgtgtgtgtactgtgagttcacactggtacctagtacctcaacacctcagagttcattttatttttcttcctttttgtatttgtaactcccttctctgacagagaaactgggccccagtttttcttaatatattactatttacttaattgatcaatccccttgaatgtgcccagtctttcctttccttatcagatcatgtgcatgctaaccttgctcagccccacctaatggtttttagactgaattatttggagacgaaaaaagtacggttgatgctcattagtcacagattttttttatttgcaaattcacctacttgctaaaatttatgtgtaaccccaaaatctgtactcgtagcacttttatggtcattcatgaacacgtacagaagggtaaaacatttgagtcgctattgggtaacgtgtattcctaggtgaggccaagcaaggcagtctactgccttcttctttgagtcctcatactataaatagttgtcccttttgcagtttacttagcgccacatattttgcattttgacttcttttacttagcatgtgttttcaagttccatccatgtttatagcatgtatcagtacttcattcttcttcttttttttttttaaagagttgggggtctcactgtgttgcaggctggaatacagtggctattcacataggccatcatagcatgctgtagcctcaaactttcactgggctcaagtaatcctcccacctcagcctcccaagtagctgagattagaggtgtgggccactgtaccaggttccttcctttctaaggctgaataatagttcattgtatgtataataccacattttgtttatctattcatccaataatgggcatttaggttatttccaccatttggctatcttttgaaaatcttttcatgtgcttgttggccattagtatatattctttggagaaatgtctcttaaattctttgcctattttttaaattggggggaagttgtctttttttgttactgaattgtaagagttctttattctgataactagacccttatcagatacatgatatctgattaacacatagtttcttgcatcccataggttgtctttcaaaattttgacgaattccaatttgtcagttttgttgcttatgatttttagtgtcatatctaagaatccattttcaaattcagtgtcatgaagatttacctatgttttcttctaagaattttatagttttagaccaagcgcggtggctcatgcctgtaatcctagcactttgagaggctgagacaggcggattgcctgagctcaggatttcaagatcagcctcagcaagatggtgcccatctctactcaaatacaaaaaattagcctatggcgtgtgcctgttcagctactcgggaagttgaggcaggaaaattacttgaaccatggaggcagaggttgcagtgagccgagattgcatcactgcactccagcctgggccacagagcgaaactatgtttccaaaaaaataataacaataattttatagttgtagctttttaagtttttaatccactttgatttttttgttttgttttgttttttgagacagggtcttgctctgtgctgcaggctggagtgcagtagagcagtcttggctcactgcagccttgacctcctgggctcaagctatcctcccacctcagcctcccaagtagttgggatcacaggcttgtgccaccatgcctggctaatttttgtattttttctagagatggggtttcactattattgcctaggctggtcttaaactcctgggctcaagtaatccatgcccaccttggcgtcccaaagtgctgggattacaggcgtgagccaccactttcagtcccaagttaatttttatatatggtatgaggtaaggattcattcttttgcatgtgaatatccagttgtcccagtgccatttgttgaagagcctgttctttccccattgaatgttgtcttagcactctttccaaaaattagttgaccatagggcatggtggctcatgcttataatccaagagctttggaaggcccagatgaaaagattacttaaggccagtatttcatcaccagccagccatggtggtgtgtgcttctgggagggtgaggcagaaagatggcttgagctcgggtgttgaaggctgcagtgagctctgattgtgccactgcactccagcctgggtgacagagtgagacactgtctctaaaaaatagaataataaaaatcagttgactatagatttgtggatttatttctgaactcatttaaaactattccattgatctatatatcactccttataccattaccacacagctttggttaccggtgctttgcaataagttttgaaatcaggaagtatgagttctccaactttgttcttccttttcaagattgttttggccattcggagtcccttgcaattccatataaattttaggatcagtttttttatttcttttttttttttttttgagacagagtctccctctattgcccaggctggagtgcagtggcgtggtcttggctcactgcaacctccatctcccaggttcaagcaattctcctgcctcagcctcccgagtagctgggattacaggcacacaccatccgcccaactaaattttgtatttttagtagagatggggtttcagcatgttggccaggctggtctcgaactcctgacccccaagtgatccgccggcctcggcctcccaaagtgctgggattacagacatgaaagcttttttatttttgaaaaaataaataaataaataaagacataagatgtctttccatttatttagggtctccttgttcttggaggtagattttctctgatctattttcattgagaccttgggccttaagagagccacaatttcatgagagattatttctctggagcccttcctacccttctcctatttcctgtctcctttcctcccttgttattcaaaagtcttaacaaatgctcctgggcccaatacagaggtcagctcacacttccagccttagctttggttcactttttgctttcttgccactggtagttttccctcctctcttaagaacttagctaagcttttcaaaggatgtttgcatttatccaacatttctagattttggtagctggagagttttaataattttctagattgctgttttactagattagaaaaagatagagctgggtgtagtggcacatgcctgtaatcccagctactccagaggctgaagtgggaggattgcttgagcctgggagttagaccaacctgggcaacatagtgagacctatctcaaaaaaaaaagtaagactttagggcgcagtgtaatcccagcacttttggagaccgaggcgggtggatctcgaggtcaggagttcaagacaagcctggccaagattgtgaaaccccgtttctactaaaaatacaaaacttagctgggcagagtggcaggcgcctgtaatcccagctactctggaggctgaagaagagaatcacttgaacccgggtggcagaggtttcagtgagccgagattgcaccactgcactccagcctgggcgatagagtgagactctgtctcaaaaaaaaaaaaaaaaaaaaagacagtgttttttaaagatggagtttagtatacagaaatattgggtgtcaggcaaagtattaattactttgtacgtattctcttttccttcttttttttaaaacgagacagggtgaccaggctaaactctgactgttgggctcaagtgatcctgccttagcctctggagtagctgggcattacaggcacatgccactgtgcccggctacatactcacttataaaactctatttttaaatgacagctcctctttacaaaatagatcaggagagcgattttcctgtctgcttcctgaggaagcaaaaaggcagaaacatggtgagcagcaagaccagtggttgccgtagtaagcatgggacttcctatgaatggctctgttaacagtaggggatggtaatgttctttgatttgtggactctgtttgatttgtggacaaggttttatttcctgtctttggggtaggagggtctgccatatccacaaattggctcttcccatttgttgtattcatttagttagaccatgattggaaagcctcactggctgtgcacattgcaccatacttaggaatatatgacggttatacatttcaaacagggctttaaaaccttccattcagctccttttggataaagctcttttcctcatgtggttgttgacatacatgaattataggctttgtttagctagtgggtaagagcagattttggagtcatgtacacctgggtttgagtttcagtcttgccatgtaccagttgtttgtggacaagttatttattaataactactctgtaccatagtttcttcattggtagtatcttcaaaatgaagtatctatttcctgtgctgttttgaaggtaaccttaaataatgtgcattgtacaatttgatacagtgtctgacacgtagtaaatactttaatatataatacctgtttttattctgatccttgttgagctgctgctttttgatgtgttgattatatataattggtaatcatccattttactgacatcttccaagatttgaccaagttgattgtctcaaatttccaagcagaaaaagtacccagaaaacagaaattaagcagttattaaagaatcgaatagcaatgatcattacgacttgtgcttaataagaaatgtgggccatgtctgcctgagcctttatttaatgcattttaaaatttgctgggttttttcctccctttaaaccttactatcaggttcagtaataagttaaactaaaaagaaacggatgccttagaataaagaaagattcaaattaataggatatataatggcctttcatggtggtggaatttctgtgtgttttgaactaagggaaagacttaaaggaagattgcctacagtgtactggacactttgctaggctctgtggatattatcaagacacagtccttaccctcaaggatctttttatttttcttttagagacgggatcttgccctgccacccaggctggagtgcagtagcaaaatcatagttcactgcaacctccactcactctcaaggatcttactctcagctgggggaggccataaacagttaaagtagcttactctcagctgggggaggccataaacagttaaagagttaatgattgactctagggctaagggaaagaaagtaattgggtcaactaggatttctagcttggcaagggggtagacctggattggcaaactacaacccaatgccagtttttgcatagcccacaaactacaaatgtttcttacatctttgagtggttggaaaaatatcaaaagaagaatactattttgtaacgtggaaattatataaaattaacatttacatgttcataaataaggttttattagaatatagctatgctgaaactacatatctatgactgcttttttgtcacaacagcagagatgagtaattgtgacaaaggctgtttggcctgcagagccaaacatttactgtgtggctctttacagaaaaagtttgctaactcaatgagtaggtggtaatttttatccattgaaacaagcaattaaggaagaacagatacaggagaagataacatttctgtgagtgttgattatttgaatcagaggtacttgtgaatatgcaggtctagaaggcaagggaatttataggtttggagtttggaaagagcttgaggctggaaatggatgtgggaggaaaggaggagatcaagaagactggatggaggagtgcaatttttagccctgtctgcacattggaatcacctgtagtgcttaaaaccaaacaaaaccagacagacatttccaggaacccaaccccaactccctctttcccaagattatgatgcacctgagctggacttgggcaccagaattttttgaaagctcccccagcaactctaatgtgcagccactggtacagagtgagaagattggaagatgggacaccaggaacaccaacatttaagggatagttctaggtgcttctgctgaggagaggaaattctgagggagtgatgatgggaattttagggtggtcagatcctgtaatttgagatcattgttgactgatgaatcaagagcagtttctgtagaggccaggtgagggtgtatgtcagaggcccctggtttgaggtgggagagtatgaactattgagaatattgaccgggaggaaaggggggaaagtgatggctgggatggggggcattgggaatgtagtttgttctagagaggtttttttaagatgttaaagccttgaggctatttatgtgctgagggagtgagtactcagaaagaaagcctggaatggcagtatcagatgccaccattcagttttcatgatggagtgaagggctagattttgaatagttcttggaataatcttaatattgtaacctttttggaactgtttgcttaatgtgctttcttcatttaggtgcattacattgtacctggaaagagaaatggacccaggcattgagaagcaaggccaacaactctgctttgcttgcccggttactgtcgttctgtctgggacattggtctcatctctgaaagcaggagggcaaactgaatgggctctgtagtctcttctaaaagtttttagtttaaactattaatagtacaactttgatttaacaaatgaggaagctgagcttacgagatgtctgtgaagcccattgtctgatcttttatttccttagtacctgggaatgcgcttttttttttttttttttttgaagaacaccaacagttgttcacccttccttgaatttgggtacactgtatatacagagtataccaatttagcctgccattagaacatgtcttcacgagcaaaatctagtataaagtcttactttaatattttctttattatgtataaataatagatggttgttatggaatactggatagtacaaaagtttagaatttttaacattttggtttatttattgggactcttttttccccccagtgattcttgtttctccaacaatgtgaatgcgcactccattcagtgtgaacgtgaatgttaatttatgtgccagctggattctacaggaagcagacacagatggggttggaggggcaaagggcttattagaggagtaatgcctgtgaagaaaaggggaacggaacatgtttgggtatagggagccatcagactgcagtgcacacctgacgaagtctctgcccacccagattgcctgatagaggaataccacaagaggtagaaatggctaggctcttgtactaccactttgcacagtcattgactagagatagatctttgatcaatgtagagattttcagccttggcattgttgacatttgggactggatactttgttatagggggttgtcctgtgatttgtaagatgcttagcagcatcctaggcctctatcccctagatgccagtagcccagcctccctgctattagttgtgacagtcaaaactatctttagacactgccatatgttccctagggaagggcctaatggtatataaacaaccctatggtggcatagtccaagttttgggacagggaggagtgttctatactacccttactggaaagacctatgagctattcagaaatctgaactatttaagatggagctttgttctgtggctcctggaattttaagcacacccctgtgaaacatcttgttaggatatactccactctccaaaacaatccataatgtttaaatagggctgttttattgattgattgattgattgattgagatggagtctcactctgttgcccaggctggagtacactgtcacgatctcggctcactgcaacctccccctcctgggttcaagcaattctcctgcctcagcctcccaagtaactgggattacagacacccaccaccgtgcctggctaatttttgtatttttggtagagacggggtttcaccatgttggccaggctggtctcgaactcctgacttctcaggtgatccgcctgcctcggcctcccaaagtgctgggattataggcatgagccaccgcacctggccttatttttctttttgagatggagtctgactttgtcgcctgagctggagtgcagtggcgcgatctgggctcactgcagcctctgcctcccgggttcaagcaattctacctcagcctcctgaacagctgagattagagatgcgtgccaccatgcccagctaatttttgtatttttagtagatgcaggatttcagcatgttggctaggctggtctcaaactcctgacctcaagtgatccacccacctcggcctcccaaagtgctgggattacaggcatgagccaccgctcctggctattttcttttgagactgggtctcattctgttcccaggctggagtgcagtggcacaatctcagctcactggaaactccaccttctgggctcaagcagtcctcccacctcagcctgctaagtagctgggattataggcatgtgccaccctgcctggctactttttgtggagatgggattttgcatgttgcctaggctgggcttgaattcctaagctagaacaatctgctcagggatgttgtatatttctaaaggtatttttccttttgttgcaggtgacacaactaaaaaaaaacaaaggtatttatggaattccactgagtggtaatggatgatgcagttcaaataactaaggtaagagaaataaaaccagaactgtgaggaggcttttgccagccaagtagtgtccttaaataaagctaacatcacatgctttcctgcttcatttcgtttctaagctgtaagagtagcttatttttttattattataaacattgtaattatcctttaagatacttcttaacctgattatgaatcagaatcacttgaagagctttttttttttaaaaaaaaagaccaaagtcaggctgggcatggtggatcacgcctgtaatcccagcactttgggaggccgaggcgggcagatcacttgaggtcaggagttcaagaccagcctggccaacatggtgaaaccccatctctaccaaaaatacaaaaattagccagatgtggtggcatgtgcctgtaatcccagctactcgggaggctgaagcaggaggatcccttgaacccaggagacagaggttgcagtgagctgagatcgcacactgcattccattctgggcaccaaagaatgaaactccttctcaaaaaaataaaaataaaaagaccaaagttaatgccctgccagcattgaattaaagcttcttgagtagatcacagatgatctccaagttttttaagtgggaatgtaaaccaactctatagttttagaaaactctttggcaatatctgcaaaacatacacgtatctaataacccaggaatttcaattctaggtatccacctttgagaaatgaaaaatatatgtctacacaaaagtgcacatacaaatgttcactgcagctttatgtattatagccagaaaaactgtaacccaatcaggtgtccaaaaacaggagaatagttaaacaaattgtgatatatggtcaggtgtggtggcttacacctgtaatctaagcacttgggaggctaaggcgggcagatcagttgaccagcctggtcaacatggtgaaaccccatctctactaaaattacaaaaatgagctgagtgtggtggctcacgcctgtaatcccagctactcaggaggctaagacaggagaatggcttgaagccaggaggcagaagttgcagtgaggtgagatcacgcccctgcactccatccaatctgggcaacagggcgagactatgtatcaacaacaacaaaaaattgacatacactattgataacatggaattttattcagtaatagaaaggaacaaactaccagtagacatgacaacatggatgaatctcgtagataaaaggttgagtgaaagaaaccagatggacaagaaaaagtagatgtagcagaattaccgagtaaaactaaactacagtgataaaggtcatatccctacttcctctgacaggaggtgggaggttgtgactggaaagaggtatgagagagcctctgcagcaccgaaaaggtgttttgttttgttttttgagactgagtcttgctatgtcaccaggctggagtgcagtggtgtgatctcagctcactgcaacctccgcttcctgggttcaagcaattctcctgcctcagcttcccaagtagctgggattacagacacgcgccaccacgcccagctaatttttgtatttttaatagagacagagtttcaccatgttggccaggatggtctcgattgcccaacctcatgatccgcctgcctctgcctcccaaagtgctgggattacaggcatgagccaccgcgcccggcctgaaaaggttttacatcttaatgtgttcatatacatacttttctcatggtaaaatatatataagattaaatttatcattttaactacttttaaagtatacaattcattggcattaagtacattcctgttgtgcagccatcaccactgtccatctccaaaactttttcatctccccaaactgaaactccatatccattaaacactaactccccatttcctcctcccccagctgctggcaaccattctaccttctgtctctatgaatttgactataatagttacctcgtataagtggaatcatatttgtcatttgacatctggtttgtttcacataggtttatttcacaaaggtatcttgtttatttcacataggatgaccttgttttcaagtcatccatgttgtagcatatatcagaatttacattttatggttgaataatattctgttgtatgtttataccactttatgtgtatccattcattcactgatggacacttgggctgcttccaccttttggctgttgtgactaatggtgctatgaacatgggtgtaggctgagtgtggtggctcacgcctgtaatcccagcactttgggaggccgaggcaggcggatcacttgaggtcaggagttcaagaccagcttggacaacatggcaaaaccccatttctaccaaaaatgcaaaaattagccaggcatggtgctgcatgcctgtaattcccagctacttgggaggctgaggcaggagaatcgcttgaacctaggaggtagaggttgcagtgagcccagatggtgctactgcactccagcctgggtgacagagtgaggctgtctcaattgaaaaaacaaaaacaaaaacaaaaaaaaacacatggatgtacaaacatctgttcgagtccctgcttttagttcttttgagtatattcttagaagtaaaattactggatcatatggtaactccatgtttcattttttgaggaatcaccatgctgtttttcacagtactgcatcattttatattcccaccagcaatgcacaagggcttcaatttctttacattctgctttttggtgacctccataattctaaattatatgtatatgctgtttcttcttaattcttttattaataaaaaagacaacataattctttgcctctccagtgtgaaaaaatgggaatttaccttacactatccccccatttaatatttgtattatttcctgttctgctgctgtttattagtttcctcagacttctgtaacaaaactccatgaactgggtggcttaaacaatagaaatttattgtctcagagttttggaggctagaagtcttgcgggctgtgcgggagaatctgttctatgattttcttctagcttctggtagcctcaggcatcccttacattgtagatggcattctctctgtatcttcagattgtcttccctctatgcatatctgtctcttgtgtccaaatttcctttttcaaaataagtgcgctagtcattggattagggaccaccctaatgagctcatctcaacttgatcatatgcaaaaatcctctttctaaataagttcacattcacaggaactgagtagggggttacaattttaacatcttttaggggacacaattcagtctgggtgacagaacaaatctctgtctcaaaaacaaaacaaaacaaacccataaagtgattacatttctaactttcggaagtactcttcaacctcctttttttaggttaattttcagcactctttccttctttcttcctttcctttttccttttccttttttttttttttttttttttttactttttatttttttgagacagagtcttggtctgtcgctcaggctggagtacagtggtgtgatcttggctcactgcaacctctgcctcctaggctgaagtgattttcctgcctcagcctcccaagtagctgggattacaggcacccgccaccacgcccggctaatttttgtatttttagtagagccaggttttcaccttgttggccaagctggtctcaaacttctggcctcaagtgatccgcccgcctcggcctcccaaagtgctgggattacaggcatatgccaccacacctggctaatttttgtatttttagtagagacagggtttcacctgttggatctcctgacctcatgatcgccctcctcagcctcccaaagtgctgggattacagtcgtgagtgccgcgcccacttaatatttatgttattatagctaagtaaatattgttcactgtcaggccaggcagcattttctgggtttttatttctttctctgtaggttcaatgtcatagaccctgggctattcaaatgagaaaatgaagaaaaagtgaattctctctctgaaactatcagttgcttccaatcatgtctttatattttatatttgaaccgtaactttctcataaaattttctccctggagtttctaattttcttgtctatttgcctgttattatagtttcacttttcaccaagatctcaatcatacactccagcctgtcaaggctagttcaaaccatacactgtggcccaaatttaggctagtcgtacactccaatccgagaccagtgggcactgttttttaggctgtctacacagtcatattggtattttccttactggtttttctttgacgggggtgcaggggaggttgggtccactgatcttggatatcagtctttctttgtatttgttttttaaatcttactagaggctagggggcatggtggctcatgcctgtaaccccagcactttgggaggctgaggcaggtggatcacttgaggccaggagttcaagaccagcctggccaacacggcaaaaccctgtctctactaaaaatacaaaaattagccaggcgtggtggtgggtgcctgtaatcctagctagtcgggaggctgaggcaggagaattgcttgaacccgggtggtggaggttgcagtgagccaagatcataccattgcactgcagcctaggcgacagagtgagactccatctcagtcaatcaatcagtcaatcaatctatcttaccagagttcattctcaagtcacttactgagagaaaaggtacctggcagataaattttgactctttctggtatccgttttttgttgttgttgttgttgttgtttgtttgttttggagacggagtctcgctctgttgcccaggctggagtgcagtggcgcgatcttggctcactgcaagcttcgcctcccaggttcatgccattctcctgcctcagcctcctaagtagctgggactataggcgcctgtcaccacgcctggctaattttttgtatttttagtagagatggagtttcactgtgttagctgatctgccctccttggcctcccaaagtgctgggattacaggcgtgagccaccgtacccagcctctggtgtctgtttttaagaccctcatgttggagtgatggtttggttgactatagaattctaggttgcctattatttttcctcaaaactttgaagtcattgctccatttcttctgacatcccttgttgttcatgagaaatagaaagtttcatataggaaattaatttttcttcttttctggaagcttttatgttctatatagtctggaattccatagaggtgtacttggtgggccccttaatagatctgcagactcatagctctccattttttggttcttttctgtcagcagctttctgatattgagcttcctgggttgttcatataatgttcttatctattctgtcctttttaaaaactctttgcttttggttgttttcctggagattgtcataactttatctcctaatctttttttctctctttttttttttttttttgagacagggtctcaccctgtggcccagactggagttcagtggtgccatcacagctcactgcagcctcgagctcccaggttcaagcaatcctcccacctcagctttccaagtagctggaactataggcatgcgctactacacccagctaattttttttatttttagtagtgacagggtctcactgtgttgccctggctggtctcaaactcctgagctcaagtgatccttctgcctctggggactacaggagtatgccaccacacctggctaatttttgtattttttagtagagacagggtttcaccatgttgccaggctggtcttgaactcctaggctcaagcgatccacctgcctcagcctcccaaagtgctgggattacaggtgtgagccaccacacctggcctgctgttttttcttttactgtttcttaaactagtcttctccccgctttcttttcctgtatgaacgttaatagttgaccacagcattggccctgtaatactcttttgttctttgtatttcttcagttttatttagcctctgttgtgtgttcacacattcctttttatttgcttgatgtgtgtcccatcccttcttttgaacactgtgtggtcattaatgagagtgtggtaggattttatgtactgatatttaagaaaatgaccataaaatgttcttggagatggtctttaaagaccgggcatggtagctcatgtttgtaatcttagtactttgggtggctgaggcaggaggattgcttgagctcaggagtttgagaccagcctgggaaacatggggagatcccatctctacaaaaaatgcacaaattacccaggcgtggtagtacatgcccgtggtcccagctattccagagcctgaagtgggaggattgcttgagcccaggagctcgaggctgcagtaagccatgtttgcaccactgcactccagcctgagtaacagaacaagaccctgtctcaaagaaaggaaaaaaaaattttaagtagttgattaaaagaggtctttagggtgggctctaatttgatgtgactggtgtccttgtaagaaaaggaaatttgtacacgcagacatcagaaacaaatacacagaggaatgaccaggtgaggatacagtaagatggtggccatctgcaggccaaggagagaggtctcataggaaaccaaacttgctgacactttcatcttggacttctagcctgtacagctgtgagaaaataaatttctgttgttgaacccaccgagtctgtgatacttttatggcagccctaccaaatgaatatagacatttaagaaggcttggtgcattgcagcatttggtaaattattatgcatttcgttgtattgtgcatgtagtgccattactgagaatagcaggatggatgggaagcatcgagacaaagtaaaatacgagctggccactaacatatggtatgattttgtggtaggtgaaaaaaggattccagaagtagagtgcttatgaaagaaaagctcagtagtgtaagaattttacaccagtttgactttaacagagagtgagttcaacagtgaaagatgaggttgcaaatgtagtttggggacccatattaatttcctggtgctgcccaaacaaagtaccataaactcggtggctaaagacagcagaaatatattgtctggcagttctggaggcccaaagtcaaggtgttggcagtgttggttccttcttggggggaatctgtcccatgcatctctccttagcttccaagagccccctgtgttatttggattgtaaatgatcactcaaatcctctttcttcaattggcattttccctgtctgttttcacatgattatcttcttataaggacaccagtcatattggattaggggcccacagtactccagaatgacctcatctttatttaactaattacatcttcaacgaccctatttccaaataaggtcacatcctatggtactggggattaggacttcatatcttttttggggaggcatagttcaacccataacaggggccaaactgtgaagcatttcctatatatcaatccagatattttcaaatctattgtttattcagtgggaaaccattgaaaactttgagcaggatgaatctaacactttaggaagactccttggggatggggttggagagatgttagctgcactggaagtcagtagaccagagtctggaccactgggagtctggaccagatcaatgttatggaaaaccaggattctggggctcccactcaagatatcccaaacccaaatcttcagactggagacccaggactgttttttaaaagctccctctctctccctgtgagtcagatgatttagcctagcttggatgtaacactgggtgtgaggtgatagaggcatgaaatgggttggtggttatgcaagtagaaagaccagagagaacctgggaaaagagacatttcgaaaaagtagtatgtaaactggcaccggagagtctgagacagtggtggaatccttaacagaaataaagatgtctagagaataaattgggtttaaagggaaggtaattaatttggtttacagtgtaaggtgatagacagtcagcaggcacttggagaatggtgatgtatgttcagaagtgagataatggaggtgataatcaaaaccctttgttttgatttgagcctttgtgtgggagaaaggatatggcgagaagaacagaagatcaggaagccaatactgtagaccctcattccctagcccctgaaacaaatggatttgacttctctgtcatgacacctggaacaaatgtggcattgcttacttacttcctttgccatgaactcagtgaaggcagggacgggtcttggcttgtgtgtgtgtgtgtgtgtgtgtgtgtgtaagagactgggtctcattctgttacccaggcatgagtgccatggcataatcatagctcactgcagcctcaaacgaacctcctccctcaggcctcctgagttgctgggactacaggcatgcaccaatggccctggctttttaaaggccatcatctagcacagtgcctggcttttcaatggaagtctgttgaatgactgactgactgaccgacttggaaaatgaacacatcaacttgagaataagaactttaacttttttcttccttgcatcccctaacatttaatccaatgcctggtccttaataggacccaaataaaattttgatgtgtgaatggtagaagaaaagctaaaattgagtagtcattgtgtcaaagagaaccaggaaacagagaagcttttgagaataagttgaccataacatgtcaaatgcaagtcaaggagaatgaaaactgagggcaggaattagatttaatcaggaggttatttgtagatttgagaacgaaggatttaagaacataatgaggttgttaagggagaatgaaggaattaagatcataatgaggttgttaagtagaggtggaaagtgaggaaatgaaagccaagtacatcttatacaagtttagtagtaatgaggaaaagagaagctcatagagttaaagctctaaaaatctgtttagaacatccgtgtctatttgtaaacaaaggggtatgagggttagggatggaaaaatggaaagtaccagaaggaaatgcataattttaggggaaagatctcaaatgggatcaagaacatgggcagtagccttaaaaaggatgagggaatctcttcctctagtctaaaaagggagaatagaggctctatagaggagagagaggtcatgtcctcttgtcagccatctgctcagagggagcttgggctgctgtgctagaaactgacataggaaactgacaaaggaaggatatgttttctgcacagcactgaggagtgtgatactcctaagcagtagttggcagcctgagataggaatggtggaaccagatggtaagtataatccaggaatcaggatggcactttctgtagattagggagttgtaggctgggggtgtacttttattcactcttctctgattcagaggttttataattttcactaacatcattaaaaacaatattggatgcctactacctgttggtttttattttaatcttgggaaaaaaaagtaaaagctactatcctgaggtttctggttttattggggagatagatcatatatgtaaaaagcaagtttagcaaatggcacatggcattatagactaagtcccaaatcagtagattacataaatgtcagagagattacaattatagcagtacactttgaggttcttttccccttagcttatgaacatttaaattttgtcacttttataaatacatgcctatttgagaggtaagaaaagtaccatgttgctttaatttgcttttctttgttagcaaagatgaattttttcagttgtttatcattattttactttttatgaattgcctattcatagcttttatccatctttccatggttgtgtttgtacttactaatttgtaaatacctcatttaataaggttatttaaccttttgcctgtaacattttgcaaatgttttttctagcttgttttttggggttctttcttttggttggttggttggttggttggttggttgggttttttttttgagacagatcatcactctgttacccaggctggaatgcagtggtgccatctctgctcactgcaacctccaccttctggggtcaaatgattcttgtgtctcagcctcccaagtagctgggattacaggcgcacgccaccacgcccagctaatttttataatttttgtagagatggggtttcacgatgttggctagggtggtctcaaaactcctgacctcaagtgatttgcctccctcagcctcccaaagtgctgggattacagatgcagccaccatggccagccttttctagtttttttaatttaaacattttctttcagatttcttattttgatttattttcagtttatgatgttttgttgacacataagagtttaaatatcttatgtattagaaactattaaatatttctttttaatatttaggaaggctacctcagcctgagaacagacaaatattttcaaatgttttcttcaaattgttttatagtttattggtacttatttacattccattgtattattgttatttatatacttaaaactttaaaccattttggaatattgcatgaaatagagacctaatttttgctgagtagttcagcagtttctagtactgtttactaaataatctatgaaaattttctgcggattcctaaatgattttgtccaggctggagtacagtggcacaatcatggctcactgcggcatctacctccccaggctcaggtgattgtcccacctcagcctctcaagtagctgggactacagaagtgccactacacccagctaatttttgcatttttttgtagagactatatttcaccatgttgctgagcctggtcttgaactcctgggctcaagcgacctgcccacttcggcctcccaaagtactaggattacaaggcatgagccaccgggtattttttatcatattcccaatacttatgtatacagacttccttgtttataaatctgtatctgtaccattgccacatattattgtattaatataatctcatagtgcaaatacttgttcattatttgttttaaataatgcctagactacactcacctatttgtatatgtgaactttttttaaaacattttattttttaataatttaagactcagaaagctgcagtagtacaggttcccaggtatgcttcacccaagggctttcaattagaacctttttttttttttttttttttgagatggagtctcgctctgtcaccaggctggagtgcagtggcgccatctcagcacactgcaacctctgactccctgattcgagcaattctcctgtctcagcctcccgagtagctggaattacaggcatacgccaccacacccagctaatttttgtatttttagtcaagacggtgtttcgccatgttggtcaggctgatctcaaactcctgacctcaggtgatctgcttgccttagcctcccaaagtgctgggattagagtggtgagccactgtgcccggcccctgaaatcaccttttctgtaatgctactttgttcaataaaaataacatattaatatcctttttaaaaatacatacaatatattgttattaactgtagtcaccatgatgtacaatagatctcttgaacttattcctcctaactgaattttgtgtcctttgttcagtatttccccaattcccctacccaccaacctctagtaaccaccattttactctctatttctatgaattcaactttttacattccacgtgtaagtgagatcatgtgatatttgtctttctatgtctggcttatttcgtttaacataatgtcctccaggtttatccatgttatcacaaatgacagaatttattctttttttaaggctgaatagtgttccattgtgtatgtatgccacattttctttcaccattcatccatcaatgaatgaaaacacttaggttgatttcatatcttagctattgtgaataatgctgcaatgaacatagtagtacagatatctcttcaacatacccatattagttatatcctttagatatatatccaatagggggaattactgaatcatatagtagttctatttaaatttttttttgttttttaattttgtttgtttagagacagggtctcgctgtgtctccaaggctgtagcacagttctgcaatcataactcactgtaagctcaagtgatctacttcagcttcgctactacaggcacatgccactatagtcagctaatttttaaaaattgtttgtagagtccaggtgtggtggctcacgcctgtaatcccagcaatttgggaggcctaggcgggtggatcacctgaagtcaggagtttgacactagcctgactgccatggtaaaaccccatctctactaaaaatacaaaaaaattagccgggcgtggctgtgcatgcctatgatcccagctacttgggaggctgagaggcaggagaatcacttgaacccgggaggcagaggttgcagtaagccaagatctcgccattgcactccagcctgggcgacaagagtgaaaatccaactcaaaaaaaaaaaaaatcgtttgtagagacagggtctcacaatattgaccagtctggtctcaaactcctggcttcaggcagtcttcctgtcttggcctcccaaagtgctgacattatagccatgagcccctgcacccagccttatttttaattttttgaggaacctccatacatgttttccataatggctgtacttatttaccttctcaccttattgtataatggtgcatatctcagaatgtgtccttactgagtgacacataactatatttgaagtaagtttcttatagatagcatatagttgggtcttttcttttctttttttaatagagacagggtcttgctatgttgcccaggctggttttgaactcctgggctcaagcagtatgcctgcctgggcctcccaaagtgttggtattataggcatgagccaccatgcctggcctaggtcttttttttttgagacagggtctcacttttgtcacccaagctggagtgccgtggtgcaatcatggctcactgcagcctcaacctcctaggctcaatcagccctccacctcagcctcctgagtagctgggattacagatgcatgccatcatgcctggctaatttttgttttgtttggggtttttttggtagagacagggttttgccatgttgcccaggctggtctcgaagtcttgggctgaagtgatccacctaccttggtctcccaaagtgctgggattacaagcgtaaaccattacacgtggtctagttgggttcttttttaaaagaatcagttctactaatttcttttcgttggtatgtataaaccatttatatttaatataattattgatactttggatttaaatttgccatttttgtttcattcattatttttgttcttctgtttcccctttcctgttttacagtgggttccttgaacattttttaatatttcattttgagtgtatctctttataaagttttttgtgtgattgctctaggaatatatatgtagataacttattacagtctattaatatcaactttttaccaccttaagtagaatgtagttagttttagtagaaggaatcttttagttccttctacctttcttcttctttttttttttttttgagacggagtcttgctctgtcatcaggttggagtgcagtggcgtgatctcagctcattgcaatctccacctcccgggttcaagccattctcctgcctcagcccctccgagtagctgggattacaggtgcatgccaccacacccagctaatttttgtatttttagtagagatgaggtttcaccatgttggccaggatggtctcgatttcctgacctcgtgatctgccggcctcagcctcccaaagtgctgggattacaggcatgagccattgtgcctggcacaccttccttctttatggtacagttgtcttaaatattacctctacatacaaggagaaccacttcagggactgctataatttttactttcaaccatcaaacataatctttaaaactcaagagaagaattgcttaattagtgtatgtatgtgtgtctgtatatgaataaacatatatatatgcataacatatatatggatatatgcatatatagacacacacacaccctttccattgctttttctttacttctatttgaggttttcttctgttatcatttacttcctttctgatagagtttctttagccattcttttcaaagctgatctgttggtgacacatttttagttttgttcatctgccagtatttgtatttcatttttatttctgaaggatattttcactgtctatagaattttagcttgatagttattttctttcagcatttgaaaaatattgtatccatccttgtggtttccatggttcctgatgaaaaatctgttgtctttcaaattgttattctcctatgagtgatatgttgtttctctctaattgatttcaggacttttctttagtttttagaagtttgattctgtaagtttatatctaaatctgaggctgagtgtggtggctcatgcccataatcccaacactttgagaggccaaggtaagaggatttcgtgagtccaggagtttgagaccagcctggacaacatagtgagaccccacctctaaaacagatagatagatagttgattttgtttttgttttttcctttttttgagacggagtcttgctgtgtcacccaggctggagggcagtggctcgatcttggttcactacaacctccgcctcctgggttcaagcaattctcctgcgtcagccacccaagtagctgggattacaggcacccgccaccacacccaactcattttttgtatttttagtacagatggggtttcaccatgttggccaagctggtctcgaactcctgacctcaggtgatccccctgcctcagcctcccaaaatgctgggattacagatgcgagccaccgtacccagtagacagtttttagccattatttcttaaatttttttttttcatctctccattcattctcttactcttgggaccctgatagcatgaatgttagatctttgttattatcccacaggactttgaaactgtgttcatttcttttcaatctactttctctcttgtacagactggatgatttccattcatttaagtttactaattgtttcctttatcatttttcttttgctgttgagcccatccagtgggtctttttaatttcagaaattttatttttaaaaattccatttggtactccttatgtcttctatatgctgagtgtttataatgtcttgtttgagcagtttcatgagcgctgttttaaattcttttcaaataattccaaaatctatattatcttggtattgtcatctgttgattgccttttttcattcaagttgagattttcatgttcctggtataatgagtaatgttggattgcatcctagcacttggaatattgtgctatgagattctggttcctgtttaaatttttatatttaacagtcaacctgtttaggtttagaacacataccctgtcccacttttgtcgactgtggttcagttttcagtcttgttttactcttatggtctgtgctaccgaaaggccagtctgaaatttaggtgttattccggagcagtgttcagttcttatgccttttgctgtgttgtttctggtcatttttacacatgggttgctcagaggcacttttaggatttcatacacagattcagagaattcatttctctagctctctcctcaccataatcctttcccaattctgtagttttgctgggattaggactccatctggttattccagggtagagaaagatgagttcacccacattctctgcagctgtaacatggagaagaggggaaaggcgtgccacctcattatggcagagttgtgttggaaggcagaatgctgttcacaatttctgggccacagtgtctggtgaggaaaaggaggggtacctcctccccttttttagtttgcctggtcaaaatgtttttgtctgctgagctgcccctttcccagttctttacctagagagggcaggcttttcttggcactttcttgtctgtgcttactggatctttcagattgtggcttcagagcttgggctaggacatattagaagttaaaccaaaccaaacaaaaaagtagggagcttcctgttgggtcagtcctcatgtcccctggtccctagccaatctaccttcttttttctacttttcagaatttttctgtcacttgtgtcatgaatttcatctagaatgttcggttataatcggtgggaagggctgggcgcggtggctgacgcctacaatcccagcactttgggaggccaaggcgagcggatcacctgaggtgaggagttcgagaccagcctggccaacatggtgaaaccccgtctctactaaaaatacaaaaaaaattagccgggcatggtgggggacgcctgtaatcccagctacttgggaggctcagataggagaatcgtttgaacccaggaggtggaggttgcagtgagctgagatcgcgccactgcgctccagcctgggcaagaagagcaaaactccatctcaaacaaaaacaaaaacaaaaacaaatcagtgggaggaatagggtggaatatgcttactccatcttttcctgaactgtaaatccctgctgcaattttaaattatgaactttagttccagtagttttttttaacctatgtacgtagtctttcaaatacaaataacagttaaggggttttcccccaataattatatcttgttttcttttcttttcttttttttttttttaaagagaccgggtctcgctgtatcgcctaggctggacttgaactcctgtgctcaggcaatcctcctccctcagccttccaagtatctgggactacaggcatatacccccatacctagctgttttcttatcccattatctacttttagaacaaggattggcaaactataatctgtttcccatatccagctcactgcttattttggtatggcagacaagctcagaataggttttccttttttttggagacaggtctcactttgtcactgaggctggagtgcattggtgtaaacacagctcacttcagcctcgacctcccaggctcatgggatcctcctgtctcagagagaaaaagagagagagaaaaaaagaaattatatgaaattcaaatttcagcgttttattagaatatgccatgttcatttgtttatatattgtctgtggctgccttcatggtacgacagcagagttgagtagttgaagcagagacttaattgccagccctttttccagatgatttgtaaatcctagaagtgaaaccattgtccctttcttgtcctgctttagtgatactgatatttcaagatacataattttcttgggtgaaagtttcttttgtttctggtttctaggtatttgtgagatatttctctcacaaaacgtgttcttttcttctggtttttttttgggggttttttttgtttctttggttttttgagacagtctcgctctgtcacccaggctggagttcagtggcgcgatctcaactcactgcaacctctgcctcctgggttcaagcagttctcctgcctcggcctccctagtagctgggattacaggtgcctgcaatcacgccaggctaatttttgtatttttagtagagatggggtttcaccatgttggccaggctggtcttgaactcctgacctcaggtgatctgccctccttggcctcccaaagtgctgggattacaggcatgagccactacgccttgtctcttttcctctgttatctgacttactggatggcatctgttaggtaaatcagaaaccaaagaggagtagcattcagcactccctgtcaccccaagagcaaatctattatcacaccctgtgcagtttacttcctgaatatctccttccttgtaacacttttgtgtctccaccagtaacttctaactggactgtccacatccagtgctatattctctacacccagctaaatgaagtgttcattccaaaatgcagggcagggaggtcactgtcatgcttctgttcttcaaaggcttcttaatgcttatgggacaaagaaaaatcacccttgtgtggccctaccctgtatacatctccagcttcctggcacctgctcccccttactctttatacttcagacacggtggcttctttcagaccctgctcctgccctttctgaggttacggactggcatggagttccctgccctccttaatgcctccctgattcctgttcatcttctacttgtcagctcaggaatcagtgccttagggaggccttggctgagctccctgactaggtcaaattttcttcttctataggctcttagagtcctataattctcttttccatcacttctcctatttgtctgtgaggtgatttgtttaatgtcagttttctgctactagactgtaagcttcatgaagatagggattctgttagaatttgttcactatttctagtagaaggaacagggcctagcacatagtaaatactgagtaagcgggttatttccccaatgattgcctttttaaagaaaaccagttctgtaaaccagcattcatcaggcttatcatatggctttttatattttgaattatttttgtgaggatttttattaatatgttttccaataatggaccatggttaaatttttgaagtaagccttacttgatcaggttgtggtataattataacatatgctgctttttctttgctaggattttaagattttgcagttaaagttattttcttttttgtgtgctttgtcagattttgacatcagtgttatactagtattttcatggcttattttattccattcttttattttcaacttttctatatccttaagcttaaaaatgtctcttttaaacagcatataattgagggcttttattattaggctttataatttttgtattttaattggaacatttagtttgtttaatatagttaatatattctttgctttctattttcctcaaagatttgaatagaacaaaaggctgacctcccccaagcaagagggaattctctggcagtctgcctttgcacttgaaatgcaactcctccctgaatctccagcctgccagcctcttctattatgagtcaattccttaaaataattctatatgatatatatttaatataattaatatataatgtggctactacctagtagaattaatgtatacttaatatgacatataatataattacagtagtaccttcttatctgggggaagcattatattccaagacccccagtggatgcctaaaaccacagatatatattttcctatacatacatagctgtgataaagtttaatttataaattaggcacagtaaaaaattaacaataactaataataaaatacaatacttataataatatgccagcatgttcctttttctcttttttcttgctttttggattgatagacttttttactatcctagcttttttccctcttgccaagttatagaccctgttcttttagtggttaccctacagattacaacacatagcctgcatgtataggaatgaaatacagtttacgtagggttcagtaccatctgtggtttcaggcatctactgggagtcttggaacatatccccccaccccccccccagataagggggtagtactgaaattatattaaatatatgcttattatattaaatattagtcatatattacatacatattatatagatttattttaagggattgattcacagtgggggaggctagcaggctggagacccaggaaggaactgcacttcaagttcaagggtagtctgctggagaattccctcttgcgtggggaaggtcagccttttgtgctattcagaccttcagttgtatggatgaagcccacctacattatggagggcaaccttctgtactcaagagtccattgatttaaatgtaaatctcatccaaaaaaacccctcacagaaatatccagaataacctttaaccaaatatctggacactgtggtgtggcccaaccaaattaacaatcacaagtctactctttatcaacttggcacccatacacatctccttaaaccattattaatctccaaataaagacagtaacaaagtcatacttctgcttagcatgaaagaactatcttgcatgtagccgaaaacacactattcctttctctaaaagaggatgcagattatttggttgatgtttactcttcttgatatcctgcaacttaaattctaaagtttaagaaaaagttaatacttaagtattatgatcagctgttaatctaattttttttgacgaaaatattttcgtatccattttctattgctgcctagcaaaacatccccaaatttaatattttaaagcaacaaccatcaaaaattggctcacaattctgtgaatatcaatcaatgctgggtagctgtttggttcctctactggtcttttttttttttttttttttagacagggtctcactctgccacccaggctggagtgcagtggcatgatctcggctcactgtaacctccgcctcccaggctcaagcaattgtcctgtctcaaccttctgagtagctgggattacagacacacaccactaccacctggctaatttttttatttttagtagatatagggtttcaccatgttggccaggctggtctcgaactcctcacctcaaatgatccacctgcctcggcctcccaaagtgctgggattacaggcgtgagccaccatgcctggcccctctgctggtcttgattgaagtcattcatgcaactgtaatcatctaatggttcatctgggactgagattgtctcaagcacatgtctggcagttggtgtcacttgttgattgggcctctctcttaacgtaaggaagtgagccaaagcttctcacattatgacagcagtgttcccatagagccaaatgacagctgtaagttctcttgaggtatcaacttggaagacacaccattacttctgcattttattggtttaagcaagtcacagggccaactcaaattaaaggaatggagaaataaacttcacctgttgataggagtggcagtgtctcactgtaaaaggcatgtgtacaaggatgggattttacgtagccatctttgcaaacagtctaccacagtgtcttttttcctttcgagtgcttaaaaaaattgtttttaaataattatttggttttcagaaatttcactattgtgtatctagacacagatttcctttttatttatctgtttggggggtgtttagggcttcttggatctgtggtttgatgtttttcctcagttttggagaattttcagccttcgtctgttcttcgaatatttcttctgttccatttctccctttccgcttttctgaaactgaaattacatgtaggttagatcatttcattgtatcctttatacctcttaccttctctttggtatttttttataaatctttttgcttctctctgcttcattctagatacttccttttgacctatttaccagctcactaattctctcttcaggtatattttacctgttcttaaatttatccattaagatctttttttcagatctgctattacatttttataccattcttgactaaaattcttaatgctacaggactgttcttcttgtctgtttcttactgattctcatgttgcctttttatggactagacactgtagttttaaaattatttatagaaatgacctgagacctatgatatatttttcaagagaggatttacgtttgtttctagctttgcctaggagtcttcaatcattttaattcagtttcagggactgatttgcttttaagcagggctgtagtccctacaggggtggtcaacttcatttcactacctaatatacctattatgtgtggagtactttgctagatgttgggtaggtcttgtgagcagagcagacctctctttggtctgtatggagcacggagcttgattataattggcaggtgtgtgtgtgtgtgtgtgtgtgtgtgtgtaaataaataaatatttatttatttatttattataggccgggtacagtggcttacacctgtaatcccagcactttatgaagtcaaggcaggtggatcacttgaggtcaggagtttgaggccagccttgccaacatggtgaaaccctgtctcttctgaaaatacaaaaattagccagacgtggtggcaggtgcctgtaatcccagctactcgagaggctgcggcatgacagtcactcaagcccgggaggtagaggttgcagtgagctgagattgtgccactgtaatccagcctgggtgacagagtgagactccatctcaatatatatatgcgtgtgtgtatatatatatatctatatctttaagatagatatatttatatagctaagtaattaataaatatattaagttctatgaaagcaatgagtaggctgctatggttgtgaatatttggactacacaggggataagaatgggtctaccataattagcagggacaggttttgtttaagccaaaaactaagagggcttagaacagaaaccgccaggcagaagcagttaccagtgtgaagactagatgacaaccaaaaaagtatgtgggaggagggaggggaggttgcgcagtggggagttgagattgacttagaactgtattaatgagctttccccccaacccccatttttctcccatttaccttcagaaaaattagtgatttggctaccagtgaatctaggctccaggtgtagctctgtagttttggactagttacctaattcttcattcacaacaaaacagaaggagagaggaaaaagagagcaaacatggaattgggatgggaagtaagagagcacatgaggagagagactatgtcaagtttcttcgtattccttttttaattacagaagaaaagatgggataaaaatattccatcttatttctctgtttaaaagaaagagtaggccgggcatggtggctcacacctgtaatcccagcactttgggaggctgaggcaggcggatcacaaggtcaggagtttgacaccagcctgaccaacatggtgaaaccccatctctactaaaattacaaaaattagccgggcgtggtggcgcatgcctgtaatcccagctacttgggaggctgaggcaggagaatcgcttgaacccgggaggcagaggttgcagtgagccgagatcacgccactgcactccagcctgggcaacagagcgagactccttctcagaaaaaaaaaaaataataataataaaataaataaaagaaagagtaaatgaatcaaaatgaagagaagccattttatctgcctcctggatgaagagtttcattgatgaacctgaaatgttttggttaacatgagaaaggagggtgagaagatgcctgagatgtgagctccttgaggacaggagctgctttctctctccagcctggcacaagacaaggaacttagttgaatgaatgagcaaataagtggttctctgctttgaaggaacttggactgtcattaccttgcaaatcaggtttaccatttatttgctttatataagttccagaaagaaactatttcctctcataatattactaccctaaacttctggtctgatctatggattgtagagcttaaatttcctcaaaccccaacagtcagagattgttacaccaagataaatagcatatttctcagcgccttgtattttctgtctttggccacagaccttaggacttaggctgatatttgagaaggaaaaactggaatttagtagaattatacttcctgtatcttaattttccaactcttatataaggtttgctttttctagagagagactaatctggaatgagaatgaattctcatcagtaaaggcaaagctttaagtgggtcatctgactttgcttttgtgctctacattcaccctgctcataaaaggtcctttcatgagttttctaggctttcatcactgccagcgtctccacaggcattgtgaaagtattaaacttcctaccctcccccatgcttgtctcatggactctttcgtagagtgcacagtggactgtgtttagctcagcaggaactctttgcaaacactgaatacatgaacaacccccctggaaagataagagatttcagtattgcttggtgtcatagccgcagaagttagtgtctgccagtatctgatgaatatggtgacttgcagcctaatttttgtgaaattatgaggccaaagtttaagaagtgttcatgttaaagttacttatatataaaatttgcctatcgataatttctgtcaataggaggttgatgaatgcttcacataacctagatactcctaattaactgttttttatttctttttttctaggacacatgttcaaagagcataattaactttttaaaagaagctagtaagtactgaaatagttttttaagttttttctacaagaatagaggaagaaaggaaacatggaattctgaagggctacttagcaagctgcttatggcataatctggggtgggggtgcatagtaaaggatttgcattttactgagaccgatacatgtcaagggaatggtatttaaaattagtgatatgtgttgatttttcaaggactatagcccatcaactacaataggctccaaaaaattctggtgaaattagcttcttggagccttccagtttacctactatgttattcccactataaaatattctcaacttttggggttttagccacttaagttttttattttctctaatgtctctagtatctgctttagtttcctgtcaatgctagactctgtggttcagcagttcatccattctcttcccagtactcaacctcgttgcttatagtttcattacattcatctagcaaaaccttaattctgtatgtttgccataccattagtgcttagagcattttttcagaaaagaatcctggaaaaatggatcttatctcacctgggccctcaggactgctgggctgcctggtgtcagcacttcccgccattttctatagcaccagtattattcttaatactttaaaaaaccaccaggcacggtggctcacgcctggaatcccagcactttgggaggccaaggtgggcggatcacaaggtcaggagatcaagaccatcctggctaacacagtgaaaccctgtctgtactaaaaatagaaaaaaattagctgggcgtggtggcgggcacctgtagtcccagctgctggggaggctgaggcaggagaatggcgtgaacccgggaggcggagcttgcagtgagccgagattgcaccactgcactccagcctgggtgacagagcgagactccgtctcaaaaaaaaaaagtaaataaaaataaaaaaccatatcccactatctcccccttctctctttgcctgtgatcttgctgcatacttatggggaaatctttaagatgtcagatttcagttctctcacttttctacaacttctcccacttttgcctttcttatgtaccttcccttccttcccatctgattccttatcagtatttacacatgattagttcttgcctaacctaatagaccctttcttgagtgcaaatcagtggctatttttgctagggtataaaaattacctatctaatcaccttgacaaagttaccctgttatttccaataacttacttcctatggattcttgtagattttcttttttttttttttaatttttttattttcagatgttttctcgctttgtcaccatgcctggcctaaattctcgtaggttttctatgtaaacaatcagattttctgcaagtattagtctcctttctaattgttataattttaatttctttttctttttaaaatttttcgtagagacaaggttttgctatgttgtccagcctggtcttgaactcctgggctcaagcaatcctcccatctcagcctcccaaagtgccattacagtggcatgagccactgtgcctggccaaatttcttttcttgttgcgaaggcagacttttcatacaatactgaatagaagtgatagtagattactttatttctgattttcaaaggaatgctttccgtttctctctgttgaagataattgcgtattgtttttttttttaaatagtaacttttatcaggttaaggaaggtttcttctatttctatttaaaaggattttttaaaatcttgaattcatatgtttttatctaatgcattttctacatcagttgaaatggttgtatgaactcttttaatatgggtgaattatatttatagattttatgttaaaatatccttgtatatcttggataaactcaactggatcatgatttatcttttttatatgctagattcaatttgttgatactttgttatgatttttgaatatatattattgtgtaaaagtgagcctgtgattttctttcttgtaatgtttctgtccagttttggtgcctggttttgctctctccttagaatgagctgggaactagtcactcttgttttctcacctataatagcatctgggtccagtgttttttatgtgggacaaatttgaacttgtggtcaacctctttaattgtaagaatattcaggtcttttgttcttcctgggctagttttttattctttttctagagattcgttcatttttcttagttttatttgcctataattgtggataatctgttttttatctgctacttctgtaattatttccacatttgatttataatattaacttgtgggccaggcgtcgtggctcacacctgtaatcccagcactttgggaggccgaggcgggcggatcacgaggtcaagagatcgagaccatcctggccatcatggtgaaaccccgtctctactaaaaatacaaaaaaaaaaattagccgggcgtggtggcaggcacctgtagtcccagctactcagaaggctgaggcaggagaatggcgtgaacccaggaggcggaggttgcagtgagccgagatcgcaccactgcactccagcctgggcgacagagcgagactccatctcaaaaaaaaaaaaaatttacttgtgtcttctctttttacctgtttgttaatttatcaaataactacttttggctttgtttcatttttattatacaataaaatgaaattcttttcattgtatttcttttcattgattattcctataattcttaaacaactttataattgatgtaacaataacctgtacacatttaaagtgtaaaatttattacattttgatccatgtatatagcagggaaatatcaccacaacaagagtgtgaacatataatctctccccaaagttttcttgtgtcttttataatcactgcctcttgcccctgcccactccctcatccttaagcaaccattggtctgttttctgccactatagattagattgtattttctagagttttatacaagtgaaatcatgtagtatagtattaaccatgtgtttgtttgtttgtttgtttctttctttctttcttttttttttagacggagtctcgctttgtcacccaggctaaagtgcagtggggcgatctcggcttactgccagctccgactccggggttcacaccattctcctacctctgcctcccgagtagctgggactccaggcgtgcccgccaccacgcccagctagtttttgtatttttagtagagacggggtttcaccatgttagccaggatggtctcgatctcctgacctcgtgatccgcccacctcagcctcccaaagcgctgggattacaggcaggagccactgcgcccagcaactatgtgtttctgatcctttgtcagggctagccaattcctagagacagtgaataactcactcataatctagctgcctcctttatgtcgctctcataggactttgacacctctctgctacaatccacctgccctgttcatttcaagatcaggtaccaggaaactcgggacatccctatgctgcagaactcactgaaattattcaaactagccagtcctaaacatgcttaccctgccttgcccattccttccgctgaaaccacataaaggctcttgcccatgttttcatcccattccattgacctccttactgaccctagctagtgcttcctcatgtggcccctgcatggcatggtgtgcaccttcctcttcggaactgcgagtaactgtcttgtcagcggcaatcatcttgtgatctgttggcctcatcatatttgaataacaataaaatctgttttaaggctgggcgcggtggctcatgcctgtaatcccagcactttgggaggccaaggcaggcggatcacgaggtcaagagattgaggtgaaaccccctctctactaaaagtagaaaaattagctgggcatggtggtgcgtgcctgtaatcccagctactcaggagactgaggcagggaatctcttgaacccaggaggcagaggttgcggtgagccaagattgcaccacggcactccagcctggtgacagagcgagactccatctcaaaaaaagaaaaaaaaaaaactgtcaaatgatactccaaaatggttgtaccattttatatttgcaacaacaatgtctgagggtactgattgctccatatccttgacagcacttggtatagctgatcttttaattttagtcactttagtgggcatatactggtattttatgttttactttttattttcctaatgattaatagtttgcagcatctttcatgtgcttatttccctttcatatatcttctttgataaaaatatctgttcaaatattttgcccattattttgttggaatacttattttcttactgttgagctttgagagttctttatatatctggataccaatcctttgtcagatatattttttgcaaaattttttcccagcctgtgatttagtttgttattctcatgtcttttaaaaaaaattgtagttaaaatatacacataatacaaaatttaacattttaactctttgtaagtatacagttttgtggtattaagcatagtcacattgttgtgcaaccatcaccgccatccatctctggaactttttcatcctccctgactgaaattctgtacccatttaaacactaacttctcattcccccttactccagcccctggcaaccatcgttctgttttccttctctatgagtttgactgctctaagtacttcatataagtggagtcatacaatattttcattttgtgactggcttattagtataatgtcttcaagtttcatccatgtggtagcatgtgtcagaatttccttcctttttaaggctaacattccatcctatgtatataccacattttatccattcatctgttgatggacatttaagttgcttcctccttttggctattgtgaataatgctgctgtgaatgttgttgtataaatatctgttcgagttcctgctttcaattcttttgagtatgttcccaaaagtagaattgctgggtcatatgttaatactgtatttagttttttgaggaattgccatactgatttctatagtagtggtaccatttacattccaaccagcagtgttcagggttccaatttgttaacattcttgccaacccttgttgttttctggattttttttattttggggttttttattttatttatttattttttttttgaggcagagtctcactctgtcacccaggctgaagtgtagtggcgcaatctcggctcactgcaacctctgccccccgggttcaagcgattctcctgcctcagcctccgagtagctgggactacaggcgcgcgttaccacgcctggctaattttttgtatttttagtagaggtggggtttcactgtgttaatcaggatggtctcgatctccggaccttgtgattcacccgcctcagcctcccgaagtgctgggattacaggcgtgagccactatgcctggccattttttatttttaaacaatagccatcctaatgggtatgaaataggttttttggtgttttgttttttttttttgagacagaatcttgctgtgttgccctggctggagtgtagtgacgtgatctcggctcacctcaacctccgtctcctgggttcaagcacttctcctgcctcagacttccaagtggctgggactacaggcgcccgccaccacacccagctagtttttgtatttttagtagagatggggtttcactgtgttggccaggctggtccacgatccatccaccttggcctcccaaagtgttgggattacaggggtgagccaccatgcacagccagggttttgttttgttttgtttttactatttttttttttttttagagacaagctgtctcccaagctgtagtgcagtggcaccattcgtatctcactgtaacctcaaactcctggacccaagcaatcctcctgcctcagccttccatgtagctacgtctacaggcatgtgccaccatacccggctaactttttttttttttttttttttgagagttttgctcttgttgcccaggctggagtgcaatggcatgatcttggctcactgcaacctcctcttcctgggttcaagtgattttcctgcctcagcctcctgagtagctgggattacaggcgcccgccaccacgcctggctaattttttgtatttttagtagagatggggtttcaccatgttggccaggctgggctcgaactcctgacctcaggtgatccacccaccttgacctcccaaagggctgggattacaggcgtgcgccaccacacctggcccccagctaacttttaaatgtattttgtagagatgaggtctcactgtgttggccaggctggtcttgaacttctgagctcaagtcattctcccacctcggcctcccaaagtgctgggattacaggcatgagccaccacacctggcccctttgcccattttaaaaattaggttgtttttgttgttgttgagttgtaggagctctttgtatattctgcatttcggttccttattggatatgtgattggcatacattttttcccatccatggattgctttttcattctgttatagtatccttgattcacagaagtttttaatattgatgaggtcctgcttagtctgtgttttgttttgttgcttgtgcttttggtgttatatccaagaaatttttgccaaatccaaagtcatgaagctttgccctctgtttccttctgagttttatagttttaggacttaaatttaggttttcgacccatttttagttaatttttgcaagtggtataagggaggggtccagcgttattgtttcacgtgtagatatacagttttctgagtaccatttgatgaaaaggctgtccattgaattgcttttgcaacttttatttgggcatatttatgtgagtctgttactggttctatattttactccattgatctatgtgtctattcctctgctaatactgtcttaaatatggtagctatatagtaagccttaacactgagtagatagatttctcccctttttttgttctttttcaaaattgtcactggtttgtttttattttttactttatgcagataatctgtactatactttggtttcatgtatcaagtagtttgttccaagttgtgctttaagcagaacaaataaattttcatattgttctttgtgttaatctgcaatataaacctataccaaattctattttgtgtatttgtttattgtagtaatctgactgactcttttgcctccagactcatctctttcaaggtccccaactgaatcttgttttaggtggaacttagaagcagtagaagttaagaatctatttcacagccttagtagtctagtttcattctctatataatgttgtctatgcaagtgagctgctctccagtgccttagtttcactaatgttggggaaggtctcttctcttgttttggacttctctatcacattgcctttctcaagagaagacatataatgaaagttgatatctggtgttctaggacttcttcagaagcttgccagtttttcaagctgatttctctcactggcaactcttcagagtgctgttcctactccaccctcccctggtggtatgtatcagttttctactcatcagcacccacctactcctgcctactgtgtttctcagatgtctgctgcctggctagctcattgctgcttttgtcactcatagagctgtcttcttccctttttttggctttctgcctgacttccagggcagctgctctgtcattgcctgtctgccattctgtcttttttccccctaccccccacagatacaacatctactctaataccacacattctccatgttcaaactaacctcatcactttccccaccacattccccaaaactggtcatcctccagcttatagcattgcagttcactgaagttagacatctgggccttgcttacctccaacatctcattagccttcgattctacccctataaatcctcttctcagtctcctttagatattcctgccctgctgtgagatccatctggtttattggctagattacttcagaaagcttcagtcagtgaccctccttacttcaaaccccaccagttgatccttcactctgccatcagtcattgcttctaaaatctaaattgttccatttaaccttgctgtgataaaacctttggtagttcttcagtgtgttcagtggtaagttaaaactttcactgtaatgtacaggccccttcatgatatgatcgctgcctcctcgagcctcattgtgtgcatttccccgccccaccctttcctcacccaccctagtctttcatgtctgccatttttacattcatttagcagatatttattgaagccccctgtgatgtccttacctaggtctttcttgttgccaggaccagacaggctttttcaagcttccaagtcatctcagtttgaaagactatgtctgacccttgtcttggccaattactctttatccttccaagttcaatgattgtcccactgcactccaaccagagtgagagagcaagaccctgtctcagtaaataaaaataaataaataaataaataaataaataaataaatcagccataatttatttaatcatgtctctctcccccattgatagacgttaagggtatttccagtattcttctcttgaaaacaatgctacattgaataaccttgtacatgggtcactttgaaagtatggatatgtatccgtggaataagtttccagaagtggaattgtgtcagaggggttgtgcatttgtaattctgatgaatatttatagattatatgagagtacctgtttactcaaactcttgccaatgcagcattatcaaagttttttatgttcgccagtgtgatagattaaaaaatggtatctcagccaggcgcagtggctcacgcctgtaatcccagcactttgggaggctgaggcgggcagatcacggggtcaggagatcgagaccatcctggccaacacagtgaaaccctgtctctactaaaaatacaaaaaattatccaggcgtggtggcgggcacctgtagtcccagctactcggaaggctgaggcaggagaatggcatgaacctgggaggcggagcttgcactgagccgagatcgcgccacaacattcgagcctgggcgacagagcgagactccgtctcaaataataaaaaaaaaagatggtatctcagcattgatttctttgatcatcagtgaggttgagcatcttttcatagatttaagagaactgtatggttttttgtgagttatgtttcatatcgtttacccattttacttttaggctggaagcagctgttttagtggaatggtggaacaagaagccagattgccatggagagacaactctttctagagatttggctatgaagcagagtagagacaatgatagctgaaggattgatgtagatgcaaagaaatttttcatcttctttgaaaacttaattgtgttaaaaactggtatgaaagggaggggttaaagctagagatggtggtagaaaaaaatgcagggttcctaaaggactgagattcctggatggaatttcagggaaggggaaaatttctggatatagtgactggggagttaagggtgtctagtccaatggcttttattttcttggaagggtaggcaaggccaacagccacatgtgtgggaggagatggttagaggggagaggaggtttgaaggcaccgctatggagaattggagagagctaaggaaagacagaaagactgcagaaagtgcttagggttccactgaagcggaaatagtgatttgtagtgatacaacccttatgagttatttgatttttttttttttttaagcagcatctggcagtccaagtatagggctgacagtttgggatttttctttccatgttggtgtaaaagaagaacagtgtagtgaaggaagttaggacaaaagaatgattgaactgacaccaagttttcttgatttggtagaaaaggaaataaagatagagcagagatattgaaaagaattagagaggggttcaagagactgaaggcctgggtgaggtcagagagcaggtgtggtagacataacagagagaactacaaggatagaaagtgtggttggagagtgggaaggcaagatttattcagtatgggggcttttctgggtgatgacagcatctggagtacagccattgtcgtgagtggcccaagtgtagcagagataaagcgttgttggagtgaaggaagtcaaggaactgagaggctggcctagatggggattttggttgtcatccatgaggatattgaagtcatccaggagaatagcaggcctgggggacaggaaggaaactgagccacttacagtgtcttcagtgataggaaagcacagggcaaaaagctttcaagaacagggactgttaagccgggtacagtggctcacacctataatcctagcattttgggaggccaaggcgggtggatcacttgaggtcaggagttcaagaccagcctggccaacatggtgaaaccccatctctactaaaaaaaaaaaaaaaaaaaaaaaaaaagaaatacaaaaattagccaggcatggtggcacgcgcctgtaatcccagctacttgggaggctgaggcaggagaattgcttgaacctaggaggcggaggtggcagtgagcctagatcacaccactgtactccagcctgggcaacagagcgagactgtatcaaaaaaaaaaaaaaaaaaaaagaacagggactgttagagcaggctccaggagaaatgctttgcatatggcattcttgaggagtgaggaggacctcaaccctacttcctgaaatggagctctgagatgttggagtagaaatttggaaaccagagagagaagtaaggatagtgttgttgcaaatgcattgtatatggggggtcgggaagtcacaggagtttgcctcaaagtctttctcggagacggatgaggttttcactgtgattttcctggtcgtggtctatggatatagtacctgttagtgacatggatcttcttaacttctgatgtgtcttttcctccctagtgtacgcataccaattctctccacagcttccatcaccatgcatttgttcttttcccttgttcttgtattacctttctggaaaggaatttttattgtaggctaattgttactcccaccagtatttaaccactggatatttcatatgattgatctcttctgatttggaaaataaaaatgtaatctcattatattcatttgattagtggggacagtcaacacttctttgtgtattttcttagctgttcgtttttctcgtctgtaaattatctgtttaggtccttcagatttttcaaaattggactgttatgttttcagtattgttatgagttcttgtttcaattatttatgacagttcattttcttttttaaaatagactttttttttcttagagaaataagaaaaaataaaaattaaaatagactttgtgttttagagagtttcaggttcacagcaaaattgatcaaaaagtatggagagttccggccaggcgcggtggctcacacctgtaatcccagcactttggaaggccaaggtgggcagatcacaaggtcaggagtttaagaccagcctggccaatatgatgaaaccccatgtctactaacaatacacaaattagctgggtgtggtggtgcacacctgtaactgtacctactcaggaggctgaggcagaagaatctcttgaacctgggaggtggaggttacagtgagccacagtcatgcccctgcactccagcctgggcaacagagtgagactccgtcctaaaaaaagaaagaaagaaaatatagagcattcctaaataccacctgtccccaacacctgcacagcctcctcattatccacatcctacaccactgtggtacctttgttgcaattgatggaccaacattgactcctcattatcacccaagctttggtgttgtacattctgtagatttggacaaatgtataatgacatgtgtctaccattgtagtatcatacagaagaatttgactgccctgacagtcctctgctccacctgcttactcctctctcccttttcctaactgcacaaccactgattttttttttttttttttgagacggagtctcactctgtcccccaggccggagtgcagtggcgccatcttgggtcactgcaagctccacctcccgggttcatgccattctcctgcctcagcctcccgagtagctgggactacaggtgcccgccaccacatccggctaattttttgtatttgtagtagagacggggtttcaccatgttagccaggatggtctcgatctcctgacctcgtgatccgcccacctcggcctcccaaagctgggattacaggcatgagccaccacgccctaccttttttttaaaaaacaaggtcttgctctgtcacccaggcctgagtgcagtgatgatcactcctcactgaagcgtcgacctcccaggctcaagtgatcctcccacctcagcctcctaaatagctgagactacacacacacaccaccatgcccagctaagttttgtattttttatagaaatgtggtcttgctgtgttgtccaggctggtcttgaactcctgagctcaagcaatttgcctgccttggcctctcaaggtgttgggattacaggcatgagtcaccgcacctggccttttttattttctttttttttttttaaccagtgatcttttactgtctccatggtttttcacattggcttctgtcacttagtaatatatgtttaagtttcttctacgtattttcatgtttttagcttatttctttttagcagtgagtaatatttcattgtctggatgtgccatcacttatttatccattcgcctgctgaaggatatcttgattgctcccagtcgtggcaattataaataaagttgctgtaaacatccatgtgcaggttttttttaagtggcataagttttcatctcatttggttaaataccaaggagcacaattgctggatcatatggtaagagcttatttatttttttgagagactaccaagctgccttccaaagtggatgtaccattttgcattcccaccagcagtgaatgagagttcctgctgctccatattcttacaaacatgtagtattgtcaaatgttttggattttaaaaccaaaatccattttcatagatgtgtagtggtatcccgttttaatttgcaattacctaatgacttgatgttctgtgtcttttcagatgcttatttgccgtactgtttatcttctttggtgaggtgtctcttcaggtcttttgcccatttttaatctggttgttatttttcttgttgagtttaagaattctctgtcctttgtcagatctatcttttgcaaatattttctcctagtctgtggcttatcctctgattctcttggcattgtctttcacagagtagacattttatattttaatgaagtccagactatcaattatgttctcatggatcatgcctttgatgttatatctaaaaagttctcgccatacccaaagtcatctagattttctcctgttatcttcttggcattttatagtcttatgattgatatttaggtctatgattcatttttagttaaatttttgtgaaagataataaggtctgatatggattaatttttctatatgtagctgtccctttccagtatcatttgttgaaaagactatcttgctccattttattgcctttgctcctttgtcagttgactatatttatgtgggtctgtttatgatctctgttccgttccattgatctgtttgccttttcttttgctaataccacagtcttaattaccatagctttaaagtaagtcttgaagtccaatagcattaatctttgactcttctttaatattgagttgccccttcagaatcttaatgtctctccatgtaaactttagaatcagcatttttatattcacaaaataacttgctgagattatgattgagattgcattgaatctataggcttatttgggaataactgacatcttgacaatattgagtcttcctgtccataaacattatttatgatgggcttcttctttatgtttaggagcttttgttttttctgtcagatattccacttctacctttatgatttcttaattgccttttatgcttagaaagtttttcctcatcctgagctcacatattcatttattttcttttaaaatgtgttttcaagcatttaatttttaaacctatgtggaatttattttggtatatggaatgaggtggtggtctaactccctcctctcaaatatgtagttatttttcccaaaaccattttctattaatttatcaagaatagacatgtatacatatacatatataatagtcagccttccacttgttgtttgacccttgtgaaggaaattgtatgagtttccaattttggattaggctcaggtagtaattgagctgggttctgccagagatccatgttaattcactatccaaacagagttataaaatgtaagttttatgaaaatctaacagtatatcactggtttaatgatcacagcctaggaagaatggggaaattgtcaaaatcttctgtggatgcacctgaaggccactgctgaacccatttccctgctaggcacggctgctggtaccaggggcaaactcctggagtatatatgaaccacctacatctccttctcttccccccctacccttgagattttcatgtgtcccttaaggatgtgtgtcctacttcccttggagagtcactaccacattgaacactttagactgtgagtcctgtgaagatggggctcatgagtgtattgctccccagttgtttctctagcactagctcagtatagggcataaaaatctgaatggatgaacaaaccactattactggtggggacatgctactatcttacatggttcgaggtggaataaaggttgagaacagctatataatgtgttccttgaagggcagcagtacatcagtgcaatcagcctaccttctccatacttctcactctgaaaactgtaaagctgcacctagcaatcaacttgggagctttaaaagggactgctccctagctctcacccacaaagctgtagtctagcacaggtgacttttttaaaaaagttttttggtccagatgtgatgactcacgcctgtaatcccagcacttcgggaggctgaggctgggaggtcacctggggtcaggagtttgagaccagcgtgaccaacatggagaaaccccatctctactaaaaatttgccgggcatggtggcacatgcctctaatctcagctactcgggaggctgaggcaggagaattgcttgaacccgggaggcggaggttgccgtgagccaagatcacaccattgcactccagcccgggcgacagtgcaagactccgtctcaaaaaaaaataaaaaaggagtcctattaagacttatttttacaggttggatatctctaatcccaaaatctgaaatgctccaaaatttgaaactttttgagcgcagacatgatgctcaaaaaaatgctcactgggacattttggatttcaaaatttggattagggactaggtgtgggagctcacacctgtaatcatagcactttgggaagttgaagcaagaggatcagttgaacccaagagtttgagagcagcctagacaacatagtgagacgccgtctctacagaaaattttaaaaattagccaggcatcgtagtacatgcctatagtcccagctactcaggaggctgagacagaaggatcacttgagtccaggaggtagaggctgcactgagctatgatcataaccactgtctccatcctgggcaacagagcaagaccctatctcttaaaaaaaatctgaaacactgctagtcctcaagataagggatagtcagtctttataaagactcaattagttattggatatctgaggaagcatgcatatcaggctcccaaaagatcattggtttaggcacacattttaatagcttggaaatccagaatactcttctggtgaccagctcagacatagtcctgataatataggacctcatctaacatgactccctattttccagataagcatggattcctggttcattcttgttctgctcggcagtggtctgatatgtgtcagtgccaacaatgctaccacaggtaaattgtcatttgataaggctgctatttgaaatgaaattttgctttcacatttaatgagccacatttgaaaaccgagatggtatttgaagaaaggaatataaaaattttattcaaagtgatggtaaaataggtgtcttcagaaatcttggaattgaatgctcagcattgtttttcatacatacataactgctttaaataaatcaaagagattatgtgttctttcctgaaaagtaaaataaattgttgacatttacaactctatatatggtttctgaggaactaagtgaagaatcttgtgtctttctcccttaaaccgtagtcctttggaggaggtaggaaaggtccagcatgagataaaaacgtagggggtgggtggtgttgagggggattggtctttgcttggtctccatatgtttgagagtttattaaggcttgctgctttgtgtctcacagctttttagcctcacattcttcatgtgctatttccttgttttttggtgtttgtagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtactagagatgattctgtttgttcttttgctctttgagtttagtcttccttttattatcttgtttgtgttttctagccttaaaatttcttcaaataagtaaaattgctcaagtgaagtaatgaaacctgtatgtggaatttttgggttagcatgagtgaagaggaaagaagaaagattctggagaatatctttctgctaggtgggatcctggttagattgagaggacttaaatgtgtttaaaggtagagaagaaggcttaaaaagacaagagaaatagaggagctcattgacgatgcaagagactgaagatgaaaagatacagagaatgagtaataagattaggtttggaaagggagggatccgtggagaccatggaaaggagaatgggtattgatgtccatgacagttagatgtgagatacagagaatgagtaataagattaggtttggaaagggagggatccatggagaccatggaaaggagaatggacattgatgtccatgacagttagatatggagtggcaggccagtggccaggggtggcatcaggctctgggaaatggttacattgcagtgccagttgttcagggcctcaggttgaagcagtagtcccaaggagaaaatcagagacgtggatctgagaccagggcaggtaagacaagtttctgacctctttgaaccttaggtaccttgtctgtaaaagaggattagagataccctcaaagggcttctatgaggagtaaaggaaataatcattacctgattgctatgtaactgtcatcccttttctagcaaaaatcactctttcctcttctgtgttcccagttagatggtgagtgcccctaagcagaatcacatctcgctcatgtggaacattcaggaactgtttgctcagttgattctcatttgttactacagatgatatcttttactgcgccttataactcagacccttcacctgccagcttttccccatattttctaccgtaaagacaagacagcatttgcagttaagagcacagtcttcagtgccacactgagtttgaatcccagctcttccataaaccagccatgtttatggcatagctggcttactttatctctctacctcggtttgttcatctgtgaaacaagaatgagtgatagtaatagttcttacctcatagaggagatattaggattaaacaagttaatatgggtaaagcacttataaaggtgcctacacatggtaagcactatttttaagtgtgagctgttagtattgttgtggttattgctctgatagttaccagtaaaatatatgaaggtacctttaatgcagatggcatcccactattcttgatgagataggggactgcagacaaataatgtctgatacttgctttgtgctttagagttaatgtagttttgtcatagttattactgtgtgctaggcatcgtactaagagttttctagaataatcctatgaattaagttctattttatgttttataggtgaaagtattttacaatgatgaaaccataatttgtggaatgtttttcagtgtacaggtcatgacacaattcatgaaatcactttagcaggccaccactagttgtttgttttgttttattttaatggatgatccagttccatgtttattcttttaatgttacatacaattttttgaaattttagtaacaacataaaatgttgggttgtggccattgcttagggagaaaggcaggataacttgtacaaactgtatgagtgaatggaaaaggtggagactgtaacacaggcctgactgactgaacagcccatgttctattgtgtactgtctttcatttaacagttctgtgacatgaccatggataatcatctccttttaacagatgcttgatttcagactgtatatagaggttaaatgatttgttttagatctcaaggctgacaaattaggcctatttctcacttttgcggtctttccactctgcttgtagggaacttagttttccataaactgacttaggtccaaattgtgccacagctaagaatctagttattgtacatttaacacagttcacgtcataggaggctgagactatgtttctctagtggcgtttattcaagatgagtaaaacacaagaaaccattatcgcacatgggaatttcatagtcttaaaccccacatcccacttatcaccaccatttaccagtcctcctgtaacagttacaattttttattaaatcagtatttgatgtatattattgtaattatgaaatattcattgctgagctataagtataaatggattgtttttcttgtacagttttttttctggatttaatacttaccttattttttgtttatttagttttctatttagtcaggccaggcacactggctaacacctgtaatcccagcactttgggaggccaaggtggacagatcacttgagctcaagagtttgagaccagcctggggaacatggtgaaaccccatctctacaaaaaatacaaaaattagctgggcatgggtgcatgtgcttgtagtcccagctactcaggagcctgaggtgggaggattgcttaagcccaggaggttgaggctgcagtgagctgtgttcataccactgcactccagcctgggtgacaaagcgagaccatgtctcaaaaaagttattgctactcaattcttaccatgctctccagagcctctcaaaacagctttctacaaagtgagatctgttagataatctatttcttttttacctctagaaattcctcctgagccctccattgtcttattccagtctaggcttgtcgatctctagggctactacacagatacatcagcctgagatttcccttctctgtcattctgggaattccccttgctgctgcttcctgacttccatattgtcttcctttttgtcttctcatcattcggtagattcctgagaaaaggggtccatgggaggcaaattgcatccttacatatctaaaaatatctttagggctgtgcatagaatttgaggaatatttttcccccagaatttttaaagtaatgccctaactgacacctgtttaccaggtttggaggattttactgctatcttaatccctaattgtttgtatgctttctaggatcttctctttatcatcagtatcctgaaatttcacagagatgtatcttgatgtgggtctttttcgttcattattatggatacttaataggccctttagagccttgatcttgcatttctgaaaattttctcccatttctttgaaaccttctccccctcttccttttttttttttctcaaattcttaatatttggatattggatgtatcctgaattaattctttaatctttaaaatttttcctttctgttgatctttgctttgagtctttttctccttttaaaaataaacaaaggccagctaggcacagtggcttatatctgtaattccagcactttgggaggctgaagcaggaggatcgcttaagcccgggagtttgagaccagcctaagcatcgcagcaaaacctcatctctacaaatgatttagaaattagcagggcctaatggctcatgcctgtggtcccagctactcagggctgaggcaggaggattacttgaggcctggcagttgaggctgctgcagtgagctgtgatcgcaccaccgtactccagtctgggcaacagagggagacctcatctcaaaaataaataggcctggtgtggtggctcactcctgtaatcccagcactttgggaggccaaggcaggtggatcacttgaagccaggagctcaagaccagcctagccgacatggcaaaaccctctgtctacctactaaaaataaaaaaattagtcaaacgtgttggcatatacttgtaatcccagctacttgggaggctgagacatgagaattgcttgaacctgggaggtggaggttgcagtgagtcaagtccctgcactatagcctggggaacagagtgagacccgagactctatctcaaaaaaaaaaaatcagtgacaagtaaaaaggtagaatacctttttttttttctttgagacagtctcaccctgtcgcccagtctggagtgcaatggcgcagtctcggcatactgcaaactctgccttcagggttcaaacaattctcctgcctcagcctcctgagtagctgggattacacatgcccaccaccacacccagctgttttttgtatttttagtagagacaggtttcaccatgttggccatgctggtctcgaactcctgacctcatgatccacctgccccggcctcccaaagtgctggtattacaggcgtgagccactgcgcccagcctagaataccttttaaaaataaataaataggccgggcgcggcggctcatgcctgtaatcccagcactttgggaggctgaggcgggcagatcacgaggtcaggagatcaagaccctcctggctaacatggtgtaaataaataggccgggcgcggcggctcatgcctgtaatcccagcactttgggaggctgaggcgggcagatcacgaggtcaggagatcaagaccctcctggctaacatggtgaaaccccatctctactaaaaaatacaaaaaaaaattagctgggcgtggtggcaggtgcctgtagtcccagctactctggaggctgaggcaggagaatggcgtgaacccaggaggtggagcttgcagtgagccgagattgcgccactacactccagcctgggcaacagagcaagactctctctctaaataaataataaataaataaataactccttttacaaaagcatatatattcattttttccatttataatataaataatagatatgctgagttgatttctgcatattgctttttcagttaccctatcatacttgctctttgttttagtaaagagctgctgtattgaaggatataccttaatctctttatccagtttccccatcagtggacactaagattgttttcagagtactcttataaacaatacagtttgtcatttcagacacatatgagaatattagcaggatgaattattttaagtctgcatttataaatttatggatattgccacatttacctctgctaggaagtctattcctattaacaatatgtcaaagtgcctatttttctaaactctcttcagtgtggtgaattgttaaacttggggatctctgccaatctgacaggtgaaaaataacatctcagtgtaagtttaatttgcattttgctgagattgagcaattttgtgtaatttaaaagatcatttatttttctgagcattctctgttgatattctttacccatttttattagagtgtcaaggttttcctgactcgtttgtagatgttctttgtacgtttgggaaatgagtcctttgcctatggtaaaactgcaaatgttgttccctaggtggtcatctagattttctgcattgcagaagatatcattagctatttttaatttttttaatttaaatatttctcagtttaggttttctaggaattgggtcatatctaggaaggctttccttactccaagattataaaaataattttcttctggacttctatggtttcgtgtgtgtgtgtgtgtgtgtacacgcacttaagtctgtctcgaatttattctgatgcagagtgagctatggatctgtttttccccaaatatctaacttgtcccaataccccttaataatttatttttcctcattgatttgaaatgccacctatcttatatattgaattcagatatttatttacctcttcatatgtatttgagtatttgggaacattcattttattttctattaatctttttctctgtccatgtgcaaagcctcactgtctcaataattgtaactttgtaaagtatttaatatccagtaaaatgagtcattccttgttaattttatttttcagaattttgttagcaattcttattataaacattagaattaacttgtctagcaggaaaaaaagtttgtattgatcatgttaaatacgtagattaacagagaaaatggcatcttacagatgttgagtctaactatccaagaatgcaatatattccattttctgaagtcttttttttttaaatcttctgtttttgtaattataaatggagcattttcttccatcagatcttctaactggctgctgttggggatatgaaggctactgatttttgtagagacattttgtactggccaccttaaactctcttagtattggaagtaattttcttcattaatttttatggcttcaagtcatctcatctgcatatatcttccaaatttttagaactttctttttcttctgtttaatcgcattgatgaatacctccagaacaaagttaagcagctggtaaatgcagacagcattctcttgtatctgacactaaggaggacactttcagtggtttttcattatacgtggtactgactcttgagttgagataaacatattttattgtgttcaggatttaatgagcgtttatgttaggaatgggtgttaaattttgccagttgcctgttcaggatcaatgagaaagatctgaatgattttttttctcttttggtctgtttctatggtggattctattcctaggtttgtttgtttgtttgtttattttgagatggagtctgttaccaggctggagtgcagtggcgccatctcagctcactgcaacctccacctcgcgggttcaagtgattcccctgcctcagcctccgagtagctgggactacaggcacgcaccaccatgcccggctaattttttgtattttagtagagacgtggtttcaccatgttggccaacctggtctcgaactcctgaccccatgatcctgcctcagcctcccaaagtgctgggattataggtgtgagccactgcgccctgccagtttttatttattcattttttagagacagggtcttgctctgaattaattctttaatcttcttaatttttcttttctgttgacctttgctttgctttaagtcttttcctttgagtcatccaggctgaagtacagtggcacgatcatggctcactgtaaccttgaactcccagacttaagcaaaccccacctcagacttctgagtagctaaggactataggcgcatgtcaccacgcccagctaatttttaaattttctcagaaacagggactcactgtgttgcccagactggtcatgaactcctggcctcaagcagtcctcagccttagccttccaaagcactgggattataggcatgagccaaggccgcccaaacatattgtatcgttcctgtaacaagctgttgcagtctatttgatattatttcttatttttttcatttagaattttctctgtctagatattctcaaattatctctaaatgagattgatctatgtttttcctttgtgtgtgtattctttttgataagttttagtttttagtgttttgttttgctacatggaaaggatttgaaagtttacactaaaaaatatgctttttttttttaagacaggctttttcactgttgcctagtgctggagtgcagtggcatgatctcggctcattgcggcctgcacctcctgggctcaggtgatcctctcacctcagcctcccaagtagctgggattacaggtgtgttccaccatgcccagctaattttttgtatttttttgtagagatggggtttcgccatgttgcccaggctggtcttgaactcctgggctcacatgattctcctgtcttagcctcccaaagtgctaggattacaggtgtgagccaccacatctggccatttcattcatgttttcaaatgtatttgaatgaggaaaagttctcccttgtgattatttattataatagcctacagagctattaatttttaaattttgtttactttatgtctcctttttttttttgtttaggctgaataaccatttatttcataggtttattgccttttttcttccaaagaacttgctattgtgcatttatagtccttttatgtttacgttttctatttcattgatttttactttctaccttctttagatttattttgttctttttctatcttcttgaattgagtgtgctttaattgcattctttccagttaattaacatatttagtgctgtgaattttgaacaagcacagctttagccacatcccataggtgtttctataggcagttgtattaggatgcgctataagctgctctgacaaagataccaaaattcagtgacttaaataagaccaaagtgtctttctctccccagttacattccagaggtagacagggccttcgtctcagtagggaccaaattcctttcctcttgtggccctgccatcctaacaatattgcccttatctgtttggttagagatagttctcaccattgggttctagttccaaccactgcgaaggacaaacaaagggaataggggccatttctcttccaaaagatgtgacctggaagttactcacattgctttagctcacatcccgttggctagaattcatcacatgaccacacctagcacaaaggagtctcaaatatagtctgccaggagagcttggtgctcagctaaaaaacaaaggttctgtatcaaggcaagaagagaaagagactgatctgaggggaggagagttggcaggttctgtcacaaaacttctcgtcattgttatttttaaggtatttttccattttgggttttttgtttgtctgatttttttttttttttttgagatggagtctcgctctgttgcccaggctggagtgcagtggcgtgatctctgctcaccgcaagctctgcctcctggttcacgccattctcctgcctcagcctcccaagtagctgggactacaggcgtacaccaccacgcctggctaattttttttttgtatttttattagagacagggtttcactgtgttacccaggatggtctcattctcctgactttgtgatctgcccacttcggcctcccaaagtgttaggattacaggcgtgagccaccgcgcccggccgtctgtttgatttttgagatggaatctcactctgccccccttctggagtacagtggtgtgatcttgggtcactgcaacctctaccctcccaggtttaagcaattcttgtgcctcagcctcccaaagtgctgggattaaagacgtgagccactgtgcccagcccattttggttttgatttttttttttctttgaaatagagtctcgctctgttacctaggctggagtacagtggcatgatctcggctcactgcaacctccccctcctgggttcaagtgattctcgtgcctcagcctcccaagtagctgggattataggcacccaccaccacgcccagctaatttgttttgtatttttagtagagacggggttttaccatgttggccaggctggtctcgaactcctgacctcaggtgatccactgcacccggcctcattttggttttgatttttattttcaaatgttttcttactttgtcaatttctaattttattgcattgggacaaaagaatattgtactctttctactgttggggtttataagggctgtggatatttcactcgcctttgaaaagaaggttttctctgttagtctgtagagtttggtatgtaccaattagattttattacttatcattttggtcttttgtatccttacttaattttgtcctcttgaattttaatggagcaaaagacataaagtcctctaataacatgcgttctgtttgcattctcatactttttatgaatattgatgctgcactatttgtgtacccagggagaaggccagaccactgtccaaagtttagtgaatctgggcagccttgtttcccagttgttggaggatgcctcatggaggaaagcattcctaatcctggagcttgttttgttgtactctaattgaattgtaatgtgtttctttaacctgaatgaatgtttctattttttacttattacacaggtaattctgactcgaaggacagaagaggtgagctgctcaccttatatctgttgttccttttacacagtgtacagtattcatttatttcctctgctcacagtctgtggtaaccgtgtgcatctgtggctgtgttgtttgtttactttcccttaagttatttccatgttaatctcatggagaagagcaatagaaacaagtactgtattcagtatgttttttaatatagactatggattctaacagctatgatgtattttaacaagtaacaaaatatatcttactttgacatgtcactttgttaacattactttttggtgatattaggtcataatttctataccattagttacttctgatttctaggccacagttccctttaaatattctttgtgttgtttttcccctagtgtataaaatgtcaaccctttgtggctttatatggattttatggattttcagcccttaaatgtaaagtctctatggcctgagatgttgtgtctgtggtttaagctggactgctgagtccctggtcactagagagtagggggacatgggtacttgtctgcagaagtgtggcacattttgcctagaatgacagtaaggctgctatcaaagagcatgagagaaagagaaagagatcatctaacattctaagaagtgattattacatttgagttttaaaaatgttactattcgaagcagtgtttttatcataattttctattttatcaaatcagacttgagttttttttctgattctgttatttaaccatacacaattttccctgtgtaattaagtaatggaacacttggaggcatatgaagtcccactaagtagggagcatttgagtcagaaaagtgggtactctcttcctttatgtgatgtccatctgccattgtatttggtaaggaatagtgaggtgttaccatactgtgtacagatttccctcacttttccacctctcactttcctaaacttgggaactaaacattggattaatacagtgtctttgctgttcagattcacttgccagattttatcaaatgtagacttaaataggttttattgtgatagatatttacttgctccctaaaactgctctcttaaccagccttacaataaagtcaaaagtcaaagtggtaggcttcaagatgaaacataagatctgttgactccttcctctatttagtatatattttcataatattcagccttttcttgccccagatatcatatctattttacctacccaatatttaagtagtttccatgttgtgattaagaaaacaaaattaccataattacctagattattgctaattgtgacatatgtaaagtctattaatgtaataaatctcctttcttaagtcaaaaaataattttgtgtaattccaaacaggaaactgaaaaggcataggtattctcagcagtctctaaagtcccaaaatctaatggcaattttaccagagcagatctttagaagtattgctataaatttggatatcccattctaattttaagccaaatgctttttgagaaataagccagctgtttggaaatgcttgtattataatcggtttgataagcagttatgtcttatgcagatgaattaggggctacctgtttttatgcactggtctttggggtgcttttgaacagtagtgtctgatgttttaattgtcaaagcaaaaagaaatgagagggagggcaacttttcttcctcttctgaagtccaggaaactggttattttctcatgcatattattttaaaatatattccagccaggtgcagtggctcacgcctgtaatcccagcactttgggaggccaaggcgggtggatcacaaggtcaggagttcaagaccagcctgaccaatatgataaaaccccatctctactaaaaatacaaaaattagccgggcgtggtggtgtgcgcctgtaatcccagctactcgggaggctgagtcaggagaattgcttgaacctgggaggcagaggttgcagtgagccaagatcgcgctcttggctgcgatccagactgcactccagcctgggtgacagagcaagactctgtctcaaaaaaaaaaaaaaaaatcagactcttaatatttgtaaagaagtagtccttgagctactacttaagtctagaaagagttgatattcttgttttaagagtgttagggcactttgggaggctgaggcaggtggatcacttgagcccaggagttccagaccagcctgagcaatatggggaaaccttgtctctactaaaaatacaaaaattaaccaggcatgtggtacgtacctgtagtcccagccacttgggacgctgaggtgggaggatcacctgagcccaggaaatggaggttgcagtgagccaagattgcgtgactgtactctagcctgggcaacagagcaagactctgtctcaaaaaaaaaaagggcggggattatcatagtgccattattattatgagtttatgatggctttctctaagcaccttttacattcggcatttattcagtacctattaagcatcaaggagtccagaaaaaattttatatataaatatatataaaatatgtaaatatatatatgcatatgcttccctatctcaggaaggaaatatgtgaacatcaggaaccgaagtctactcagttacatgccattggatatatcacacaaagtgctgagggaactcagaaggctcattatatctggggagtgggaaggaggcacagagatgtgctttgggaagtttaaattaaaatagcaaatggggaaaatgaagacacaccagacagggcacaagcaaagagacatgaaagagtaagtcatgtgtttgaggatctgtgcgcagttgacatgtgtgaggtgtggggagtgatcagaggtggcctcaacagaatgggtgtggtggtccactgagttcaggagttggagcatctcctgaagatgatggtgagtaaggaagtaacatagtcagattttggttttagaaagatattccagaggacttaggggagatagatggacaatagaaatttaggtttctgaataatttggctcaaaacaacggtgattgggctcaacccagtggttagattctagaggcaatccaatgaatattgctgtttttagagccaataggaaacatttaaaacaacattacaaccttgcctttgagagctgataaatacttgtaccaaaaagtgtggcaataggtaaatgggccataggaactggggctataggactatggctattcctttactgactagtttgtagttgaccagtgtgtgtctgaagtccttaagtcactcacctgtttagaggtgagcccttcaattaatatggccctttgttttcaaggaaagaagttatagcaagtaggtatctgttgtcccgggacaccattttagtggttttcattttcatgcttgctccctggcctgaatctagaaagtaaaactttgctggaatgaagttggggttgaaacagtttcggtttgtaaccatactgtctctgtctcatctactcagctctgcctttgtaatgtaaaagcagccatagatggtatgtaaatgaatgaacatggccatgttctgatagcattttatttacaaaaacaggcagtgggctaaatttgggctatagtttgccgacccctcttctaggcaaagaactgcctgagcgtaggaagctggactgaggttctctgctagtgtgtgaacttgtggatgccaaagccaatctcttcccttcatgtcagacactttgcaaatgttacctcttttagatctcccattaactctaaaaggtggagggtgctattatgcttccatttcatacattgttctaagagattatcacactactagtaagttaggatagtaggaatttgaacttcaggtctgtcagaccctaaaaccccatgccctggaaatggttttctaaggctggcctgtggttcgttggttgatttcaattagaatttaagaattttttcagaatacatctaggtgtaaagatttttttgtcaatattactccacaaactagattatttcttttggcctgataactcaggaactttcttgtattacttctctcccttcttactggtttcttctttggactctcctgttgcacaggtattggatctcctggacctatccagttcctttcttttctatgctgtcatatttttcatctcttattgctctgtgttctgggagcttccaggacagttgctctttcacacaactaatttggttttcagttatatcagttctcctatttagcctttctttttttggaggcagggctggggcagactcatgctctgtcgcccaggctggagtgcagtggcctgatcacagctcactgcagccttgacctctgggactcaagcgatcctccagcctcagcctcccgggtagctgggactataggcatatgccaccatgcccagctaatcaggtgtttgtttgtttgtttggtagagacagactaccagagtctcgctaagttgcccaggctggtctcaaactcctggcctcaagcagtcctcccaccctggcctcccaaagtgttgggcttacaggcatgagccaccgtgcccggccctgttaagcctttctatctagattttttccctcctaatcatgttggtgtttttttgtttgttttcatttttgttttgttttgttttgagacggagttttgctcttgttgcccaagctggtgtgcaatggcacgatctcggttcaccgcaacctctgccttccaggttcaaacgattctcctgcctcagcccccagagtagctgggattacaggcatgtgccaccacacctggctaattttgtatttttagtagagatggggtttctctatgttggtcaggctgctcttaaactaccaacctcaggtgatctgcctgcctcggcctcccaaagtgttgggattacaggcgtgagccaccatgcccggccagtttttaaagaactccttcttactactcagattactcctttttaaatagtggcttttaaaaaatatcaatgtaggctgggcacagtggctcacacctataatcccagcactttgggaggctgaggcaggctgatcacctgaggtcaggagttcaagaccaggctggccaacatagtgaaaccctgtctctactaaaaatacaaaacttagccaggcctgcagttccagctactagggaggctaaggtgtgaggatcgctcgaaccaggaggccgttgcagtgaaccaagatcacgccagtgcacttcagcctgggtgacggagtgagactccgtctcgagaaaagaaaaaaaaacgcaatgcagcagtggctcacgcacataatcatagcattttgggaggccaaggcaagaagatcacttgagaccaagagttcaagaccagcctgggcaacaacaagaccccctccccccatctctacaaaaaatttaagaaaaaaaatttttttaaatcaatatggcatcctgttgcacaaattgcagtatattttgaaagatttattctgtttcttttgtcacctccatttcccagggctactgttgctctgtttgagctatgccctggaccattgagtggcttagactgtgctcacaataggtgtcccttcatcccttcagaagacaaacatggacatacgtcctaaaccaggaaggggttcagtgatggctcaggaaaatcggggcagggtgcagttatcctctaggcgagctgccgttttctttttcctttcctctcttgtggttgcctagaattagcttgggcactactatggtttttttctgtctgcaggccccaggagaccttctgtggacccaatatacttaacaatcatatgcagtgtagacctgctctggtgtcaattctaaccaaaacaaaaaaaaagcatttatgagacactcagggaaattcaagcagtaactgaataatattagatgatactaaggaattagtgttactttttaaattggataatagtattatgtttatgttaagaatcttgatctcttggtgatacatacctaagtaattgcatttgaaatgctaggtctcggatttgccttaaaagaattcagttagaatggcgtgagtatagaccagtggttccttactgggggctatttcccccacaaaggcatttagcaatgcttggagatacttttggtcatcaaaattgggaatttgctacagacatctaataattagaggctagggatattgttaaatgtcctacagtgcacatgacagacccacataacagagaattgtatagcccaaaatgtcattagtgtgacgttgagaaaatatatatgcagcatatgttttgtaaaaaagaagcccttaccagtctctgtgacaaactctctactctgtgtagagcactgtttttccagctgagtctagatgggaagccccgcttgtcatttgggctgtgggtgtactggtgctgggttggcaggcctttgcttaagtaccatcctggtacctcaaggtccactttcaaccccagtcccaattccctctgagcttgaggtgtttccaggcccaaactggtagaactagtacttagttttcagctggaggctctttggctctgtttgatctcttggacatcgagtctggtctgttttgtcttccagaaatctctcaaagattctgatctacatatgccaccgtttgctgcctttcagatatgctgttgattcattagtatttttatatttcttctaccatgtcagtgtgctttgggggaagatgaagtaaattcatggatttagcccagtgtcttaagccaaaggtgcctaattactttcttcttcttctttttttttttttttttgaggcagagtctcgctccgtcacccaggctggagtgcagtggcacgatcttggctcactgaaacctccgcctcctgggtacaagcgattctcctgcctcagcctcctgagtagctgggaccagaggggtgtgccaccacacccgctaattttgtatttttagcagagacggggtttcaccatattggccaggctggtcttgaactcctgaccttgtgatccacccgcctcggcctcccaaagtgctgggatgtgcctaattactttcttataatacctgatatactgccccctgttgttggaatttaacaaagacatttagtgataaattactatttttttttgttctttggctcaacgtaatccattgtttgttttgtgcctgttatgtgtgagaccctgtgctaggttttaggtgtacagtgagaatgaagcagacatgtaatccttgctcttgtggaatttatgctataaaggagggatattcattaatcaacaaagtcaaatatgtaattataaagtgtgagaggtattatcaaggaaaataataaggtccttgccttacaaaaatagtataggaaataacagcaattttttttttttttttgagacagagtctcgctctattgcccaggctgaagtgcagtggcgcaatctcggctcactacaacctctgccccccaggttcaagcgattctcctgcctcagcctcctaagtagctgagattacaggcatgtgccaccacacctggctaattttttttgtatttttagtagagatggggtttcaccatgttggccaagctggtctcgaattcttgacctcatgatctgcccacctcggcttcccaaagtgctgggattgcaggcgtgagccactgtgcctggccgtaacagctaaaatgaagtacacactgtgtgctagttactgtgccaacaactttacatgaaagatctcatttaatacgcagaataacttatttcagaaatgaggaaactgagacttatgatcctaatttagtattaggaagtcagagaagacctgtgtgggaaaagtgacacacagagaaccagacaagtaggagataaccaggcaaagaacagagagaggctgtgtaaagcagaaggaataacatgctcaaaggcctgaggatgaatgaatgaaagcatggaaggacaccagtggctgaaattgagtgagcaaggaaagagtgcaagagatagggcaggtaggggctaaatcgagggggttgttagagtccaggataaggagattagatttcattctgaggcatgagaaactgttggagggttttacctaagagtgggacacaacctgagttgctttcctagagatcactctgctttgtggagaatggattggcaggggcagaggcttactgtgatccaggtgagagaggatggaggttgggactacactggtggcaataaaaaaaatgcaaaaaaaaaaaaaaaaaaaggcagacagatttgaagttttagatatatctccaaaatatattatttgcagctgtgctagatatagaagataagtgtgaggaagaaatcaagggggtttccacatttcttacttgagcaacagggtgggttggagtactagctactgaatggtgagggaaaggttttaaacacagaaagcttgtgttgcctatgaaatttaaagtggaggtggcaaataggcagttgagaatctggaactcagaaaagaggtctgatcaagcaaagcaactgtgggaattgctagcatggcatttatatttacagtcatctctctgatcagattaactagatatagagaagagtgccaaggacagagccctgaggaattcccacatttagagatctggtgttggaagaggaacagatagtgagggaaactgagatgggcagacgagatagaaggaaaatcagaggagtgtttcgttgtggaaagctaagagaggaaagtgcttcagagaggaaggagtgatcagccagtctgaacactcattttaaggtgagagccacataccacagtatgtttgaaacttaccattaacaaagaagcgtcatgtaatgtcttccatctctaaaaacaaaaccaaaaaaaacccatctgtccacctcactcacatctccctccatctgtcattcctttcctctgcatcccttaatgttaaaagtccccacgaaaggacccagtgtctcactgtcctttttctatctttatttcactccatttaggctttctcacccatattcaactgaaaatactcttggaaaggtcaccagtagccaccgtcttgtcaaatctggtttcacttctctgtctcatccttcttaagtctgtaggcagtatttgattgaattgattgctccctccttgaaaaactctgctcttggcttctatgacactacattcttagattaacctctcacctcatggctactgcttatgggtcagtttagcttttaacagaatgtaaatccagttatatatctcctctgttcaaagcccttcgatgacatagtgtttctcatcacactcagaattaaatccacaatcattacaatggactcccaagtcctaagtctgctggcttttgcccacctctctggcatcttatattgaactggcctttgtgctgtttcttgaacctgccaagctcctgagagctaccatgcttgctgttcccagtgtctagaaagctcttcacccagatctttgcgtggttcacttcacgttatttagagctctgcttgtatattacttcctcagagagaccttcccagaccactgtatcactgctccccaacctgtcactttctctctccccaccctgctttttattcctcatagcacttgtccctgtctaaaattaagtattgacttgtttataaacagtgtcttccttcctccccacagaatggaagctttctatcacttgtctccttgaacacttctctgttcctagtgtctcaaacaatggcatgcaattgctggcccacagatatttgaatgaatgctgctaaaaggttgaatcagatgaggatgggaatgttcctgttggatttggcaatatgccatttgttggtgttctggctgagcagtttaaacagagcactgagggtgggagtcagggcaaatagattaaggagaacctgaaggtaaggaattagacaagacgaattagacaactgtgtttcggaaagtcagctgagaagagagacgcgaggctggtggtagctgggggagggtaaatgaggtcaagaagacaagtctttgagttgacagcagtggatgtaatccagagcacacatgacaggatggaagagacttgtcttcccttttagcaggtaggaaaatggtgaagatagttaccaagccactctgatggtgtagttcatggagtcgggtggagggtgagagtggaggcggatgagtcagtgcctggccagctgcatgagaaaacaaggctaggtattgggtgaaagggagccaggccctgtggaatgaggtgggattgccatgtcttcaaaccagatgttgccatggttggggtcctggcaaaaggtgactaagggagcagggtgtggaaagaggaaaaaagaagcaaccagcagttttgttacatggtggctgaggatctaataatgtctccttgttttattttatttttatttagctggtctcaaattcctggcctcaagcaatccttctacctcagcctcccaaagtgctgggataggcatgagccgccacacccagctgtctccttgtttgtttgtttgtttgtttgtttgtttgtttgtttgttttgagacagggtcttgctctgttgcccagggtggagtgtagtgtacaggcccggctcactgtaatctccatctcctaagctccagtgatcctcctacctcagcctcctgagtagctgggactataggcgcacatcaccacaccggctatttttttaatttttagtagagatggagttttaccctgttgccaggctggtctcgaataccttggctcaagcaatccacccgctttgtcctcctaaaatgctaggattacaggcatgagccattgtgccctacttgtctccttgttttaattaggaacagtattctctgtgcccggaaaccatttgggtttatgataggaaaactgtctttttcccttcctctcccatcttcctctagatggaacccattgaggctgagagagtgtacagtgttggccctgcatacctaacttgccatcagaattgaatgtgttcatgcctccagatattccagtgctttttatgtgctaagtactgttttaggctcaaaggatatagcagtgagtaaaacaaagtgtctgcctttaaacagcttttattctaatgcagggagacagagtaaataaatgtatgatagtcagagatggggtgagcatgtcatcctgggccccatgctctctccccacctcacctcaatagccctggcatggcagtgggaggtgcacactcatactttcttctctgtttccatttcctggcatctgcagaaggactgaatgagctcttcctcttcagggtgttgccctgaatggctgacttaagccctccattgcacaacacagtaatgacttgttctgttgtcttgatttcagatgagacaccaattattgcggtgatggtggccctgtcctctctgctagtgatcgtgtttattatcatagttttgtacatgttaaggtgagcctactaacacttcacattctcttagattctgtttcaatatcccagtgtcccaatgaacccacacagtccagtagacagtaggatatacacaatgaataggatagagggggaatgacccatgatagtgctaaaattgaagttctacttagaaattatttaaaagctctacatagtcttccttaagtcctaagccctccctctttcttccatctgtccaagcccagtctcccaactccagtgcaagctaaagcccagaatggtagtttggaggttgaggtaagaaaccgcagtttgttattagtgacaggtgttacaggatctctaggtctagccctgctgaagcaacccctaaaagggccccagtaagattacatgctcaacaaaagcctactgtatttctggctggggctttgtccccagacccttctgggacccctggccctggcatgttgagttgagccatgtgagttgtgagttacaggatccctctttctaaccttctttcagggtcctctagacgttaccactcaagcagaagcaaggaaggggaacccaagggagagaagagggtggtgcatttattctcttcctgctaaagctactgccctgactaattggatttagccctgccttatctttggcctaaccaaagatgttctgtgctccctctgttcttctgcagggataaagagagaggaatcatgtgccccctataatttgtcatgtgtctctatcattctgcaggagacttgtggccaggactgtgtccacccaatccaaagctctgggcttctccctgggtctcccaggctacactgaggaaataccaagatttttgtttgatatatattgtctgtctcccccagctgtattccacccactcaccctctctctacctggtgtggctgtgctctgcagtgagccacatgagcctgaatatactgttggggttccctggttggattccagtgtgccaagggtaaacaggagtatcccgaggtactcggtcaccccagcatgctgctgcctcagggtgtgcatgacctgtctctaaaaaagcccgattatttttaaaggcgatttagaaaggctgaattgatgagcaggaatacagaggtgtgatttgcctctcccacctctgtgctccattcttcactgtgatcattttctcattaggtttaagaaatacaagcaagctgggagccattccaattctttccgcttatccaacggccgcactgaggatgtgggtaaggcattccttaatgtcatggggaaccttcacaaggaaggaaatcaagaaattaggagtttctccatccttttaaaagaataagacaataaaaagaggaaaaaagatttttgaagaaaacagtcctagttcttacaggcttggtccatgaggtagaaccccgtttagcctccagaagaggggctaggttctcagggtacctgactgaccttctcccttgtgtactgcagagccccagagtgtgccacttctggccagatccccaagcaccaacaggaaatacccacccctgcccgtggacaagctggaagaggaaattaaccggagaatggcagacgacaataagctcttcagggaggaattcaacgtgagtactttgttgaggctggtgtatcagcagggaagaaggcagacctaaagtcagacctttcagatctttggagtcatgaagtaaaaaatgggcttttaatgtttaagaggtgagaaatgttttaccaagtttatctgactccctgtatgatcatggataggaaatgaagtgagatttgcctcacctccctaatctacccatccattcagtcatcatcacatctcttacttcttttgtttaataaatacttagcaagcatctaatatttgtcaggtaatattctagttgccagtgatatgatgaggagcagaaacagatccaatccctattctcaaggaactcactgtccaggagggaaacctcacaaacaagaacaaatataactgtgtaagttcaaacagcagtacagcacatgaaggactggtgcatatttgtaggcatccatattaagaggttgcctttttgagtctagagcaggggtgtcagtgtttaaagtagacagtgggatagatcagtgtgggaaatgacgaccatgggagactgcagagcacaggtctcatcttgagtatttagattcacattttttataattcccacaaggaagcagaatatgtttttaatccaccagttggtgatcctagcctaccagttctgatcccagatcagaagagcttctggccagcacggtgactcacgcctgtaatcccaacactttgggaggctgaggcgggcacatcacgaggtcaagagatagagaccatcctggctgacttggtgaaaccctgtctctactaaaaatacaaaaattagctgggcgtggtggcatgtgcctgtagtcccagctactcaggaggctgaggcaggagaatcgcttgaacccaggaggcggaggttgcagtgagccaaggtcacgccactgcactctgacctggcgacagagcgagactccatctcaaaaaaacaagagcttcctcgaataaatgatattttaattgatacctaatcataggcaagggtggtggggacaggggattggggagccttccagccactggaaatagcaggagaattgtcaggagtgagtgtgctgaaggagggcacacccagaacatgacagggctgtgtgcagctgaagaccagagcttcaaaggaggataagaggtgaaactagtgtggccagaccacagaccttgcagatagtcatgagagaagtggcaagccatagagcagccagatttacatcttgaaaaaatgactcagctgggcacggtggctcacgcctgtaatcccagcactttgggaggccaaggcgggcggatcacaaggtcaggagatcgagaccatcctggctaacacagtgaaaccctgtctctactaaaaatacaaaaaattagctgggcatggtggtgggcacctatagttgcagctactctggaggctgaggcaggagaatggtcagaacccgggaggcggagcttgcagtgagccgagatcatgctactgcactgcagcctgggcaacagagggagaccccatctcaaaaaaaagaaaaaatgactctggcttctgtaaggagaatagcccatgggcagaccagaatagttgcgggaatacagttaggggttacaggtgttaatatcagaagtgctagtagattgacctaatgtcatgactaggaaatgggggatggatttaaggacacagaggagcagttccagagttggtaaatacatcagctggggcattgctaaaccatcagtttccttcacaactttccactaagccatgtgtcagctttgccttataggctggctccttttttatcagtgggaaaaattttcccaaaagcttctggagacttctcttgtcacatgctccttcttaaaccggtcgtgagcaagggagaaaataaggttactgtggttggctgagactagtccagattactcctgggtcaaggccaggcatgctagctcacacctataatcccaacactttgagaggctgaggcaggcagattgccttgatcacaggagttcgaaaccagcctgagcaacatggtgaaaccccatctctacaacaacaacaacaacaaaatacaaaaattagctgagcatagtggtacatgcctgcagtctcagctacttgggagatgaggtgggagtatcgcttgagcctgcggggtggaggttgcagtgagtcagattcactccactgcaccccagcctggacaacagagccagatcctgtctcaagaaaaaattttttttagatattcatgtgggatatggatggataacctcacagaataggaggtctggtaaaggaggaatggttattgggtcagtgggtcaccattcatatctgctccatgacagaagggcttagggggagtggtgagtgatgtcagatttgcattttgagaaaataactaactacaatatagagaatagataaaagggagaggcaagagttgaagtgggagaccatttaccaggcaagagttaacagaatagcttggaccctttttgggggctattggaaaaatagcaccatttaatgttcattattgattgataagatttaccacatcctgccaggcacagtggctcacacctgtaatcccagcactttgggaggccaagccaggcagatcacctgaagccaggagttcaagactagcctggctaacatggggcaatcccatcccatctctactaaaaatacaaaaattagccaggcgtggtggcacgtgcctgtaatcccagctacttggaagtctgaggctgaggcaggagaattgcttgaacctgggaggcggaggttgcagtgagccaaggtcgtgccattgcactccagcctgggcgacaagagtgaaactccatctcaaaaaaaaaaaaaaaaaatttaccacatctcacaagacagcactccagcctcagtaccatagctggatctgtgctaggcattgtactgttttgtaatctataatgccaactgcttctgggtgatggggtatgtgatcccattactatactttttttctgacaaattagttcttttctttttccataacattaaatttacataagcatgaaacgaattatttgtttggaggtaatattccctgagactccatggtaaggtatttcagtaaatccctggatggtgatggtattcctggaggcatgacaggtaaattcggatagatattgtggtgagagccatttgctgtgctaccatggcaaccgtgttcacgagctcattgggccagcactagggtagtgagggaaagggctgaccatcatcacctgggtttctagcaatgagtgccatcttgtgagcattcacatggaacataaatattttctttcttgtgctagttatccactacccagcgattggtttagatcctgacttccagtgagataagtggtgtgataatttgcttgaagttctcttcactaggagaatttctcttttatacacattcaaagccatcacttaagtagtataccccatagcagtctacttccagcccagcatgggccagcatgtttcaccaagcagtttatataccaggccggactttttcttcttcagttaactgttgatgtcaataggaagtcagaagtatctattgcggcagtgggttgtgtggtaggcattttatagagatcacttccagctgataatgggattctgctgggcatgtccaaatctatggctaattgaatctcataatacctagtttacgagaccggcccggtggctcatgcctgtaatccctgcactttgagaggctgagttggacagatcacctgaggtcagaagttcaagaccagcctggccaacatggtgaaaccccgtctctactaaaaatacaaaaattagccaggcatggtggcaaatgcctgtaatcccagctactcgggaggttgaggcaggagaatcgcttgaacccgggaggcagaggttgcattgagccgagaccacgccattgcactgtagcctgggcgacaagagcgaaactccatctcaaaaaaacaaaacaaacaaaaaaacccctagtttacgatggggagttgaagtcatttggatacctgtctgtgatcaggcttgcagtctctaccctagagcccagtactaggctaggagcatggtcttaccaataggatcatggtcttatatccatatccaaatattacgattcttctgtttaccttactacaaacactctagagctccatacaatctaccagagcttatttctctgtggcctggatcagcaggagcactttctcttttcagatcactcaataaattggtcagaggctgggcacagtggctcatgcctttaatcctcgcactttgggagatgaggcaggcagattgctttgagtccaggagctcaagaccagcctgggcaacatggcgaaagcctgcctcttcaaaaaattagctgggcatggtggtatgcacccgtagttccagctactggggaggctgaggtggggtattgcttgagcctaggagtttgaggctgcagtgagctgtgattgcaccactgcactgcagcctgtgtgacagagcaagatcttgtctctatgtaggtaggtaggtagattgattgattgatcagatggattagatggattaaattgagagatcagagttggatgcaaggataaggtatctgctgtctccaaaactcaaaatggcccagcaagcattgctcctctttgttagcaggagaggggtggtggggcaaggggcaacaagttgtcttttatgttggaggagataccctgacgtgctgcaggcctttgactttcagaaaatttggctgaggtggcaggccactgtatttttatgtctgacatgtacatctaagatacataacttcctgcttttcatgtctcacattgatgtcattagcatagttgtcaaggtaatgtcctgtgaaacagacaaaatcttgatgaaccagatcacaacacagaaaggtcaagatgatttatcactgaggctgctcttgccatgagcaagaaaaactgcttcaagtagtccacacaacttaaaaagaacacacacttacccctagcagtagtctaggtaccaggagttatatgttaatctgcagaaagtagagtacgtctggaaaagtaactgcaaatctgcaaagtcttctgtagcacttaagatcctgcggttcacatggagacttcgccttttgctaaagagatcactgctctaggagcttacatttgctctttctgtgatggttcttatccagtgggctagggaatctgtgtgtctttgggcattacctaatggccaatgttattgaaaatcaaggtggcacagagggaggtctagccaacttcacagagccgggagcatctagtttctttccctcccttttggaggccctgacagacaggcaggcaggcagacagacagatcgacagacaggtaagatagattagatagattaataggtcctaatgtgaagccacctcaggccaaaattccttccatcagctggcctgcaaaggctccgttctaactagcatatcttagcgacattctgagttcctagcaagtagctacctcaaggccaggacctagcagaccccaaaagatgcatttccctttacctagtacagttgccatggcaaatatctgcagattattaagaaaagatgaggagggaggtttataatatatgtgtgttaatgcgctgtggcagggttcctccttacagatgcctggcctccctgttattgaagggttctgggtctgaaatgacccaggcctacgagttggatgagggggccccctctctagcatggtggtctagtaggctgcctaaactgacctggaaagctactttccgtttccattactgggagcttcacaatgaattattcacagccataaacgtctgatcatggtctccaacagtctttctagcccacttagatcaggaatcccattttgaaatagtcccttccactagcatctcacgctgctgaggacagccaggaaagcacttctgaaagattccagtgctttcctcaccagtgtatagcctcagcaaggcatgtgatgtggatcccatcaagggcatactgaaggtgtcagtagaaggctgagcctttagagtccatatgccactctggtctcctctactttgtgcccaggtttttctggcttttcattatcacctcactaaatccagcattcagtccaggtttccactggcgagcctagctcaacattaaaaccatggccagttacctgagctgttacactacctgcagaagttcttttgaccataccataattagaaatttggctttatccaggctgggcacaatggctcatgcctgtaatcccagaactttgggaggctgaggcaggcagatcacttgaggtcaggagtttgagaccagcctgaccaacatgctgaaaccctgtctctactaaaaatacaaaaattagccgggcatggtggtgagtgcctgtaatcccagctactcgggaggctgaggcaggagaatcgcttgaacccgggaggcagaggttgcagtgagccaagattgcaccactgctctccagcctgggggacagaacaagactccatctcaaaaaagaaaagaaatttggctttaaccaagtcatactctcccttccttgttataacgtctccaaaatctatatcaacaattgttcctatcatttgtaatgatccagctcagtgaattcctgtagtttcttctggatatttattagctctttactttttttcccccgctgtagagacggggtcttgttgtgttgcccaggctggtcttgaactcctgatctcaagcagtcctcccaccttggtctcccagagtgctgggattacaggcatgagctactgtgcctggccagcattttacttttctaccttatttatgcattttaccctcaggtcatgttatgcttgcattctggtaatgtgtgggcaatgcaggctgggttgtggggcagttttcatcatgacagcaagatgcagtagagagcataatagagatttttggaaattaactttctttgggtcctctcttttatcatcatttctgttgtctcacttaaagccttatctttctcatgagcaacccaggaaagatgtgaattctgtggcattaaaattcagcaactcgcaaaatttggaaaccttaacatttcacttagcaaaatacatatatagtaatgtaaaggccctgagtcttgggttttcatttcaaggtgagcatttgatattggagctgggttatttcttgttttgttctctaatattgtcagaagtaatcctactccttggtttcaacatttcccctctccttttaattgggacacccctactcgtttaccaccagcttgaacacatcacaggtaattgcaagcaataactaaaatagtagttgtgcagctatgaactgtgagcagcttgctctttcccatcctggcaattggttgtcagtttctttccttccatctgaacccagtaacatcacccacgtttcccctagcagtctctcaactacaacccactctgatagtaattgctaaatcagttaaggtcctctagttaaaagcaagagaagtcacctcaactaaattaagcaaaaacaaacagaactattgatttgggaagacactggaggagctggcagaatcagaaggtaagttggagtaccaagtctcaggtagagccgaccttggtggctttggggcccttctagggaagcccctgcttcttcctagttttcaaaatcctgggagagaatctgattggctcagtatcagtcaggtatgactgtgtttggatcagtcagccctgggagagaagaggagaaataacacatagggcaaacaaaccaatttgtgtctactgtcatagaataatatttttagtaaccatcagatggggaaggcctttctaagctacttagaagatttagatgccagaatggaaaagtttgaaagatagcaaatatattaaaatgtgaaacatctttgtgacaaatgatgtcgtaaaaaagtggccaactgggagaatctatttgccataggtagacaaagaatgttccagaatatacaaacctgtgagtaaaaggtaaacaatccagtcaagaaactggcaatttacagaagaaatacagatggtctataaagatatgaaaagaagatcaactatatctagtaatcagggaaatacagattaaagctaaccattattttggacctatcagatttgaaaatttaaaaagctttatatcaaatgtggacaaaagtatggggctgcagagacttacaggtgggggagtttaaattggtattgcattggagggatgattctggcagtaccaatcattatttaaatgtttgagttttctgaccaagcttctgagattcttaacagaaaaagccatgtacaaagatgtttatgacagcattatttataatagcaaagaagataaaaacgcaaatatctgtcaaatagaatggccagatgatttcttatatccattatgatattctatactatcattaaaataaatgtgttcacatagatctctaagttatattgttatgtgagaaaacatatgtgggataatttcatttttgttttcaaaaatatgtatatctgtgtgtgtttgggtatgttaatgcttttttttttaagtctgaaagactacaaattgtcaacagtggctgcctacaagggggctggaagagaggagagacataatagggaactttgttttctactaaattatttgacttaaaacaagcatattctttttataatatttttaaagcagatttttttgaatatgggaaataaatctaatggacttagtttgcttcgatggatatataacatctagaataaagaagttcctatgcctagtttgaactgtgtcaggagtcttgtggtcaggtctctataaaaagggatatcaccaaatgggatgttgttctggagagaaactggaccatgggggtgaataactaaaggaacaacactcataggacatgacagctgttttcagatatgtgacaggctaaaaggagactgtagcatttccgtgaatgcccacctgattagaagttctaggctgtggctttcatcctaattacaagctggagcttttttgttcaccagcatttgtctttctaggaatcattgaatttattcaaaagaaatactttgaaaaaccactcagaagcccccattttcagggaaaattgaggtctttaaggcattatcaaggtttaaaaagaaacaaaaagataaaattgtgttagcttctggctgggtgcagttgttcatgcctgtaatctagcactttgggaagccaatgcgggaagattgaggccaggagtttaagaccagcctaggcaatgtagcaagaccttatctctacaaaacaattttttttaattagccaggcgtgatggcacatgcctgtagttctagctactcagggggctgaggtgggagaatcatttgagcccaacacttggaggctacagtgtgagctatagtgctaactttatagagctgcaggagctacagtgagctacagtgatcaccgcactgccctccagcctcctggctaccagagtgagactctgtctcaaaaaaaaaaaaaaaaaaaggcttagctcctgagaggaatgggataggagagaaagaaaagagggaaagaggtgaagccagtgaaatagtcagaatctgtgcgatgtgagatgtgaccttcctcaggacctcacatctcttagattgccaggtgaagaaggcatgtgtgtgtcactagtgatgggactgagtgtggcatctgagttgagatgggtgaaatcgcctctacattgatgagttgtcccaaaataagtgaatcagagtcacagtcctgtgggaattagcaggaactgtgacaagggctttggaattccactgtccagagagttgggagtttgcgttttgcaaggggcagaaaagatgcccgctgacatctgggttttacattgcttagtacgagggaaatgcaaaagaaattgtgtgtctgggtgttgggtcgttttaaacagaactgttccaagacctaccttggaaggtagtaaatttcccatcactctagtgttcagtcactggtgactattgggtgagagtattgaaaggagattcagacttaaaagtgaatgagattcagacctgtactggagatctaggcaagaaaagaaaggtataaggattgcaaaggaagggacaaaatataaatttttcacagaccaaatactgtcttcagaaaaacccacagattcatcagacatattatagaattaatatgacatattatattatagaattaataaatatgacatatttataatttattatatatgacatatttataattaataaatatgacattatagaattaatatgacatattatagaattaatattcatcagacatattatggaattagcaaggttgctagatacagaagcagcataaaaatttaatgcatttctatacataggccacaaacagaaaacctaataataccttttaaaaggtgccaattacaatagcatccaaatgtaaagtacctaggaatggatttaacaatttagagaaaattattaaaatgtttgaagacattaaaggaaaatagcttaaattagtgaagagataggatcaatggattaggaggctcaattttgtaaagatgtcaattctcccccaagatatatagattcaatgcaattccaataaaaatcccaacaggtttttttgtggaacttgacaagctgattctaaaatttatatggaggagaaaagattcaagaatagccaagacattcctgaagaagaagaacaaggtgaggagacctgccttaccagatataaagagattataaaattttagtaattaagacagttttgtattggcactgggatagacagatcgaccagtggaatgaaataaagagcccagaagcagatccatttgtaagtggaaacctatttatgacagaaatgctcttgcagtttgggtggggaaaagatggtcttcacaataaatagtgcctgggaccattggtaaccctgtgggaataaatgaaattgaatgcttgtcacatatcaaacacaaaaaccaattccagttgctgtaaacactgaaatttaaaggacaaaaatgataaaatgtagagatcataatgtagtaaaatatacttctgatctcacagtaggaaaggatttcttaagacttaaaatgttgataaaagggaagattgatgaatttacatgaaaatgcaaaacctctgttcataaatgataccataaagaagatgaaagggaaggccacaaccttggtaaaagataacacaggtaactgataaaggaagagtatccagaatatataaagaacttctacaaattgttaagaaaataagtaggctgggcgcagtggttcatgcctgtaatcccagcactttgggaggctgaggtaggcggatcacaaggtcaggagttcgagaccagcctggccaacacggtgagaccctgtctctacaaaaaaatacaaaaaaaattagccaggtgtggtggcgggcgcctgtaatcccagctacaggggaggctgaggaaggagaattgcttgaacacaggaggtggaggctgcagtgagccaagattgcgccactgcactccagtctgggtgacagaacaagactccattttgaaaaaaataatccagtaggacaacggggaaaccacttgactaggtacttcacggaagaggaaactcttttgaccagtatgctatggaaagatgatgaacctcattaataatcagagaaatgtaaatcagttaacacaaagtctgacagtagcaaatgttgataagcatacggaactggaacactacattgctggtgggagtataaattagtacaacttctttgaaaaacaatttggccttatctggtaaggttaaagatacctatacctgaaattcttgcacatatgcacaagaaagatacaaaaatgtgtctcaaagcaggacctttaactgtaaacaacccaaatattcatcagtagtagaatggataagtaaattttaacaccgtctcaaatggagcactacaaagtagctgaagttagcagccaggatgaatcttaggaacgtaatgttgagccaaagaaaaaagcaactcaccacttaatcatgattccattttcctcaaaaactagactagcaataataatacattgttttggatgtaaaaaatatgagatacaaataaaggaatgtaatgataattataaaacttcaggtttaccagtgagaggggaaggaagaggatataaggagaggagcccaaagagagcttctaagttaaattatgtgatggatactttttaaaaaataaatatcaacaaatgtgaaaaaaaaatttttttttaaccgacatgtctttaaaaaatgaatgagtacttagccttggttccagttaaggcttaaacaagagatgaaacggtcttcgatgccacctagtgtttctagagagtttaacattttatagacttctgctctagctgctccttcctagctctgtgagctaggtttttcagagtagaaaccaaaaggagtaggattcaccttgttttcatccgtgacgcaggctcttcattctgaacctttgcatctagcgctgtgttctccagggcaagccctttcttctctcttgttaaacaatggctcctgtttcttcctgactctttttaggagccttagtccacctggagacctagtttttctttatcatgactgagggagctagggatgctgatagggctgtgagatgtagtctttgttattcctgacatttttgtattgaagactgttttcaagagtcttgctgtccctacgtctgttctacattttagagaagggatgcacaggaaaactagtgcctctggattagccatcagggcttaaaaaactgacatctcatcctgccctgtacttgggtggaaacctgtggaaatcttatgtgaaggaagagaatgcaaactgtgggtgaactgagaaattctgatctaaaataatggtctctactgcgtgtgtaagagtccagcccaggaaaatcttttcttccttttgtggtattcacagcatagggtcaggggtaattgcctctgttagtaaaataacatgcagaacctccagggttttaatctgaaaggaaatctcttgagtaggtgagggcagatggattttgaggtcctaatttccctatctttgggtctttcactttaatttctcctatcactgtcatgctggtttccagtaaatatatttgctcctttcttaaagctcttgcttcccagcctgggcaacatagcaagatccacctctacaaaaataaaaattaaaaaattagccaggcatggtggtgctgtgcctgtagtcccagttactcaggaggctgaggcagtaggatacctccagcccaggagttcaaggctgcaatgagctatgatggcgccactgcactccagcctgggtgacagagcgagaccctgtctccaaaaaaaaacaacaaaaaactcttgcttccatctgacaaaaaattggttccctttgggttggcatttcctttattcagtctttttttaaattattatcaaagacagaaacgttcattcttcatttctgcctcttgctcttcccagtccacttttgccttcattccatctccaaatgtagtaatttttttttttttttttttttgagacagagttttgctctttctgcccaggctggagtgcaatggcgcagtcttggctcactgcaacctccatctcccgggttcaagcagttctcctacctcagcctcccaagtagctggggttacaggcatgtgccaccatacctggctaattttttgtatttttagtagagatggggtttcaccatgttggtcagctggtctcgaacaccagacctcaaatgatccacccgcctcggcctcccaaagtgctgggattacaggcgtgagccaccgcgcctggcccaaatgtagtaattctaattccagaatatgtctcaaatgcatccatttccttgtatcatcatttttccatgcttctcttcttgctcctctctagtccattttccatacaataacaagtaattctttaacatggaaaatggatcacactttaaaaaccttcaatgatttccttatgcacttaacataaaatttgaactccctattcaaggacctacctggaaatggatgatctgactttgccaggctcatctcttcctacttcctcctgccatccccatcaacctcaccttctgcgtgatacctgcactgattttcggttcctcacacaaccaagccttcttccacctctgggttaccacagatgctgttctctgtgtctggaatactattttctatactcatccttcctcagagagacccacctgtaatccaaatttggtgctttctgatacttcatctctagtagcattctgttctttgattgcattcatcatggtatataattatatatgtatttgttttatttgtttaatgtctgcttttcacccacaagtttatattgtccttgagggcgagaactgcacttatatttgattccccactctttgctctgtatctagcccagtgcctggtaggtacaaaatatatatttgttgaaagaatgaatgaaaagtaatgcatgaattgttcctctactgctgaatactacggttgttctcagttttgggtcattctaaataatgatgaagtaaataattaggacataaagatttttatttcctaagggtatgttctcaaaattgaagttgctaggccaaaaagtatttttgaaaagtttttttaaggctcataaaatgtaatttccaagtcacttactcggaattagtgttggaattttaaagtgcctccctttttgctttcttgtttgtttttatagtgtcagagtctcactgtgtcactcaggctggagtgcagtggtataatcatggccttgaactcctgggctgaagtgttcctcccacctcagccttctgagtagctgggactacaggcatgcaccaccatacctggctatttttttttttttttttttttttaatgtagagacgaggtcttgctgtgttgcccaggctggtctcaaacttctggcctcaagtagtcctcccacctctacctcccaaagtgctgggattacaggcatgagccaccacacccagctccttttttcatccttaattttgaatatatgaaacatacaagaggagaacagatcaaataataaaatttagcttcccactctgataaaactcatttatttgaatacttattctttgctacacatgagattatttccttatgtggcagatgttgttgttccaattttatgtatttatttattatttatttttgagacggagtctcgctctgtcgcctaggctggagtacaatggcgtgatcttggctcactgcaacctccacctcccaggttcaagcgattctcctgcctcagcctcctgagtagctggggttacaggtgtgcaccaccatacccagctaattgttgtctttttagtagagacagggtttcgccttgttagccaggctggtctcgaactcctgacctcaggtgatccacccgcctcagcctcccaaagtgctgggattacaggcgtgagccacttcacccggccccaattttacagatgaggaaactggacctagaaattttaacagatgtgctcaagttcatacaaacacagactatctcatgtcagatcattgtgtgataacctccctgcactaactaatctacatttgctccagaactgctgcaaatttaatgtcacctcacccaaatcttctgcttcttaactgctgcatctatatgaatgccctcccacccacccaccagtccttgcttccttgccacatgatgctagaggctggggtgccatgcccccttagatccctaggaagagattaaatcagctggccatccagaaccttcctgtgtggttcactctgagatgcatgtcatctttgtgtggtggtaattagcatgaggataaatggcccattccttcaggtatgtccccattccaatttacaagggtaggcccttttggcccagtatcataacaacaggctgctaaccacatagtaatcatggaaagagcatgctatacttacataacagaaagggcattctgccccctgaggattcttgtgttgttgaactctaaggagcttgtggctgtttcgggggagaggagcattctctgtgttaggctgcaggtattcacctgggcccatgtttttccccccaggaaaaggtagaacatgctaccaggtcagggtttggtgcagcagtttgcatgtttgatgtttatccctgctaataattcctctaatttctcttaacctttcaggctctccctgcatgtcctatccaggccacctgtgaggctgcttccaaggaggaaaacaaggaaaaaaatcgatatgtaaacatcttgccttgtgagtgtctttagtgtttcttgggatgtaacctgaaattacatctctggagggattttctgaagatggaaagaatcttgcaattgggcacagcagggtgaataacaagagtgcgttcatggcagtactcagtggctcatacctgtaatcccagaactttggaaggccaaggtgggagaatctcttgagcccaggagtttgaaactagcctgggcaatatagtgagacctcatctctacaaaaaccttaaaaaattagccaggcatggtggtgtgtgtctgtcgtcccagctactcaggaggctgaggtaggaggatcccttgagcccaggggggcagaggttgcagtgacccaagatcgtgtcactgcattctagcctgggtgacagggcaagaccgtgtctcaaaaaaataaagtaaaagaaatgaaataaataataataaataagataaataaataagagtaggttgaagactttgggctgaaagagcctttatggatcccacatactcagagtcaattaggatgatccaggaggatttttgtgtcaggcctaaagtttctaggaggtcctggagaacagcttcactaggatcaggcaggaagcagggggtaatggtggtggtagagatggttttttgtggtattcattgaaagaaattctaatgcagagttctctgtataaacccttcccagagttagccattgctaatcagttgatccataagctaacagacatttttctagtccattggtatccagaatgggatatgcataatttaatgagatatgagaggaagatgtttgaacctcacttgatttttatatttgcttttcaaaaaaaaaaaattcctaatcctcagaacctgtgaaaatgttttttttttaattttttgtagagatggtcttgctgtgttgccttggctgatctcaaactcctggcctcaaacagtcctcctgctttggtctcccaagtgttgggattacaagcatgagccagtgagcccagccagtatatttgccttttaaaaattcatccttttaaattttttatttcatttatttttttagagacagggccacccaagctggggtgcaatgatgtgatcatagatatgtatcctcgaattcctgggctcaagtaatcctcctgccacagcctgctgagtaactagaactacaggtgcatctaccatgcctggctgattattttttagacacagggtcttgctgtgttacccagcctggtctcaaactcttggcctcaagcagtcctcccactttgacctcccaaagaattgggattacgtgcatgagccaccacatctagaccctaaaaattttatatttcagggtatatcatacattagcatatgtgcataatttatcaataaatgagcatgtattagagatgcctgctcacatttttataagtgaagtatggaaccaaaaaattaggaccactacactatgcatttacagatacttttgtctttttcttttttctttctcgctctgtcacccaggctggagtgcagtggcacgatcttggctcactgcaggctctacctcctgggttcaagccattttcctgcttcagcctcccaagtagctgggactacctataggcacatgccaccacacccagctaattttgtatttttagtagagacggagtttcaccatgttggccaggctggtctggaactcctgacctcaagtgatgcaccgcctctgcctcctgaagtgctaggattataggcgtgacccaccatgctcggccttgtcttcttatttatgtgcacatgttggaggagggggatgtgtgtatgtgtgtgggtgtgggtatgtgtatatataatacatattttttaatatgattggtatactgtacacatttctctcttttaatagtatatattgtcagttcatctgtcaagaaactttcttttttctcaactacttagtattccacattgtagatgcatcttaatttatttaactagtcccctaatgatacttaaggtattcccaattttttgctgttatactgttggagttatattgttggagtggcatctttatacaagcgtgagtctgtgcacataggcacagatgtctcaactgtcctggttgcgtcaggttctgtgagaaataaattttgattttactgaaatattgttggtttgtttcctagatgaccactctagagtccacctgacaccggttgaaggggttccagattctgattacatcaatgcttcattcatcaacgtaaggatcgggtgctttccctgtcacttccctgcctgaccattgccactatctgttggctcctccccagctgtgtgttaggagaaatatttgtcatttcatgttttccctgacaagtctggtttttttaagtgactgaatttttttttaaggtcagtcaaatagttttaatcattttctatatttaccctgtcgtcattccctatggtttcccatgtagaaatctgtgtctaaatatgtattttgtgataagagtcagtgaatcctttattgagctgattctaattacaaacaaaagcaggccttgccctcaacagtaaaaataagggagaacaggacaagaatacctgacatgacaccagctatattatatatgtgtgtgtatgtatatatgtgtgtgtgtgtgtctgtgtgtgtgtatatatatatatatatgactatctggttagccatatatgaaccaaggcctgagggaagagctgatactaagaggaggtttttaaagatgatttagagaatgtttatagaacagtctgtatgagagatttgaggtttttgtttggttggttttgtctttggcagtagcctgaaaaaacacataaagagttaagaatatgttttataggtttgggggaagcatcctgtagagagagtgaatttgaacagaaaaaagagagagggaaagctggcaaaagcaagtctgactcctgatgcaaaatgcatgagaagactggataaaatttccacttgcatgtttatagcagcattaatcctaaaagccaggtgggagcactccaagtgtccattgacggatgagtgaataaattaaatgtggtacatgcatacagtggaatgttattcagcctttaaaaggaaggaaattctaatacatgctacaacatggatgaacctggaagacatcatggtaagtgaaataagccagtcacaaaaggacaaatattgtatgattctacatatagaatataaactatatatacatatgtagagtagtcaaattcacagggacagaaagtagaatagtggttgctgggggagggaggaatgaggagtgggtacagagtttcatctggggaagatgaaaaagttctgtagacggatggtggtgatggttgcacgacagcgtgaatatacttaatgctacagaactgtacacttaaaatggctaaaatcagccgggcacggtggcacacctgtaatctcagcactttgggaggccaaggcggtggatcacttgaggtcagaagtttgagaccagcctgaccaagatggtgaaacctcatctctactaaaaaaaaaaaaaaaacaaaaaaaaaaaaaacaacttagccgggcgtggtggcaggcgcctgtaatcccagctacttgggagattgaggcagagaattgcttgaacccgggaggcggaggttgcagtgagccgagatggcgccactgcactccagcctgggcgacagggtgagactgtctcaaaaaaaaagaagagtcaaaatggctaaaatcgtaaattttatgttgtattttaccacaagaaaaaaaaaggacactgatggagagattagtgtgaacataagaagggctgtttcttcctctgagagtgaagataaaggagaggacagaatggatagagacgactcgtaggtgtgggtaaagcaagttgaggcaactcacccgtgtgctcatggttgtgtactgaacaaatgagatgggactgtgacatgagagcttcgaaagtttagaacagcttctgaggtccctgagaaaaggataccaaagagagaaagcaaaggacatgtctagtgggatgtcattgatgggggtggggggtgctgagttgtgtgattttttttttcttcatctgcaccctgggattggtggtaaatgcagaggacatgtggtactcagacaaaagggaaggtcagtggctgcttcaagtagtcagccaagggcttcagtttcagtagaaaagaaaagcgttaggaagttgttaggaataaacaactattcctaaggtggtaggattgaggaactggagatcttgagaaagtgaaagaacaggaggttgtgtccaaaaaataggctattagatggacttcaaaaatggggcagtccgggcattctcactggagtgaatttgctgaagttcctgtatgtatgtttaacattaatggttacatgtttgtagttttaaggaaagggaccctgactagacaaataattgttgtagtcgataaggaaaatggagaaaggctagtaatcagcaggaattcctagaacttacatcgaagatcatgatgaagagattaggtggaataggttgactttaatgttatgcagaagagaagagcaagatcagttagtgtgtccagctgcgggtaagagaatactcaactaaaagttgtctagatgggaacattttttttttttctggagacagtctcaccccgacacccaggctggattgcactggtacgatcttggcttactacgacctctgcctcccgggctcaagcgattctcatgccttagcctccctagtagccaggattacagacatgtgccaccatgcccagctaattttttgtatttttagtagagacggtgttttgctatgctggccaggctggtcttgaactctgagcctcaagtgatccacctgcctctgcctcccaaagtgctgggattacaggcgtgagccaccgtgcccagctggaacatttatttgtctcatatactgtgaaagcaaatggagaccagttcttgagttggctgattccatgggtcagtgacatacttacaaaaccaggtgcttccatctttctactcagttatccttagccctgtcaacagtctcatggccacaagatggctgcagcagtcccaagcattcctcataaacacagcatccagccgggtgcggtggctcacgcctgtaatcccagcactttgggaggccgaggcgggcggatcacaaggtcaggagatcgagaccatcctggctaacacggtgaaaccccgtctctactaaaaatacaaaaaattagtcgggcgtggtggcgggcacctgtagtcccagctacttgggaggctgaggcaggagaacggcgtgaacctgggaggcggagcttgcagtgagccgagatcacgccaccgcactccagcctgggcgacagagcgagactctgtctcaaaaaaaataaataaataaaaaataaaaaaaataaacacagcatccagcacagaagaggaacatatctgcctatgcttttctctctgttagggagcaaggcttttcacggaatcctccccaccaccctgtcctcaggaccagcaggccaggattggatcacatgttcacatccctctctaatcactggctaggacattgagaatgatcatgatttacccctctgagcctggggaatgggcaccttccaagccagtgaaaggttaatgtccaaacaaaattgtggctctaatggcaaagaagaaagggaggaatggatttgagttagtaaccagcagcatctgccaccgtaaccagtttggtcccttcccacattgaaggtgaaaactgacaaaagttaattgtatgttaaggctgttaagcagctgagatggggatctcttcatggtaatggcacagtagaaagaaacagccttatcccttgaccatgtttatttagagcttacactagggcattccataatgccttgatggttattagacagttattagtaggcagagtttacatgaagagggttaaatgggggaccttatgaactcagtgaaggaacaaaagcagggaaaaacctgtggttaaccataagtgggaagcagggattaaagatttggatttcacagtttattaaactcagtcaacattttttgagcacctgctgtgtgccaagcactgtgggtaggcttaaaggttacagaggtaagatgtaatccctcatatactacacaggtagttaggttgtttcctgtaatgtgctacgtgtgcaaaggaggtattgccaggttctgtggagttatgagaaaaaacattcagcccagcctggtaacccagtagagctcattattgaagagtgagtcagagttcaggagaagaaagttgggcagaaacttcaaagcaaaggagaaacatgagcaaagtcacagagactagaaacagcagtcttaggttataaggtataagatgggaagtggtgggaaatgagacttgatcttgaaaggtagtggatgtcaagtgtgtccattggagttcttacttgcagactatagagtgtacttttcatccactcttttaagcagaaaggggtttattataagatactgggtaccttaacaaaacctggggaagagccagtgagccaagctcagatgctgctcagcaaagagcagagcagctatagatctatgcagcatgtgactgtcatagtgaaacctctgcacagtgctgcagaagaactggatgcttctactaccgtgcttgcccaaagaccagatttctagcacagtcgttatctcatgttgctcatttctaccccaagtcttgtgtgggagcatctgctaggaagaagctaggtctcgtggattgctgagctgctagggagtctgggaaatgtagctgtaagatagtcaagctagaagggagcaggagtgggtactaagtgaaccacctaatagtgtctgccagttttcagtacagctgagcggttttgatgaatttatctaggccgtggggtaccattgaaaagtgttcaaggcagggagtagtgtgaccacatttacatattgatcactggggctatcatgtacaacatggatttaggaggggccaattgggggctattgcaatagcaggtagatcacaaatgatgagggttgacaaggaagcggcgacaaagtgaaaactacgtggaggtagaatttagcaggaattggtggttgatttatatatgagagagtagagggtgatatatccatgtagatgtatccagcatacagttggtcatatctagagctgtggacttggaagtaataaaggagtgggccaagaacagagcccttgggcccacagcccctgccaggcacattgaacaggtgctcatgggtgagatggaaggagaccaagagaagagagcatctgagaaggcaaagataaagcatggctcaggaagtgtttggcagtgaagagggttatgtgcagattagagatcagtgggaaagaggaacagattttctttggacttagtgtgtagggcagcatcctttgctgaagcaaattcagaggccgtttgttgcatcctttttgtgggctgctagttaacacttatcaaaccctttttttcccctaacattgaggtataatatatataacataaaattcacccattttaagtgagaattcagtgattttttggtaagtttaccaagttatgcagccatcaccataaatgtcttagaacattttctaacaactttattgagatgtaattcaaataccatgtatttcacccagagtttacaattcagtgtttttttaagtatattcacatataactgcagcccatcaccaattttagaacattgtcatcccctcaaaagaagaaccttacactctagctgttgcccccttagttttagaacacattgctcaccccaaaaagaacctcagtgtctaaatacaattaatctccattctcaccccccggccatcacttaactttttgcgtagagaactgagaccacacacatggatcttgaagggaactaggcaccatggagtagtggtgaaaggcctaggaaagtggggtctgtagtttgggaaacacataggtcagctaacctaacactgttcacaggaggagatgaaacagaggcagtggcacagttggcaggtgggcttccagcctagagccttaggagaaaccagtttccttactcatttttagatgtctaagaatatataggatttttttttttttttgagacggaatttcactcttgttgcccaggctggagtgcaatggcgcgatctcactacaacctctgcatccggggttcaagcaattctcctgcctcagcctcccaagtagctgagattacaggcatgcaccaccacacctgctaattttgtatttttagtagagatggggtttctccatgttggtcatgctggcctcaaactccctacctcaggtgatctgcccacctcggcctcccaaagtgttgggattagaggcatgagccaccgcgcccagcctagaatatataggatctttagacgtgtttctttttagaggtaggaatgtagctaccacctagagcccactgagattcagctttcagaatctagagacatctcaggagccagggagccacatttcatctttcccttgaacagaacacaagatcagtggctttgcttcattctcattactctgtattagttaagcagtgccgccacatcactgtacaagcatgttttcaggaaggcatatgacgcactcctggtaagatggggcaggaagcactttggggctgggccttccaaccaggtgttcaggctgttcagggcccgcatgctgcaatgagaatttagcagtgactcctcatggagcaggaatatgatgcgcttaacgtattcttaaggacttctcagttttaattataagtttagtaatataagcagaatttaacatccagaattaaggctatttccatttccattctctaataaataaaaacatttgttgaaacttaaattgctcttctcaatgaaaactttaacaagtcttttgttgctgactaaacatatccatctctgaggcctaaagctttctccttctgtgttgggcagcaaccctgccctgcccttgtttgaactgaaattgaaagtggctcctcagaccaggcacggtggctcacacctgtaatcccagtactttgggaggccaaggtgggcggatcatctgagttcaggaattcgagagcagcgtggccaacatggtgaaaccccatctctaatttttgtaaaaatacaaaaattagccggccgtgatggctcatgcttgtgatcccagctccttgggaagctgaggcaggagaatcacttgaacccgggagcagaaggttgccgtgagccaagatcgcaccactgcactccagcctgggtgacagagcaagactccgtctcaaaaaaaaaaagaaagtggctcctcagatttaggccacttcttatatttggccactgccttgcagccttgtagttcacattgccaccctggtgttggtgtgacatggtgtcccatccctgaagctgcctcccttgttactcaccttattgctgtctgagaaaggaaatgggtgattcacaatccttaaatcaagtggctttctcttacctagaacttctgaattgaacatacatttaaacaatgacgttgaaaagatgtataactggagcaataaagactgaaaaagaaagctgcggccagttgttagtttttccgaggctccttatctgttgagtggcaccccaggctcccttgctcttgtcccccactgcctgtgatagagaagcctcttgttaaacactgggagctacttcaccacactcacaggctattcccagaaagattttgcacctgggtaaagcatccttgagaaaataacctgttttctttcccagagtgaacccagcttcatccctggaaccaccacatatgcttttcccctggtgggttcttaacctgttaacactgaaatctacattgttagctgctgataaagcatcagaaacatggtctaatctgggagtcagtatttggatttcttttttctttctttctttttcttttttttttttttttggagatggagtcttgctctgtcaccaaggctggagtgcagtggcgcaatcttggcttggctcagtgcaacctccacctcccaggttcaagcaattctcttgccttagccaccctagtagctggaattacaggagtgcaccaccacgcccggctaatttttgtattttagtagagatggggtttcaccatgttggccccatgctctcacactcttgaccttagatgatccgcccaccttggcctctcaaagttctgggattacaggtgtgagctaccacgcctggcctggatttcttattctagtatttattaataattcaatttgagaagactacctagactatttgagttttgtaatctctaattcctagctctaaagctaatcccttgtgaatatctagactggaaatccccgttaagtacctgcacattttcaggttttgttaactggttggagtcagactggagaatttcatttctattcatttttggttttctctttctttttctttccttccccacaccccagggctaccaagaaaagaacaaattcattgctgcacaaggtaaagtaatgacaacttttttctgttagatttaaccatgatcacataatgggtttggtttttttctcccaaatgctgagtggattaaccagaatgctgtagcttttctgtactttttaccacctgaaagaattataatccattatacaggtttacagctaacagccttcatcttgatgacttagtatccagggatccattaaaagaagtctttttgtgtatgtatattaaaaagactggaaaaggctgtatacacaaaacacagtctaataaggccctctgtccttggggctagttaaccttaggttccagccaggctgctcagagtttgaattaggaatcagtttccagagaggatcagccacctcacagggtccaggctggttctcccccagctcatgggcctgagcctcaccattattcacagatagttggtctaggaaccctcagatcagggacccagcaccatgtcctttatgtgttctacacacatttccaggcctgctgttctaacaactgtcttcactctttgaaccctagcaaaaatatctggatgtttgcagcattaaaaagtaattgaggccgggcagggtggctcatgcctgtaatcctaacactttgggaggccaagacaggaggatcgtttgagcccaggagttcaagatcagcctgggcaacatagtgaaaccccgtctctactaaaaattagccaggcgtggtggcacacacctgtgatcccagctacttgggaggctgaggcacaagaatcacatgaacccgggagccagaggttgcagtgagctgagattgcactactgtactccagcctgggtgacagagtgagactttgtctcaagaaaaagagtcattagggactacaagatttataaaaacaaagttctcctcccttttcttttcacttttttagtctaatgcccctggggcaaccatttttatctattggcttcttatgatagatgacatcatctgatccccttacagagcacctccccctcagtcagacagacgtgtacccacatatcctccccattctcccagaagagtcaaatcacaatttggggttaaggtatttattattattatgagtttacaaatattcacagccgaaacacacagtattatgttattttttgtatagtttttttcccccttcttttttagtcattgtgttttttatatacctactactgattttcctcccaaactctttaccagaagtatatatcttctctcagtacctttagatacatgaggtttaatttttttatcttgggatccttctagaatcttctttcttcagttgcattgtggattggttgctctctatcctctggcagagttatcattctaagaccagtaccctgggaattccgttagcctctctgctgtgttggatctcatttattttcctctgtttgcctctcatttttgtttagaattttctagtgactttccgaaaaaggttatatgggaggtaaattttgaattctagcctgaacaagtcatccaacctttctggggctgatgacacccacctcagagcataataggaaggagtaaatgccatatgaagcacttagctcactgtcaggtccataatgtaggtattctgtgagcagtcatgatttctaattcccaactgtaatatccttgggagacatcattcgtgttctgtttatatttttgacagccttccacccagccccatccttgtgcagtgcctggcacatacatggtagaaacatggaaaatactcaattagtaacggggtggatggatacatgggttagatatttagctggggacatttgggcacaagcttccaaaagtcaggaatggatgttcccagcctcccagcatctttcttcttggtgtatattctcttcatttttgctgttggctactttaggaccaaaagaagaaacggtgaatgatttctggcggatgatctgggaacaaaacacagccaccatcgtcatggttaccaacctgaaggagagaaaggaggtaagtggaaaaattggatgtgaacagcagaaggatcactctgcatataagctctgagtttaagcctggctgtctatcctttgtgggtgctgtaccagtagttcatccagaaagacacaggctgaagtctatcagactttgctatggcctggaagccccagatatgaacctcaggtgtgtgcctagagcacattccctgtatttggtagtcaaacaactcaccctggttccagaacagcctgaaagagactgacttgggccatcagctaaggaaaagccacagaggggttttttttgttgttgttttgttttgttttgttttgtttttttattgatcattcttgggtgtttctcatagagggggatttggcagggtcacaggacaatagtggagggaaggtcagcagataaacaagtgaacaaaggtctctggttttcctaggcagaggaccctgcggccttctgcagtgtttgtgtccctgggtacttgagattagggagtggtgatgactcttaacgagcctgctgccttcaagcatctgtttaacaaagcacatcttgcaccgcccttaatccattcaaccctgagtggatacagcacatgtttcagagagcacagggttgggggtaaggtcacagatctacaggatcccaaggcagaagattttttcttagtatagaacaaaatgaaaagtctcccatgtctacttctttccacacagacacggcaaccatccgatttctcaatcttttccccacctttcccccctttctattccacaaaaccgccattgtcatcatggcccgttctcaatgagctgctgggcacacctcccagacggggtggtggccgggcagaggggctcctcacttcccagtaggggcggccgggcagaggcgcccctcacctcccggacagggcggctggccgggcggggggctgatccccccacctccctcccggacggggtggctggccgggcagaggggctcctcacttcccagtaggggcggccgggcagaggcgcccctcacctcccggacggggcggctggccgggcagggggctgatcccccaacctccctcccggacagggcagctggccgggcgggggggctgacccccccacctcccggacggggcggctggccgggcagaggggctcctcacttcccagtaggggcggccgggcagaggcgcccctcacctcctggacggggcggctggccgggcggggggctgatcccccaacctccctcccggacggggcggccggccgggcgtggggctgacccccccacctccctcccggacggggcggctggccgggcggggggctgacccccccacctccctcccggacgaggtggctgccgggcagagacgctcctcacttcccagacggggtggctgctgggcggaggggctcctcacttctcagaccgggcggctgctgggcggaggggctcctcacttctcagacggggcggttgccaggcagagggtctcctcacttctcagacggggcggccaggcagagatgctcctcacatcccggacggggcggcagggcagaggtgctccccacatctcagacgatgggcggccgggcagagacgctcctcacttcctagatgggatggcggccgggcagagactctcctcactttccagactgggcagccaggcagaggggctcctcacatcccagacgatgggcggccgggcagagacgctcctcacttcccagacggggtggcggctgggcagaggctgcaatctcggcgctttgggaggccaaagcaggctgctgggaggtggaggttgtagcgagccaagatcacgccactgcactccagcctgggcaccattgagcactgagtgaacgagactccgtctgcaatcccggcacctcgggaggccgaggctggcagatcacttgcggttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtaccgtccagcttcggctcggcatcggagggagaccgtggaaagagagggagagggagaccgtggggagagggagagggagagctgttttgttttgttttttgagacggagtctcgctctgtcgcccaggctgaagggcagtggtgccatctcggctcactgcaagctccgcctcccgggttcacaccattcttctgcctcagcctcccgagtaccacccgccaccacgcccagctaattttttgtgttttttttagtagagacggggtttcactgtgttaggcaggatggtctcgatctcctgacctcgtgatccacccacctcggcctcccaaagtgctgggattataggcgtgagccaccacgcccggcccacagaggagcttttttcccctggtttctctagttccttatttccctggttttctgccccacctgctgaggcctttggtatatcctggatcagcagagggagctttatgaactgagaccctgcaagccaaagggaatttgaggccttggcctaatcctggaggcagcctcctaactgggccttttccttttgtggctaccaagtgcatgcctggcctaaccagctctatcactgggccacagccagagccaattctgggtcctggggtcgagccccagcgaggaatacctatttgttaccgtgtttctcaaggatggcccttgagtcaccttgatcctagggtatcgggtgtcatgatcaacagctccacagtggcatgggaagacagtgctagggctgggctttaggttagtttcctccaaccaaacctcttgctcttggaagctatccaaagctcaggcaacagaaaaagctctaggcctctcatggcaggtttacagtctgcatcagtctaccctggtggccccctcatagcagactgctggttcgaggggttcaaacaggctttctcctagagcatgacctgaaatgttgtgaaagtgcagattttgtaggtaagatggcttcagattcgccctgaaccaagggagtgtgggtgggaaacattgagaagtatggggctagggctgtgtgtaagttaggagactgtgctcaataggatggcggctaaggaacttgagaaaagggcaaatttgaataagtaagtgtgcaactgactgagatagagaagaggtcaaagggccttctgggggactttaatctgggctttgtgggctcttccttccaggccctttgcatctgccatgggcaggaggtctaaggtcagggaatgtatgtctttttctttccagtgcaagtgcgcccagtactggccagaccaaggctgctggacctatgggaatattcgggtgtctgtagaggatgtgactgtcctggtggactacacagtacggaagttctgcatccagcaggtagtgtctcctctgtcctttctcagttcttatgttggatctgctgaccagtaagagggaacaggctggatcatcccgctgtggtcaggagttgctgagtatgcagtatgtgaattctgaaaccagatatccgggctcaggggaacttgtctgtcaaagctaaaggagcagtattttcatgactggtgaaaaattacctgttgagatgaagtctgatcatttagatatgaccaagcactgtggaaagggagcatggggaggcagtgcagtctcctaggtgcttgactcacctttctcctcctttcctactccaaagactcctgacatcaaggatgtgatgggcctgcccctggccctccaggcaaccctggagacctgagcaaaggtcaccttcagccaaggggcagtgtggtactgcgaaaagaggacttagctgggagcactgcattttagttctgaccctgccactgactagttgtgagaccttgtgtctgtggttaactaactcccctgggtacacttacttttccattgtcactgacaaccacagctgtcaccttccctcccctggtactgcccacccttgggtatcagggccaacacacaggatctcctcacttcacaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcaggtcagtgtggcctgacccttgtacccccacccccacatttcgcccccatggccagagcaggggaacagcacaagggccctggctgaggaggctggcacagagtagatgacctactggggcaccagcgcaacagccagagactccaagttctagtgcagggtggagaatatgacttgaggaaggagggtagggcagtcctccaagattaggagttgggagaccctgctatgaagccaaaagactgggtcaagtgctggccatgtatttttgcagccttcggacccttctagctggaggtcaggattcaggacatactggagttgttggctcctggagagccccagctctaccccattcagaattaggatttagaccctgaaggaagagcccctgcctgtgttgcccctccctatctgctcccacaaggcaggctggccatccctataaccccctgctctctggctacagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatgtgagtgatctgtgggtcaggtgagggtggggggttccaggactaaaacatctgcccacattgaggattcactcagtctcacaggttattgtaaatgattactatagagtgtgattgtgggggaaagaaagatagatcacactgttaccgtgtctatgtagaaaaaggaagacacgagaaactccattttgttctgtactaagaaaaattcttctgccttgagatgctgttaatctgtaaccctagccccaaccctgtgctcgcagaaacatgtgctgtattgactcaaggtttaatggatttagggctgtgcaggatgtgctttgttaaaaatgtgtttgcaggcagtatgcttggtaaaagtcatcgccgttctccagtctcaagcacccagggacacaatgcactgcggaaggccgcagggacctctgcccaagaaagcctgggtgttgtccaaagtttctccccactgagatagcctgagatatgccctcgtgggaagggaagggtctgtgctgaggaggattagtgaaagaggaaggcttctttggagttaagataagaggaaggcatctgtctcctgctcgtccctgggaatggaatgtcttggtgtaaaacccgatcgtacattctatttactgagataggagaaaaccgccttatggctggaggtgagatatgctggcggcaatactgctctttactgcactgagatgtttgtgtaaagtcagacataaatctggcctacgtgcacatcaaggcacagcacctttccttaaacttatttatgacacagagtcctttgctcacatgtttttctgctgaccctctgcccaccattaccctatagtcctgccacatccccttagccgagatagtagagatagtgatcaataaatactgagggaactcagagacgagtgctggcgcatgtcctccgtatgctgagcaccggtcccctggcccactgttctttctctatactttgtctctgtgtcttctttctttcctcagtctctcgtcccacctgacgagaaacatccacaggtgtggaggggctagcccctttcatgtgatgaagggctcttataaattatgtattcaaagaaatcgagcacagaggaggttgtggtttcatgcctgggagagtcaggaaggcagatgacaggttactggacttcaaagattagggaacaggcagctgaaagagccagtgcccagagacatgatgaagctcggccacatctgggagcagcagtgagattggctctgcagttggggcatagcaccaggagggaggcagggaccagactatcacgggctttgggtgtctccagtttctgacagccccttcagactattaaatctgcactctcagaatgaacaggaattgagtttgtccttctctccaggcgtccaccacccccaagatagacctggacccttcttcccaagtaaagcacccccacagggactcctgcatttcaagtcccacttcactaaattgggataataagagggagtccttttattcctgctaggatcaaaggagaaatggactggagtgaagtgggggtgggaacaggtgatctggcatgagaactatgttgtatgtaaccaagaacttctgtgtcattcatgtttcagatgcagtatgtcttcatataccaagcccttctggagcattatctctatggagatacagaactggaagtgacctctctagaaacccacctgcagaaaatttacaacaaaatcccagggaccagcaacaatggattagaggaggagtttaaggtgagttggagctggataacctccttcagattgaaggatccttgtaatctggggaacatgggatgcctgactgtgcatttgccaacagtaaatccccttgtgaggcatgccagtggttaaggagatggtcctttcctcgtactctggtaactctcaactcatcctgcacgttggaatcactttggttgtgttagagtagggagaagcaggcaacagtattttaaggcccctagccctccgaggtgattatgatacacagcaagagcagttttttctgtaagagccagataataaatattttaggctttgcagcccacatggtttctatccagctacttagtgctgtctttgtaacacaaaggcagccataaccaataggtaaatataatgagtgtggctgttttataaaactttatttgcaggcagcaggcagcaggccagatttggcctctggaccttagatcactgatagctcctatatgccactagacaatggttctcaacacacctaaggcatatgtcacactgtcatcagtaaaagtgctctcccaggctgggcacagtggctcacgcctgtaatcacagcactttgggaggctgagacaggtggatcatgaggtcaggagttccagaccagcctggccaatatggtgaaaccccgtctctactaaaaatacaaaaagtagccaggcatgatggcacatgcctgtagtcccagctactcaggaggctgaggcgagagaattgcttgaacccggaaggcagaggttgcagtgagccgaaatcatgccactgcactccagcctgggcgacagagcgagactccatctcaaaaaaaaaaaaaaaaaaagtgctttctcagaagcaggagattctgggttggggtggggaggaccacttagagaagttcttctcaaatatagcatgtgcacagatttctttgggatcctgtcaagatgtgggttctgccaggcacggtggctaatgcctgtaatcccagcactttgggaggccaagtcaggcagatcacctgagctcaggagttcaagaccagcctgaccaacacggagaaactctgtctctattaaaaatacaaaattagccaggcatggtggcacatgcctgtaatcccagctacttgggaggctgaggcaggagaatcacttgaacccaggaggcagagattgcagtgagctgagattgtgccactgcactccagcctgggtgacagagcaagactctgtctcaaaaaaaaaaaaaaaaaagatattaggttctgattcagcaggtatgagttagagcttgagattctgcatttctttttttcttttctttttttttgagatggagtttcactcttgtcacccgggctggggtgcaatggcgcgatctcagctcactgcaacctctgcctcccgggttcaagggattcttctgtctcagcctcctaagtagctgggtctacaggcacgtgccactacccccggctaatttttagtagagacagggtttcaccatgttggccatgcgggtctcaaactcctaacctcagttgattgcccaccttggcctcccaaagtgctgggattacaggcatgagccaccacgcccggcttgagattctgcatttctaataaggtgaagccaacgctgctggtgtatgggctacactttgagtagcaaatgtcaagaaggagcctcaatcgggaagggaggatgcaattctgaataagtttttttgaagagccttaggcagcctctgggggtggaactgcagagtggacacactccctcctacgatgctggaatcccttgctccaggatcacaaaattccaagccaggagaatctcaagagagtccacaggagcctggaaggtagcatttcccaaacagtctcttggcttcagggttccagctgaacatatgggaacagaggtcagggccctggtgagaagagcagtatggagccagagtggcctggaggtgcaggccaagggacaggcataatcttgtcaagttcagttactgggatcagtaatgtttcccctccccttcccaattcagaagttaacatcaatcaaaatccagaatgacaagatgcggactggaaaccttccagccaacatgaagaagaaccgtgttttacagatcattccatgtaagagccctcccgccactccaaagccttattgccccatccctcaattccctccaccccttccatttctcaggtactagttaatgattggcgtatagacaagaatcatggcattgcctcttgttgcacccacttaacaacatggcgttgccttttgttgcaccttagtggcttctggaaataacgtaaaagccaaaggctttctccctaatgagctaggaacagacatgtccttgcccagctgggattctgtctgcccagggcctgaggtgggagcaatgcaaggagagggagaggacaaatgatattggctagccataagccgctattcttcttacagatgaattcaacagagtgatcattccagttaagcggggcgaagagaatacagactatgtgaacgcatcctttattgatgtaagtggtgggtgtgacccctgagcccccaacaccccgtggagattcagccagcacttgcagtgcctccctcccatacctgctggggaggatcatgtttgaatcagtcaacaaatagtgaattgatactcacccacccactcaccctgtgcattaggtctgtccagctccatagagcagaaggtgggggaaaacagatggcatgcagtagtataatacctggaagaaaaagttcacagagcagaccacagccaagaggaacctggctgccccctgatctttcccattcctgccctcttcatcctagctctaatccctgttccacttccctgtctcttacagaaagcaaccagcttgtcagatagggtttcgtccttggccacaggggagctctgcatgggctgagtttgcctccgagcagtccccattcccttctagtggtctgtcttctccactagtccctctgtgattaaaccatctcacccttgcaattaacctggcctgtgcagggctaccggcagaaggactcctatatcgccagccagggccctcttctccacacaattgaggacttctggcgaatgatctgggagtggaaatcctgctctatcgtgatgctaacagaactggaggagagaggccaggtgagttcaaaaggtcctgggtggtgagagacagagacagcatgaaaagatgtgtgtgtaaatggggacgttgggaaggcaagaaggtgtttggaccttgtctttgacttatacggtccaaagagtacgtttgcatagtataagtacatacttaaaggtatataaatacatatgcatttccaggattgcccagcccgttggtgtctaagcagtcattagcttctcccaagactagaaaagcaatgtgatctgagcctccatgttattcccagacagctcacacccttgcactttctcctgaatacagtccccctagcctagcctttgcacagtgccccaggcggggggggcaccctctccttcccagtgccccaggcagggcagataggtcaaggttctgaggtggacccaatatgagtgtccctaagaagggattgcctcattgctgactacataaaataaagcagtagaatttgagaaattatacaaacaagaaacttacagtctaatattcagtaataaggaaatcttttaaagaaaaaagccctcaggtctattaaaaagcagagctgtccggaaactcatactaaaaagggacactagcagtcccctaggtcaacttcctctcagtataggaaacctcctaatattgttcctgagtcagaatcatacagcctctactaagcacattcaatctcagggatatctccctcaccccccacattatggggggacccagtctgtgttctgacaatgcttattcttttaaaaattatttctgttgaggttgcacattgcagcaaatgagcggttcactatgtctggggtgtcacttagcagggatgagaatctagagaatgggcctggagagaagctagcaaggcctggtgagaaaattccttctaagccacagtgaagagtttggtcttcctaaagcaattgaagagcccttgacaacatcccatttgtgttttttaaaaaatccctctggcagcagtgagaaggactcattagaaatgcgaaagctgtggcagtaatgctggtggcctggactcgggtggtgagagggtgctgtcccagaaagggtgaagtgaggaggaattaaggatggcacccactcatgactcattgaatttatagtcaaacatttaaaatacaaagtatgttttacattagttgtctcaagtcactagttgttccccatctgtacttgtgttaactttggtacaaggctttacacatattttctcaccctgatgtttcattacatcaggattttttttttttttttggttttgtttgtttgtttgtttgtttgagagagggtctcactttgtcacccaggctggagtgcagtggcacgatcttggctcactgcagcctcaacctcccaggttcaagtgatcctcccacatagccctccaagtagctaggactaaaggcacgtgccaccatgcccagctagtttttgtatttttttgtagagacagggtttcaccatgttgcccaggctggtcttgaactcctgggctcaattgatccacccacctggttgacccaaagtgctaggattacaggtttgaaccaccttgcccggcatttttttcaattttgatcagtcatttaactcattagctattcttcctagacttgtatcatgtacctaatcaacagacatactttgtaggtcttcatcatcttttttttttttttttttgagacggagtctctgtcacccaggctggagtgcagtggcacaatatgggctcattgcaacctctgcctcccaggttctggcaattctcctgccacagcctccctagtaactgggattaaagacacccaccatcatgcctggctaatttttgtaggcacggggtttcaccatgttggccaggcttgtctcaaactcctgacctcaggttatctgcctgactcagcctcccaaagtgctgggattacaggcgtgagccactgcgcccagtgtcttcatcatcattaataacaatactgatgaggtgggaggttcggttaaggtgcttggctttgcactcaaggaagcacacacctgagtaacaaaagctgtttaggaaatgagccactgtgttctcaggagctaggtgcctgttcctgccgtctctgatcagtcgtgatggaacctgcagatcagaccagggccctacctgtggttccttctgcacccctgcccttcagatctgtgatgggcaggaccaaagagcaggccgaagagctggaaccacgagcacaaggaccatctcggcccactgccctgtgataaaatgtggcccagtgaacatctccgcctctgtccagtcagatgcaggctcttccatccttgaaaaggacctagtgagagtaaagggcagggggcaggaagcatttcatgtgtgtggcggtggggagaagagtcgtgcgcacacaaattctgctgcctgttgagtgaggcctctccctctgccttccactgtagcttatgctctgtcttcctaggccagtgaagcagacagtagtgcttgccctcaaaagcttctgagtggattggaacaggatgttagtgatgttctttacaaggcctcactggcccccaagttcactttctgttccattcatgttgtcaagtgtagctcccagaagtaattaacgcactaagcctaaatgatgcaatgaaaggtgcctacacttatacagtgacactaccatcctcacctacaatattaagttcccagagaaaaaaattcgatcccataatataaattctgtacttacaaattaaaatctcgaaggaattaaaaatttttaattatctccctctgctttttttttttttttttttttttttttgagatggagtctcactctgtccaccagactggagtgcagtggcacaatctcagctcgctgcaacctccacctccagggttcaagtgattctcccacctcagcctcccgagtagctgggattacaggcatgcactaccatgcccagctaatttccatagtagagacagggtttcgtcatgttggccatgctggtctcaaactcctgaccccaagtgatccgcccgccttagcctcccagagtgctaagattacaggcatgagccattgcgcctggcctccttctgctctattttaatcaaaagggtccaccaggatgcctgggttccctcagcagctgcagcttggaccatcatcagcctgggcagacagagcagtgccaggaactcccatgctgggtcaaccctaggcctagcccaaccctaggcctcatcctgcttctctaaagcatagtgaaacctgatagcattagtcttcacaaagctgtgtgtccccatcaccatgtccgccttagacctcataagagacataagacataagagacttcatgctatctggtggaaagacaaagtaggagaaaagacagaaaaccttccctgtttcacttctttaagatgctattatctagaggccgtaacgtgaacacacaaatctgagatgaaactccagtccccagcttttcttctactggtcttgaatccccattccccatcttctgtccctcacccactgatgactttaacacctggcttactgctccttttgagcccctgttcctgactctgcttttggaggcatcagtcaccatgtggatgatccatctatcctcaatctttctattcctcagcttcctcagccacctgatcccatggtcaagtcaccatctgccctgtatctgcactgcccttggaatctcaacaaggcatccgccctgtttactgcctccttcctcccacctcagtattctcttttattccagtcatttttgtcttcatcaagtccttagagttattgatgcctccactttctcaacatcagtcacaccgaacatgtcctcaccttcctccttactctgtgtgtttttgagttctgtttttgagcgtttgagttttctgatttgagtttttgtggtatgtcattattacctttccttattccctcatgctttcttactttcatagcaaactctctagtaaaacccagttatatgcctctatctgatatagcaaacatcactgggcaaaaacacaaaacagtgccaaatgctctcacactgaactcatgaccacaaatctcatagaggtaattggtgccacctagcaatgctattgctctttcttttcttcctgaaacctccagcatctgctcttgcctgtcccatcatactcacaccttagcttgtgacctggcctcattcttctccaagaaatcagacaagaacactgtcatcctcccacccccaaacaaccagcctcttcaaatctgtaccaactctattctctcttgttacagtggaaaagggtttctgcatctctcaatccacctgtccactgtgctcttggccccattccgtcctgcctgctcagggatgttgctgctataaccatcttctctcccacctccatcagcagttcccctctttaaccactactctcatcagcctatacatgttacatttcctatcttttaaaaacaaaaaatctgctaatctcactttcccttccacctactatcctatttctctgcaccccttcccagcaaaactcctttaaagagttggctttcggccgggcgcggtggctcacgcctgtaatcccagcactttgggaggccaaggtgggcggatcacaaagtcaggagatcgagaccagcctggccaacatggcaaaaccccatctctactaaaaatacaaaaattagctgggcgcgatggtgcatgcctgtgatcccagctactcgggaggctgaggcaggagaatcgtttgaaccagggagctgaaggttgcaatgagccaagatcgcgccactgcattccagcctggtggcagagtgagactccatctcaaaaaaaaaaaaaaaagagttggctttctccctgcaagttctctgttcgctctgttccttccaggcttggccccactgggactgctttagtcaagatcaccagtgactgtcctcttgccaaatccaaaggtcatttctcttttctgatttttttttttttgtccttacagcagcatttgaaagagtcagtacctccctcctcttcctcagaacacttacttccgtagcatcaccccactcactaacctggcagctcctttgttatttctttgtgacctcctcctctaaaacattggagtatactagactcgggcgctagcccactctgttttcttttgacacactagcccttcaggatctcagccagtcctatggctttaagtacaacccatatgccagggatcctcaatctgcgtctctaggccagtcacctgtcccccttcccaatgtgggctcctgatttcctccttcccccgacaccagtccaccccactcttagccatctaaataaatagtaccaccttctgcccagttgctcatgtctaaaatccgggagttaccttccttcctcccctctcctcacccctcacatccagtctgccactgagtcctgatacaggcagagcctccccacttttctccagcgtaactgctgtcatctgaacaagccctcgtctctcactgcttgcccgtgggactgtgggcatgactcatatgcgcagcctcgtctgcagtggcctggcaactggtcctcctgctctcatcctaacccacttttagtttttcaaatggcagctgctggtccttttgaaaatataaatcattgtcactccttgtcttacaaatcctgtttgaggccaggtgcggcagctcacgcctgtaatcccagcactttgggaggccgaggcgggtggatcacctgaggtcgggagttcgagaccagcctgaccaacatggagaaaccccgtctctactaaaaatacaaaattagcgggcatggtgatgcatgcctgtaatctcagctactggggaggctgaggcaggagaatcacttgaacccgggagccggaggttgcagtgagccaagatcgcgccattgcactccagcgtgggcaataagagtgaagctccatctcaaaaaaaaaaaaaaaaaaaatcctctttggtcttccagagatcttgagagaaaatccgcccatgtatacaaaatttagagacttttgatcagatgtggtggctcacgcctgtgtaatcctaccactttgggaggctgaggcaggtggatcacctgaggtcaagagtttgagaccagcctggccgacatggtgaaaccctgtctctactaaaaatacaaaaattagctaggcatggtggcgcacacttgtagtcccagctacttgggagtctggggtgggagaatcacttgaaactgggaggcggaggctgcagtaagtcaagatcatgccactgcactccagcctgggcgacagagcaagactctctcaaaaaagaaaaaaaaaatgagactcttagtgttgatacctagtccctagacttgatatgtatttctgtctgagagatcatgctcaattcctccagcacacacacactgtggctcacacccatggggaccttatggttctgatggttttaaaggcccagtcttcatcccagctgagacactgtgtaaagcagtgttgagaaggcactgtggtagcaaaatccattccacccaccagtgccataaaaactaatataatgcctgatcgaggtgagccttaatgagaatttttttttttttttggctgttctggttgaagagaggcccagggcaccgatccctgaggcatccccagggcttctagagaacatgggtggaaaagcactagtccagggcatgttcttgattcaacactttaataatcatgattttatttggactgtgagactattcacaatttctttttctacttaatttttttccaaatctttcaatgacattatatgtatggttgagaatttttcaattgccagtagtgaagaatctcagatcttacccccaaattctctaaagaaatgggcagcataactgtgtgatgttatatttatgtatttatgccttggcttgttctgcagacattgaacaaattcatttaccagatactgagagcctaccatgtgccaggcattgtgcaaggtgtggggaatacagagatgaaaagagacgcagccactcccacaaggagctgtagagggaagtgagccaggtgcaagcaaagacagacagtagaccacctcctgctcactagcaaggacagaaaggcgagtgctagcaacttgaaggtaccttgcagatcaaagagataaaggtaaaagggagaaaggatactgtggcctgggcggtggtgaagcccatggctgtgtgggaatgtgaattggttctgattttctgaattagcagtctggcggatgtaagcagcattaaatatgaaaacaccccatgggagaaaaagaaaggaattggaacaaagattttcactcgtcctcctctccctgcagccaccaagtattggataccctgtgagcctgtagtcagagtcctttacagaccccggcagtgttttagatggtctctggtgaggatcggaggttaattggaatgatgtgatataatgatcctgcaagttttcaataccttggggacgaagcgtatcagcgtaagaggtggctgtactgagaggggtcaggctgctcgtgggcagtgctgcttctacacatgtggtactctgagctcctcacctctccaacctgtctctccaggagaagtgtgcccagtactggccatctgatggactggtgtcctatggagatattacagtggaactgaagaaggaggaggaatgtgagagctacaccgtccgagacctcctggtcaccaacaccagggtaagatgggtcgtgggtggactctgcccacaggaaaagcagggttacccctgcctccctgatccccttttttccaaaggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcaggtatggctcacccttgccctcagcgggagagagaaagcgaggaggggcagataggggaagctgatgaccatgggtcagactgaagaaagccatacaagagcaagatattggtgagcacatagtagttgagattgatgccaagacaggattggatgctaagagagaggaccttggagcttgaacttggcacaataagtgctaggggactaatgttcagatagtgggcaggagagcagcaggggagactggcagtggagaccccggttgtgctatgaacagagggtgaaagagaagaggagtcaagggtgtctcccaggtttgagcctgggttggtgtgaccagcagaagagagacagtaaagaggtttgtttgaggggaaaagttgaattttgtatggggcatgttgctggaggttacgttttagaaaaaatgcactcctttacttagaatcctaacaacagcttacaaggcccaatatgttctgaggggtccctggccagggccgggagaggatggtgtgcaccatgggctggctctgagcacactcctgccatgggcctgagatgccagtttcccaggcagccacagggctttgcccaagccttccctgagtaccctgccagaactcccactcctcttttctctttccttaccacacatcttcttgtctggggacattgctaaaccccacagtccctgcctcagagtaggcactcagtgtctggtgagtgaatcagctgatgacattgaatagggggatattgtcaaggtcagagtctggattccgtggatttgggaagaaagtgaaagacatggaaaggaatcagcagatacacaccagtgtagggagtggggtttgtcagaaaaagggaaagacaggactagagctagttctaactgagcgaacagcaggtcagaacaacctaggccagcatgtgcaggtggacagcaatggctctgtgctggtggggtgtgagtgaaggtcgtcccccacggtccaacaggtgagtccctccacagcacatggggccatgcaggaagggcacagggtacactgcctcccgacccagaacccctccaggctggtgggtccacagggcaaaggcgagcaccagctgcctgcccccacctcttctgccactcaccactgtcactcacccccttgcacagagggccatcacaggtgtggtaaatgtgtctgctctgttgcagcgccggggcaggaaggacggggaccttctgtgccctgagcaccgtcctggagcgtgtgaaagcagaggggattttggatgtcttccagactgtcaagagcctgcggctacagaggccacacatggtccagacactggtatgctgcccacatatttgtccctgccaccacaccacctgcagcccttctctcagggaggaggctcttcagaggggcccacccagtagtcagaagactgtctaaacacagacctgcccttgccctcccaaggtgccccaaatacacaggaaacattgggaggcaggatggcagcaatgggagcatagcccctgttgccagaggttgggccaggttagaaggggtgtctgggtgccccacagggctcatctgtacttctctgtgggtcttgggtaaggaagatccatgaagagtacctgcctttgggcttgggctccctgttaagaggtctgactttaataagccgcacatccacagaggttttcctgaatcccatggagctagaaatgtttggggggtaaagaaaagtgaatgttaggaggtttgggagacgaggttctgagagccagggtgcatgctagcctggcagccatggtaagcgtgggccatgctcagctgcactgtctcccagcccagcacatgcctgtctgacctctgtggggcctgggtcagctctggtcagctctgcttgtagaaggtctgctgcattcagcccggaaggggaatgctgtcagaactctggcaggcagatcagagctcaggtgaaagttcaaaaacattcagttcctcttgattttccatcttcaacaaaaaaatgagtctgttaggaattacaggtactgtgtgttcttcagtaaccctgactttttccctacctttcactctccaggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctga

SEQ ID NO: 2568 - DNA, 115464 bp, Homo sapiens
ggtgacacaactaaaaaaaaacaaaggtatttatggaattccactgagtggtaatggatgatgcagttcaaataactaaggtaagagaaataaaaccagaactgtgaggaggcttttgccagccaagtagtgtccttaaataaagctaacatcacatgctttcctgcttcatttcgtttctaagctgtaagagtagcttatttttttattattataaacattgtaattatcctttaagatacttcttaacctgattatgaatcagaatcacttgaagagctttttttttttaaaaaaaaagaccaaagtcaggctgggcatggtggatcacgcctgtaatcccagcactttgggaggccgaggcgggcagatcacttgaggtcaggagttcaagaccagcctggccaacatggtgaaaccccatctctaccaaaaatacaaaaattagccagatgtggtggcatgtgcctgtaatcccagctactcgggaggctgaagcaggaggatcccttgaacccaggagacagaggttgcagtgagctgagatcgcacactgcattccattctgggcaccaaagaatgaaactccttctcaaaaaaataaaaataaaaagaccaaagttaatgccctgccagcattgaattaaagcttcttgagtagatcacagatgatctccaagttttttaagtgggaatgtaaaccaactctatagttttagaaaactctttggcaatatctgcaaaacatacacgtatctaataacccaggaatttcaattctaggtatccacctttgagaaatgaaaaatatatgtctacacaaaagtgcacatacaaatgttcactgcagctttatgtattatagccagaaaaactgtaacccaatcaggtgtccaaaaacaggagaatagttaaacaaattgtgatatatggtcaggtgtggtggcttacacctgtaatctaagcacttgggaggctaaggcgggcagatcagttgaccagcctggtcaacatggtgaaaccccatctctactaaaattacaaaaatgagctgagtgtggtggctcacgcctgtaatcccagctactcaggaggctaagacaggagaatggcttgaagccaggaggcagaagttgcagtgaggtgagatcacgcccctgcactccatccaatctgggcaacagggcgagactatgtatcaacaacaacaaaaaattgacatacactattgataacatggaattttattcagtaatagaaaggaacaaactaccagtagacatgacaacatggatgaatctcgtagataaaaggttgagtgaaagaaaccagatggacaagaaaaagtagatgtagcagaattaccgagtaaaactaaactacagtgataaaggtcatatccctacttcctctgacaggaggtgggaggttgtgactggaaagaggtatgagagagcctctgcagcaccgaaaaggtgttttgttttgttttttgagactgagtcttgctatgtcaccaggctggagtgcagtggtgtgatctcagctcactgcaacctccgcttcctgggttcaagcaattctcctgcctcagcttcccaagtagctgggattacagacacgcgccaccacgcccagctaatttttgtatttttaatagagacagagtttcaccatgttggccaggatggtctcgattgcccaacctcatgatccgcctgcctctgcctcccaaagtgctgggattacaggcatgagccaccgcgcccggcctgaaaaggttttacatcttaatgtgttcatatacatacttttctcatggtaaaatatatataagattaaatttatcattttaactacttttaaagtatacaattcattggcattaagtacattcctgttgtgcagccatcaccactgtccatctccaaaactttttcatctccccaaactgaaactccatatccattaaacactaactccccatttcctcctcccccagctgctggcaaccattctaccttctgtctctatgaatttgactataatagttacctcgtataagtggaatcatatttgtcatttgacatctggtttgtttcacataggtttatttcacaaaggtatcttgtttatttcacataggatgaccttgttttcaagtcatccatgttgtagcatatatcagaatttacattttatggttgaataatattctgttgtatgtttataccactttatgtgtatccattcattcactgatggacacttgggctgcttccaccttttggctgttgtgactaatggtgctatgaacatgggtgtaggctgagtgtggtggctcacgcctgtaatcccagcactttgggaggccgaggcaggcggatcacttgaggtcaggagttcaagaccagcttggacaacatggcaaaaccccatttctaccaaaaatgcaaaaattagccaggcatggtgctgcatgcctgtaattcccagctacttgggaggctgaggcaggagaatcgcttgaacctaggaggtagaggttgcagtgagcccagatggtgctactgcactccagcctgggtgacagagtgaggctgtctcaattgaaaaaacaaaaacaaaaacaaaaaaaaacacatggatgtacaaacatctgttcgagtccctgcttttagttcttttgagtatattcttagaagtaaaattactggatcatatggtaactccatgtttcattttttgaggaatcaccatgctgtttttcacagtactgcatcattttatattcccaccagcaatgcacaagggcttcaatttctttacattctgctttttggtgacctccataattctaaattatatgtatatgctgtttcttcttaattcttttattaataaaaaagacaacataattctttgcctctccagtgtgaaaaaatgggaatttaccttacactatccccccatttaatatttgtattatttcctgttctgctgctgtttattagtttcctcagacttctgtaacaaaactccatgaactgggtggcttaaacaatagaaatttattgtctcagagttttggaggctagaagtcttgcgggctgtgcgggagaatctgttctatgattttcttctagcttctggtagcctcaggcatcccttacattgtagatggcattctctctgtatcttcagattgtcttccctctatgcatatctgtctcttgtgtccaaatttcctttttcaaaataagtgcgctagtcattggattagggaccaccctaatgagctcatctcaacttgatcatatgcaaaaatcctctttctaaataagttcacattcacaggaactgagtagggggttacaattttaacatcttttaggggacacaattcagtctgggtgacagaacaaatctctgtctcaaaaacaaaacaaaacaaacccataaagtgattacatttctaactttcggaagtactcttcaacctcctttttttaggttaattttcagcactctttccttctttcttcctttcctttttccttttccttttttttttttttttttttttttactttttatttttttgagacagagtcttggtctgtcgctcaggctggagtacagtggtgtgatcttggctcactgcaacctctgcctcctaggctgaagtgattttcctgcctcagcctcccaagtagctgggattacaggcacccgccaccacgcccggctaatttttgtatttttagtagagccaggttttcaccttgttggccaagctggtctcaaacttctggcctcaagtgatccgcccgcctcggcctcccaaagtgctgggattacaggcatatgccaccacacctggctaatttttgtatttttagtagagacagggtttcacctgttggatctcctgacctcatgatcgccctcctcagcctcccaaagtgctgggattacagtcgtgagtgccgcgcccacttaatatttatgttattatagctaagtaaatattgttcactgtcaggccaggcagcattttctgggtttttatttctttctctgtaggttcaatgtcatagaccctgggctattcaaatgagaaaatgaagaaaaagtgaattctctctctgaaactatcagttgcttccaatcatgtctttatattttatatttgaaccgtaactttctcataaaattttctccctggagtttctaattttcttgtctatttgcctgttattatagtttcacttttcaccaagatctcaatcatacactccagcctgtcaaggctagttcaaaccatacactgtggcccaaatttaggctagtcgtacactccaatccgagaccagtgggcactgttttttaggctgtctacacagtcatattggtattttccttactggtttttctttgacgggggtgcaggggaggttgggtccactgatcttggatatcagtctttctttgtatttgttttttaaatcttactagaggctagggggcatggtggctcatgcctgtaaccccagcactttgggaggctgaggcaggtggatcacttgaggccaggagttcaagaccagcctggccaacacggcaaaaccctgtctctactaaaaatacaaaaattagccaggcgtggtggtgggtgcctgtaatcctagctagtcgggaggctgaggcaggagaattgcttgaacccgggtggtggaggttgcagtgagccaagatcataccattgcactgcagcctaggcgacagagtgagactccatctcagtcaatcaatcagtcaatcaatctatcttaccagagttcattctcaagtcacttactgagagaaaaggtacctggcagataaattttgactctttctggtatccgttttttgttgttgttgttgttgttgtttgtttgttttggagacggagtctcgctctgttgcccaggctggagtgcagtggcgcgatcttggctcactgcaagcttcgcctcccaggttcatgccattctcctgcctcagcctcctaagtagctgggactataggcgcctgtcaccacgcctggctaattttttgtatttttagtagagatggagtttcactgtgttagctgatctgccctccttggcctcccaaagtgctgggattacaggcgtgagccaccgtacccagcctctggtgtctgtttttaagaccctcatgttggagtgatggtttggttgactatagaattctaggttgcctattatttttcctcaaaactttgaagtcattgctccatttcttctgacatcccttgttgttcatgagaaatagaaagtttcatataggaaattaatttttcttcttttctggaagcttttatgttctatatagtctggaattccatagaggtgtacttggtgggccccttaatagatctgcagactcatagctctccattttttggttcttttctgtcagcagctttctgatattgagcttcctgggttgttcatataatgttcttatctattctgtcctttttaaaaactctttgcttttggttgttttcctggagattgtcataactttatctcctaatctttttttctctctttttttttttttttttgagacagggtctcaccctgtggcccagactggagttcagtggtgccatcacagctcactgcagcctcgagctcccaggttcaagcaatcctcccacctcagctttccaagtagctggaactataggcatgcgctactacacccagctaattttttttatttttagtagtgacagggtctcactgtgttgccctggctggtctcaaactcctgagctcaagtgatccttctgcctctggggactacaggagtatgccaccacacctggctaatttttgtattttttagtagagacagggtttcaccatgttgccaggctggtcttgaactcctaggctcaagcgatccacctgcctcagcctcccaaagtgctgggattacaggtgtgagccaccacacctggcctgctgttttttcttttactgtttcttaaactagtcttctccccgctttcttttcctgtatgaacgttaatagttgaccacagcattggccctgtaatactcttttgttctttgtatttcttcagttttatttagcctctgttgtgtgttcacacattcctttttatttgcttgatgtgtgtcccatcccttcttttgaacactgtgtggtcattaatgagagtgtggtaggattttatgtactgatatttaagaaaatgaccataaaatgttcttggagatggtctttaaagaccgggcatggtagctcatgtttgtaatcttagtactttgggtggctgaggcaggaggattgcttgagctcaggagtttgagaccagcctgggaaacatggggagatcccatctctacaaaaaatgcacaaattacccaggcgtggtagtacatgcccgtggtcccagctattccagagcctgaagtgggaggattgcttgagcccaggagctcgaggctgcagtaagccatgtttgcaccactgcactccagcctgagtaacagaacaagaccctgtctcaaagaaaggaaaaaaaaattttaagtagttgattaaaagaggtctttagggtgggctctaatttgatgtgactggtgtccttgtaagaaaaggaaatttgtacacgcagacatcagaaacaaatacacagaggaatgaccaggtgaggatacagtaagatggtggccatctgcaggccaaggagagaggtctcataggaaaccaaacttgctgacactttcatcttggacttctagcctgtacagctgtgagaaaataaatttctgttgttgaacccaccgagtctgtgatacttttatggcagccctaccaaatgaatatagacatttaagaaggcttggtgcattgcagcatttggtaaattattatgcatttcgttgtattgtgcatgtagtgccattactgagaatagcaggatggatgggaagcatcgagacaaagtaaaatacgagctggccactaacatatggtatgattttgtggtaggtgaaaaaaggattccagaagtagagtgcttatgaaagaaaagctcagtagtgtaagaattttacaccagtttgactttaacagagagtgagttcaacagtgaaagatgaggttgcaaatgtagtttggggacccatattaatttcctggtgctgcccaaacaaagtaccataaactcggtggctaaagacagcagaaatatattgtctggcagttctggaggcccaaagtcaaggtgttggcagtgttggttccttcttggggggaatctgtcccatgcatctctccttagcttccaagagccccctgtgttatttggattgtaaatgatcactcaaatcctctttcttcaattggcattttccctgtctgttttcacatgattatcttcttataaggacaccagtcatattggattaggggcccacagtactccagaatgacctcatctttatttaactaattacatcttcaacgaccctatttccaaataaggtcacatcctatggtactggggattaggacttcatatcttttttggggaggcatagttcaacccataacaggggccaaactgtgaagcatttcctatatatcaatccagatattttcaaatctattgtttattcagtgggaaaccattgaaaactttgagcaggatgaatctaacactttaggaagactccttggggatggggttggagagatgttagctgcactggaagtcagtagaccagagtctggaccactgggagtctggaccagatcaatgttatggaaaaccaggattctggggctcccactcaagatatcccaaacccaaatcttcagactggagacccaggactgttttttaaaagctccctctctctccctgtgagtcagatgatttagcctagcttggatgtaacactgggtgtgaggtgatagaggcatgaaatgggttggtggttatgcaagtagaaagaccagagagaacctgggaaaagagacatttcgaaaaagtagtatgtaaactggcaccggagagtctgagacagtggtggaatccttaacagaaataaagatgtctagagaataaattgggtttaaagggaaggtaattaatttggtttacagtgtaaggtgatagacagtcagcaggcacttggagaatggtgatgtatgttcagaagtgagataatggaggtgataatcaaaaccctttgttttgatttgagcctttgtgtgggagaaaggatatggcgagaagaacagaagatcaggaagccaatactgtagaccctcattccctagcccctgaaacaaatggatttgacttctctgtcatgacacctggaacaaatgtggcattgcttacttacttcctttgccatgaactcagtgaaggcagggacgggtcttggcttgtgtgtgtgtgtgtgtgtgtgtgtgtgtaagagactgggtctcattctgttacccaggcatgagtgccatggcataatcatagctcactgcagcctcaaacgaacctcctccctcaggcctcctgagttgctgggactacaggcatgcaccaatggccctggctttttaaaggccatcatctagcacagtgcctggcttttcaatggaagtctgttgaatgactgactgactgaccgacttggaaaatgaacacatcaacttgagaataagaactttaacttttttcttccttgcatcccctaacatttaatccaatgcctggtccttaataggacccaaataaaattttgatgtgtgaatggtagaagaaaagctaaaattgagtagtcattgtgtcaaagagaaccaggaaacagagaagcttttgagaataagttgaccataacatgtcaaatgcaagtcaaggagaatgaaaactgagggcaggaattagatttaatcaggaggttatttgtagatttgagaacgaaggatttaagaacataatgaggttgttaagggagaatgaaggaattaagatcataatgaggttgttaagtagaggtggaaagtgaggaaatgaaagccaagtacatcttatacaagtttagtagtaatgaggaaaagagaagctcatagagttaaagctctaaaaatctgtttagaacatccgtgtctatttgtaaacaaaggggtatgagggttagggatggaaaaatggaaagtaccagaaggaaatgcataattttaggggaaagatctcaaatgggatcaagaacatgggcagtagccttaaaaaggatgagggaatctcttcctctagtctaaaaagggagaatagaggctctatagaggagagagaggtcatgtcctcttgtcagccatctgctcagagggagcttgggctgctgtgctagaaactgacataggaaactgacaaaggaaggatatgttttctgcacagcactgaggagtgtgatactcctaagcagtagttggcagcctgagataggaatggtggaaccagatggtaagtataatccaggaatcaggatggcactttctgtagattagggagttgtaggctgggggtgtacttttattcactcttctctgattcagaggttttataattttcactaacatcattaaaaacaatattggatgcctactacctgttggtttttattttaatcttgggaaaaaaaagtaaaagctactatcctgaggtttctggttttattggggagatagatcatatatgtaaaaagcaagtttagcaaatggcacatggcattatagactaagtcccaaatcagtagattacataaatgtcagagagattacaattatagcagtacactttgaggttcttttccccttagcttatgaacatttaaattttgtcacttttataaatacatgcctatttgagaggtaagaaaagtaccatgttgctttaatttgcttttctttgttagcaaagatgaattttttcagttgtttatcattattttactttttatgaattgcctattcatagcttttatccatctttccatggttgtgtttgtacttactaatttgtaaatacctcatttaataaggttatttaaccttttgcctgtaacattttgcaaatgttttttctagcttgttttttggggttctttcttttggttggttggttggttggttggttggttgggttttttttttgagacagatcatcactctgttacccaggctggaatgcagtggtgccatctctgctcactgcaacctccaccttctggggtcaaatgattcttgtgtctcagcctcccaagtagctgggattacaggcgcacgccaccacgcccagctaatttttataatttttgtagagatggggtttcacgatgttggctagggtggtctcaaaactcctgacctcaagtgatttgcctccctcagcctcccaaagtgctgggattacagatgcagccaccatggccagccttttctagtttttttaatttaaacattttctttcagatttcttattttgatttattttcagtttatgatgttttgttgacacataagagtttaaatatcttatgtattagaaactattaaatatttctttttaatatttaggaaggctacctcagcctgagaacagacaaatattttcaaatgttttcttcaaattgttttatagtttattggtacttatttacattccattgtattattgttatttatatacttaaaactttaaaccattttggaatattgcatgaaatagagacctaatttttgctgagtagttcagcagtttctagtactgtttactaaataatctatgaaaattttctgcggattcctaaatgattttgtccaggctggagtacagtggcacaatcatggctcactgcggcatctacctccccaggctcaggtgattgtcccacctcagcctctcaagtagctgggactacagaagtgccactacacccagctaatttttgcatttttttgtagagactatatttcaccatgttgctgagcctggtcttgaactcctgggctcaagcgacctgcccacttcggcctcccaaagtactaggattacaaggcatgagccaccgggtattttttatcatattcccaatacttatgtatacagacttccttgtttataaatctgtatctgtaccattgccacatattattgtattaatataatctcatagtgcaaatacttgttcattatttgttttaaataatgcctagactacactcacctatttgtatatgtgaactttttttaaaacattttattttttaataatttaagactcagaaagctgcagtagtacaggttcccaggtatgcttcacccaagggctttcaattagaacctttttttttttttttttttttgagatggagtctcgctctgtcaccaggctggagtgcagtggcgccatctcagcacactgcaacctctgactccctgattcgagcaattctcctgtctcagcctcccgagtagctggaattacaggcatacgccaccacacccagctaatttttgtatttttagtcaagacggtgtttcgccatgttggtcaggctgatctcaaactcctgacctcaggtgatctgcttgccttagcctcccaaagtgctgggattagagtggtgagccactgtgcccggcccctgaaatcaccttttctgtaatgctactttgttcaataaaaataacatattaatatcctttttaaaaatacatacaatatattgttattaactgtagtcaccatgatgtacaatagatctcttgaacttattcctcctaactgaattttgtgtcctttgttcagtatttccccaattcccctacccaccaacctctagtaaccaccattttactctctatttctatgaattcaactttttacattccacgtgtaagtgagatcatgtgatatttgtctttctatgtctggcttatttcgtttaacataatgtcctccaggtttatccatgttatcacaaatgacagaatttattctttttttaaggctgaatagtgttccattgtgtatgtatgccacattttctttcaccattcatccatcaatgaatgaaaacacttaggttgatttcatatcttagctattgtgaataatgctgcaatgaacatagtagtacagatatctcttcaacatacccatattagttatatcctttagatatatatccaatagggggaattactgaatcatatagtagttctatttaaatttttttttgttttttaattttgtttgtttagagacagggtctcgctgtgtctccaaggctgtagcacagttctgcaatcataactcactgtaagctcaagtgatctacttcagcttcgctactacaggcacatgccactatagtcagctaatttttaaaaattgtttgtagagtccaggtgtggtggctcacgcctgtaatcccagcaatttgggaggcctaggcgggtggatcacctgaagtcaggagtttgacactagcctgactgccatggtaaaaccccatctctactaaaaatacaaaaaaattagccgggcgtggctgtgcatgcctatgatcccagctacttgggaggctgagaggcaggagaatcacttgaacccgggaggcagaggttgcagtaagccaagatctcgccattgcactccagcctgggcgacaagagtgaaaatccaactcaaaaaaaaaaaaaatcgtttgtagagacagggtctcacaatattgaccagtctggtctcaaactcctggcttcaggcagtcttcctgtcttggcctcccaaagtgctgacattatagccatgagcccctgcacccagccttatttttaattttttgaggaacctccatacatgttttccataatggctgtacttatttaccttctcaccttattgtataatggtgcatatctcagaatgtgtccttactgagtgacacataactatatttgaagtaagtttcttatagatagcatatagttgggtcttttcttttctttttttaatagagacagggtcttgctatgttgcccaggctggttttgaactcctgggctcaagcagtatgcctgcctgggcctcccaaagtgttggtattataggcatgagccaccatgcctggcctaggtcttttttttttgagacagggtctcacttttgtcacccaagctggagtgccgtggtgcaatcatggctcactgcagcctcaacctcctaggctcaatcagccctccacctcagcctcctgagtagctgggattacagatgcatgccatcatgcctggctaatttttgttttgtttggggtttttttggtagagacagggttttgccatgttgcccaggctggtctcgaagtcttgggctgaagtgatccacctaccttggtctcccaaagtgctgggattacaagcgtaaaccattacacgtggtctagttgggttcttttttaaaagaatcagttctactaatttcttttcgttggtatgtataaaccatttatatttaatataattattgatactttggatttaaatttgccatttttgtttcattcattatttttgttcttctgtttcccctttcctgttttacagtgggttccttgaacattttttaatatttcattttgagtgtatctctttataaagttttttgtgtgattgctctaggaatatatatgtagataacttattacagtctattaatatcaactttttaccaccttaagtagaatgtagttagttttagtagaaggaatcttttagttccttctacctttcttcttctttttttttttttttgagacggagtcttgctctgtcatcaggttggagtgcagtggcgtgatctcagctcattgcaatctccacctcccgggttcaagccattctcctgcctcagcccctccgagtagctgggattacaggtgcatgccaccacacccagctaatttttgtatttttagtagagatgaggtttcaccatgttggccaggatggtctcgatttcctgacctcgtgatctgccggcctcagcctcccaaagtgctgggattacaggcatgagccattgtgcctggcacaccttccttctttatggtacagttgtcttaaatattacctctacatacaaggagaaccacttcagggactgctataatttttactttcaaccatcaaacataatctttaaaactcaagagaagaattgcttaattagtgtatgtatgtgtgtctgtatatgaataaacatatatatatgcataacatatatatggatatatgcatatatagacacacacacaccctttccattgctttttctttacttctatttgaggttttcttctgttatcatttacttcctttctgatagagtttctttagccattcttttcaaagctgatctgttggtgacacatttttagttttgttcatctgccagtatttgtatttcatttttatttctgaaggatattttcactgtctatagaattttagcttgatagttattttctttcagcatttgaaaaatattgtatccatccttgtggtttccatggttcctgatgaaaaatctgttgtctttcaaattgttattctcctatgagtgatatgttgtttctctctaattgatttcaggacttttctttagtttttagaagtttgattctgtaagtttatatctaaatctgaggctgagtgtggtggctcatgcccataatcccaacactttgagaggccaaggtaagaggatttcgtgagtccaggagtttgagaccagcctggacaacatagtgagaccccacctctaaaacagatagatagatagttgattttgtttttgttttttcctttttttgagacggagtcttgctgtgtcacccaggctggagggcagtggctcgatcttggttcactacaacctccgcctcctgggttcaagcaattctcctgcgtcagccacccaagtagctgggattacaggcacccgccaccacacccaactcattttttgtatttttagtacagatggggtttcaccatgttggccaagctggtctcgaactcctgacctcaggtgatccccctgcctcagcctcccaaaatgctgggattacagatgcgagccaccgtacccagtagacagtttttagccattatttcttaaatttttttttttcatctctccattcattctcttactcttgggaccctgatagcatgaatgttagatctttgttattatcccacaggactttgaaactgtgttcatttcttttcaatctactttctctcttgtacagactggatgatttccattcatttaagtttactaattgtttcctttatcatttttcttttgctgttgagcccatccagtgggtctttttaatttcagaaattttatttttaaaaattccatttggtactccttatgtcttctatatgctgagtgtttataatgtcttgtttgagcagtttcatgagcgctgttttaaattcttttcaaataattccaaaatctatattatcttggtattgtcatctgttgattgccttttttcattcaagttgagattttcatgttcctggtataatgagtaatgttggattgcatcctagcacttggaatattgtgctatgagattctggttcctgtttaaatttttatatttaacagtcaacctgtttaggtttagaacacataccctgtcccacttttgtcgactgtggttcagttttcagtcttgttttactcttatggtctgtgctaccgaaaggccagtctgaaatttaggtgttattccggagcagtgttcagttcttatgccttttgctgtgttgtttctggtcatttttacacatgggttgctcagaggcacttttaggatttcatacacagattcagagaattcatttctctagctctctcctcaccataatcctttcccaattctgtagttttgctgggattaggactccatctggttattccagggtagagaaagatgagttcacccacattctctgcagctgtaacatggagaagaggggaaaggcgtgccacctcattatggcagagttgtgttggaaggcagaatgctgttcacaatttctgggccacagtgtctggtgaggaaaaggaggggtacctcctccccttttttagtttgcctggtcaaaatgtttttgtctgctgagctgcccctttcccagttctttacctagagagggcaggcttttcttggcactttcttgtctgtgcttactggatctttcagattgtggcttcagagcttgggctaggacatattagaagttaaaccaaaccaaacaaaaaagtagggagcttcctgttgggtcagtcctcatgtcccctggtccctagccaatctaccttcttttttctacttttcagaatttttctgtcacttgtgtcatgaatttcatctagaatgttcggttataatcggtgggaagggctgggcgcggtggctgacgcctacaatcccagcactttgggaggccaaggcgagcggatcacctgaggtgaggagttcgagaccagcctggccaacatggtgaaaccccgtctctactaaaaatacaaaaaaaattagccgggcatggtgggggacgcctgtaatcccagctacttgggaggctcagataggagaatcgtttgaacccaggaggtggaggttgcagtgagctgagatcgcgccactgcgctccagcctgggcaagaagagcaaaactccatctcaaacaaaaacaaaaacaaaaacaaatcagtgggaggaatagggtggaatatgcttactccatcttttcctgaactgtaaatccctgctgcaattttaaattatgaactttagttccagtagttttttttaacctatgtacgtagtctttcaaatacaaataacagttaaggggttttcccccaataattatatcttgttttcttttcttttcttttttttttttttaaagagaccgggtctcgctgtatcgcctaggctggacttgaactcctgtgctcaggcaatcctcctccctcagccttccaagtatctgggactacaggcatatacccccatacctagctgttttcttatcccattatctacttttagaacaaggattggcaaactataatctgtttcccatatccagctcactgcttattttggtatggcagacaagctcagaataggttttccttttttttggagacaggtctcactttgtcactgaggctggagtgcattggtgtaaacacagctcacttcagcctcgacctcccaggctcatgggatcctcctgtctcagagagaaaaagagagagagaaaaaaagaaattatatgaaattcaaatttcagcgttttattagaatatgccatgttcatttgtttatatattgtctgtggctgccttcatggtacgacagcagagttgagtagttgaagcagagacttaattgccagccctttttccagatgatttgtaaatcctagaagtgaaaccattgtccctttcttgtcctgctttagtgatactgatatttcaagatacataattttcttgggtgaaagtttcttttgtttctggtttctaggtatttgtgagatatttctctcacaaaacgtgttcttttcttctggtttttttttgggggttttttttgtttctttggttttttgagacagtctcgctctgtcacccaggctggagttcagtggcgcgatctcaactcactgcaacctctgcctcctgggttcaagcagttctcctgcctcggcctccctagtagctgggattacaggtgcctgcaatcacgccaggctaatttttgtatttttagtagagatggggtttcaccatgttggccaggctggtcttgaactcctgacctcaggtgatctgccctccttggcctcccaaagtgctgggattacaggcatgagccactacgccttgtctcttttcctctgttatctgacttactggatggcatctgttaggtaaatcagaaaccaaagaggagtagcattcagcactccctgtcaccccaagagcaaatctattatcacaccctgtgcagtttacttcctgaatatctccttccttgtaacacttttgtgtctccaccagtaacttctaactggactgtccacatccagtgctatattctctacacccagctaaatgaagtgttcattccaaaatgcagggcagggaggtcactgtcatgcttctgttcttcaaaggcttcttaatgcttatgggacaaagaaaaatcacccttgtgtggccctaccctgtatacatctccagcttcctggcacctgctcccccttactctttatacttcagacacggtggcttctttcagaccctgctcctgccctttctgaggttacggactggcatggagttccctgccctccttaatgcctccctgattcctgttcatcttctacttgtcagctcaggaatcagtgccttagggaggccttggctgagctccctgactaggtcaaattttcttcttctataggctcttagagtcctataattctcttttccatcacttctcctatttgtctgtgaggtgatttgtttaatgtcagttttctgctactagactgtaagcttcatgaagatagggattctgttagaatttgttcactatttctagtagaaggaacagggcctagcacatagtaaatactgagtaagcgggttatttccccaatgattgcctttttaaagaaaaccagttctgtaaaccagcattcatcaggcttatcatatggctttttatattttgaattatttttgtgaggatttttattaatatgttttccaataatggaccatggttaaatttttgaagtaagccttacttgatcaggttgtggtataattataacatatgctgctttttctttgctaggattttaagattttgcagttaaagttattttcttttttgtgtgctttgtcagattttgacatcagtgttatactagtattttcatggcttattttattccattcttttattttcaacttttctatatccttaagcttaaaaatgtctcttttaaacagcatataattgagggcttttattattaggctttataatttttgtattttaattggaacatttagtttgtttaatatagttaatatattctttgctttctattttcctcaaagatttgaatagaacaaaaggctgacctcccccaagcaagagggaattctctggcagtctgcctttgcacttgaaatgcaactcctccctgaatctccagcctgccagcctcttctattatgagtcaattccttaaaataattctatatgatatatatttaatataattaatatataatgtggctactacctagtagaattaatgtatacttaatatgacatataatataattacagtagtaccttcttatctgggggaagcattatattccaagacccccagtggatgcctaaaaccacagatatatattttcctatacatacatagctgtgataaagtttaatttataaattaggcacagtaaaaaattaacaataactaataataaaatacaatacttataataatatgccagcatgttcctttttctcttttttcttgctttttggattgatagacttttttactatcctagcttttttccctcttgccaagttatagaccctgttcttttagtggttaccctacagattacaacacatagcctgcatgtataggaatgaaatacagtttacgtagggttcagtaccatctgtggtttcaggcatctactgggagtcttggaacatatccccccaccccccccccagataagggggtagtactgaaattatattaaatatatgcttattatattaaatattagtcatatattacatacatattatatagatttattttaagggattgattcacagtgggggaggctagcaggctggagacccaggaaggaactgcacttcaagttcaagggtagtctgctggagaattccctcttgcgtggggaaggtcagccttttgtgctattcagaccttcagttgtatggatgaagcccacctacattatggagggcaaccttctgtactcaagagtccattgatttaaatgtaaatctcatccaaaaaaacccctcacagaaatatccagaataacctttaaccaaatatctggacactgtggtgtggcccaaccaaattaacaatcacaagtctactctttatcaacttggcacccatacacatctccttaaaccattattaatctccaaataaagacagtaacaaagtcatacttctgcttagcatgaaagaactatcttgcatgtagccgaaaacacactattcctttctctaaaagaggatgcagattatttggttgatgtttactcttcttgatatcctgcaacttaaattctaaagtttaagaaaaagttaatacttaagtattatgatcagctgttaatctaattttttttgacgaaaatattttcgtatccattttctattgctgcctagcaaaacatccccaaatttaatattttaaagcaacaaccatcaaaaattggctcacaattctgtgaatatcaatcaatgctgggtagctgtttggttcctctactggtcttttttttttttttttttttagacagggtctcactctgccacccaggctggagtgcagtggcatgatctcggctcactgtaacctccgcctcccaggctcaagcaattgtcctgtctcaaccttctgagtagctgggattacagacacacaccactaccacctggctaatttttttatttttagtagatatagggtttcaccatgttggccaggctggtctcgaactcctcacctcaaatgatccacctgcctcggcctcccaaagtgctgggattacaggcgtgagccaccatgcctggcccctctgctggtcttgattgaagtcattcatgcaactgtaatcatctaatggttcatctgggactgagattgtctcaagcacatgtctggcagttggtgtcacttgttgattgggcctctctcttaacgtaaggaagtgagccaaagcttctcacattatgacagcagtgttcccatagagccaaatgacagctgtaagttctcttgaggtatcaacttggaagacacaccattacttctgcattttattggtttaagcaagtcacagggccaactcaaattaaaggaatggagaaataaacttcacctgttgataggagtggcagtgtctcactgtaaaaggcatgtgtacaaggatgggattttacgtagccatctttgcaaacagtctaccacagtgtcttttttcctttcgagtgcttaaaaaaattgtttttaaataattatttggttttcagaaatttcactattgtgtatctagacacagatttcctttttatttatctgtttggggggtgtttagggcttcttggatctgtggtttgatgtttttcctcagttttggagaattttcagccttcgtctgttcttcgaatatttcttctgttccatttctccctttccgcttttctgaaactgaaattacatgtaggttagatcatttcattgtatcctttatacctcttaccttctctttggtatttttttataaatctttttgcttctctctgcttcattctagatacttccttttgacctatttaccagctcactaattctctcttcaggtatattttacctgttcttaaatttatccattaagatctttttttcagatctgctattacatttttataccattcttgactaaaattcttaatgctacaggactgttcttcttgtctgtttcttactgattctcatgttgcctttttatggactagacactgtagttttaaaattatttatagaaatgacctgagacctatgatatatttttcaagagaggatttacgtttgtttctagctttgcctaggagtcttcaatcattttaattcagtttcagggactgatttgcttttaagcagggctgtagtccctacaggggtggtcaacttcatttcactacctaatatacctattatgtgtggagtactttgctagatgttgggtaggtcttgtgagcagagcagacctctctttggtctgtatggagcacggagcttgattataattggcaggtgtgtgtgtgtgtgtgtgtgtgtgtgtgtaaataaataaatatttatttatttatttattataggccgggtacagtggcttacacctgtaatcccagcactttatgaagtcaaggcaggtggatcacttgaggtcaggagtttgaggccagccttgccaacatggtgaaaccctgtctcttctgaaaatacaaaaattagccagacgtggtggcaggtgcctgtaatcccagctactcgagaggctgcggcatgacagtcactcaagcccgggaggtagaggttgcagtgagctgagattgtgccactgtaatccagcctgggtgacagagtgagactccatctcaatatatatatgcgtgtgtgtatatatatatatctatatctttaagatagatatatttatatagctaagtaattaataaatatattaagttctatgaaagcaatgagtaggctgctatggttgtgaatatttggactacacaggggataagaatgggtctaccataattagcagggacaggttttgtttaagccaaaaactaagagggcttagaacagaaaccgccaggcagaagcagttaccagtgtgaagactagatgacaaccaaaaaagtatgtgggaggagggaggggaggttgcgcagtggggagttgagattgacttagaactgtattaatgagctttccccccaacccccatttttctcccatttaccttcagaaaaattagtgatttggctaccagtgaatctaggctccaggtgtagctctgtagttttggactagttacctaattcttcattcacaacaaaacagaaggagagaggaaaaagagagcaaacatggaattgggatgggaagtaagagagcacatgaggagagagactatgtcaagtttcttcgtattccttttttaattacagaagaaaagatgggataaaaatattccatcttatttctctgtttaaaagaaagagtaggccgggcatggtggctcacacctgtaatcccagcactttgggaggctgaggcaggcggatcacaaggtcaggagtttgacaccagcctgaccaacatggtgaaaccccatctctactaaaattacaaaaattagccgggcgtggtggcgcatgcctgtaatcccagctacttgggaggctgaggcaggagaatcgcttgaacccgggaggcagaggttgcagtgagccgagatcacgccactgcactccagcctgggcaacagagcgagactccttctcagaaaaaaaaaaaataataataataaaataaataaaagaaagagtaaatgaatcaaaatgaagagaagccattttatctgcctcctggatgaagagtttcattgatgaacctgaaatgttttggttaacatgagaaaggagggtgagaagatgcctgagatgtgagctccttgaggacaggagctgctttctctctccagcctggcacaagacaaggaacttagttgaatgaatgagcaaataagtggttctctgctttgaaggaacttggactgtcattaccttgcaaatcaggtttaccatttatttgctttatataagttccagaaagaaactatttcctctcataatattactaccctaaacttctggtctgatctatggattgtagagcttaaatttcctcaaaccccaacagtcagagattgttacaccaagataaatagcatatttctcagcgccttgtattttctgtctttggccacagaccttaggacttaggctgatatttgagaaggaaaaactggaatttagtagaattatacttcctgtatcttaattttccaactcttatataaggtttgctttttctagagagagactaatctggaatgagaatgaattctcatcagtaaaggcaaagctttaagtgggtcatctgactttgcttttgtgctctacattcaccctgctcataaaaggtcctttcatgagttttctaggctttcatcactgccagcgtctccacaggcattgtgaaagtattaaacttcctaccctcccccatgcttgtctcatggactctttcgtagagtgcacagtggactgtgtttagctcagcaggaactctttgcaaacactgaatacatgaacaacccccctggaaagataagagatttcagtattgcttggtgtcatagccgcagaagttagtgtctgccagtatctgatgaatatggtgacttgcagcctaatttttgtgaaattatgaggccaaagtttaagaagtgttcatgttaaagttacttatatataaaatttgcctatcgataatttctgtcaataggaggttgatgaatgcttcacataacctagatactcctaattaactgttttttatttctttttttctaggacacatgttcaaagagcataattaactttttaaaagaagctagtaagtactgaaatagttttttaagttttttctacaagaatagaggaagaaaggaaacatggaattctgaagggctacttagcaagctgcttatggcataatctggggtgggggtgcatagtaaaggatttgcattttactgagaccgatacatgtcaagggaatggtatttaaaattagtgatatgtgttgatttttcaaggactatagcccatcaactacaataggctccaaaaaattctggtgaaattagcttcttggagccttccagtttacctactatgttattcccactataaaatattctcaacttttggggttttagccacttaagttttttattttctctaatgtctctagtatctgctttagtttcctgtcaatgctagactctgtggttcagcagttcatccattctcttcccagtactcaacctcgttgcttatagtttcattacattcatctagcaaaaccttaattctgtatgtttgccataccattagtgcttagagcattttttcagaaaagaatcctggaaaaatggatcttatctcacctgggccctcaggactgctgggctgcctggtgtcagcacttcccgccattttctatagcaccagtattattcttaatactttaaaaaaccaccaggcacggtggctcacgcctggaatcccagcactttgggaggccaaggtgggcggatcacaaggtcaggagatcaagaccatcctggctaacacagtgaaaccctgtctgtactaaaaatagaaaaaaattagctgggcgtggtggcgggcacctgtagtcccagctgctggggaggctgaggcaggagaatggcgtgaacccgggaggcggagcttgcagtgagccgagattgcaccactgcactccagcctgggtgacagagcgagactccgtctcaaaaaaaaaaagtaaataaaaataaaaaaccatatcccactatctcccccttctctctttgcctgtgatcttgctgcatacttatggggaaatctttaagatgtcagatttcagttctctcacttttctacaacttctcccacttttgcctttcttatgtaccttcccttccttcccatctgattccttatcagtatttacacatgattagttcttgcctaacctaatagaccctttcttgagtgcaaatcagtggctatttttgctagggtataaaaattacctatctaatcaccttgacaaagttaccctgttatttccaataacttacttcctatggattcttgtagattttcttttttttttttttaatttttttattttcagatgttttctcgctttgtcaccatgcctggcctaaattctcgtaggttttctatgtaaacaatcagattttctgcaagtattagtctcctttctaattgttataattttaatttctttttctttttaaaatttttcgtagagacaaggttttgctatgttgtccagcctggtcttgaactcctgggctcaagcaatcctcccatctcagcctcccaaagtgccattacagtggcatgagccactgtgcctggccaaatttcttttcttgttgcgaaggcagacttttcatacaatactgaatagaagtgatagtagattactttatttctgattttcaaaggaatgctttccgtttctctctgttgaagataattgcgtattgtttttttttttaaatagtaacttttatcaggttaaggaaggtttcttctatttctatttaaaaggattttttaaaatcttgaattcatatgtttttatctaatgcattttctacatcagttgaaatggttgtatgaactcttttaatatgggtgaattatatttatagattttatgttaaaatatccttgtatatcttggataaactcaactggatcatgatttatcttttttatatgctagattcaatttgttgatactttgttatgatttttgaatatatattattgtgtaaaagtgagcctgtgattttctttcttgtaatgtttctgtccagttttggtgcctggttttgctctctccttagaatgagctgggaactagtcactcttgttttctcacctataatagcatctgggtccagtgttttttatgtgggacaaatttgaacttgtggtcaacctctttaattgtaagaatattcaggtcttttgttcttcctgggctagttttttattctttttctagagattcgttcatttttcttagttttatttgcctataattgtggataatctgttttttatctgctacttctgtaattatttccacatttgatttataatattaacttgtgggccaggcgtcgtggctcacacctgtaatcccagcactttgggaggccgaggcgggcggatcacgaggtcaagagatcgagaccatcctggccatcatggtgaaaccccgtctctactaaaaatacaaaaaaaaaaattagccgggcgtggtggcaggcacctgtagtcccagctactcagaaggctgaggcaggagaatggcgtgaacccaggaggcggaggttgcagtgagccgagatcgcaccactgcactccagcctgggcgacagagcgagactccatctcaaaaaaaaaaaaaatttacttgtgtcttctctttttacctgtttgttaatttatcaaataactacttttggctttgtttcatttttattatacaataaaatgaaattcttttcattgtatttcttttcattgattattcctataattcttaaacaactttataattgatgtaacaataacctgtacacatttaaagtgtaaaatttattacattttgatccatgtatatagcagggaaatatcaccacaacaagagtgtgaacatataatctctccccaaagttttcttgtgtcttttataatcactgcctcttgcccctgcccactccctcatccttaagcaaccattggtctgttttctgccactatagattagattgtattttctagagttttatacaagtgaaatcatgtagtatagtattaaccatgtgtttgtttgtttgtttgtttctttctttctttcttttttttttagacggagtctcgctttgtcacccaggctaaagtgcagtggggcgatctcggcttactgccagctccgactccggggttcacaccattctcctacctctgcctcccgagtagctgggactccaggcgtgcccgccaccacgcccagctagtttttgtatttttagtagagacggggtttcaccatgttagccaggatggtctcgatctcctgacctcgtgatccgcccacctcagcctcccaaagcgctgggattacaggcaggagccactgcgcccagcaactatgtgtttctgatcctttgtcagggctagccaattcctagagacagtgaataactcactcataatctagctgcctcctttatgtcgctctcataggactttgacacctctctgctacaatccacctgccctgttcatttcaagatcaggtaccaggaaactcgggacatccctatgctgcagaactcactgaaattattcaaactagccagtcctaaacatgcttaccctgccttgcccattccttccgctgaaaccacataaaggctcttgcccatgttttcatcccattccattgacctccttactgaccctagctagtgcttcctcatgtggcccctgcatggcatggtgtgcaccttcctcttcggaactgcgagtaactgtcttgtcagcggcaatcatcttgtgatctgttggcctcatcatatttgaataacaataaaatctgttttaaggctgggcgcggtggctcatgcctgtaatcccagcactttgggaggccaaggcaggcggatcacgaggtcaagagattgaggtgaaaccccctctctactaaaagtagaaaaattagctgggcatggtggtgcgtgcctgtaatcccagctactcaggagactgaggcagggaatctcttgaacccaggaggcagaggttgcggtgagccaagattgcaccacggcactccagcctggtgacagagcgagactccatctcaaaaaaagaaaaaaaaaaaactgtcaaatgatactccaaaatggttgtaccattttatatttgcaacaacaatgtctgagggtactgattgctccatatccttgacagcacttggtatagctgatcttttaattttagtcactttagtgggcatatactggtattttatgttttactttttattttcctaatgattaatagtttgcagcatctttcatgtgcttatttccctttcatatatcttctttgataaaaatatctgttcaaatattttgcccattattttgttggaatacttattttcttactgttgagctttgagagttctttatatatctggataccaatcctttgtcagatatattttttgcaaaattttttcccagcctgtgatttagtttgttattctcatgtcttttaaaaaaaattgtagttaaaatatacacataatacaaaatttaacattttaactctttgtaagtatacagttttgtggtattaagcatagtcacattgttgtgcaaccatcaccgccatccatctctggaactttttcatcctccctgactgaaattctgtacccatttaaacactaacttctcattcccccttactccagcccctggcaaccatcgttctgttttccttctctatgagtttgactgctctaagtacttcatataagtggagtcatacaatattttcattttgtgactggcttattagtataatgtcttcaagtttcatccatgtggtagcatgtgtcagaatttccttcctttttaaggctaacattccatcctatgtatataccacattttatccattcatctgttgatggacatttaagttgcttcctccttttggctattgtgaataatgctgctgtgaatgttgttgtataaatatctgttcgagttcctgctttcaattcttttgagtatgttcccaaaagtagaattgctgggtcatatgttaatactgtatttagttttttgaggaattgccatactgatttctatagtagtggtaccatttacattccaaccagcagtgttcagggttccaatttgttaacattcttgccaacccttgttgttttctggattttttttattttggggttttttattttatttatttattttttttttgaggcagagtctcactctgtcacccaggctgaagtgtagtggcgcaatctcggctcactgcaacctctgccccccgggttcaagcgattctcctgcctcagcctccgagtagctgggactacaggcgcgcgttaccacgcctggctaattttttgtatttttagtagaggtggggtttcactgtgttaatcaggatggtctcgatctccggaccttgtgattcacccgcctcagcctcccgaagtgctgggattacaggcgtgagccactatgcctggccattttttatttttaaacaatagccatcctaatgggtatgaaataggttttttggtgttttgttttttttttttgagacagaatcttgctgtgttgccctggctggagtgtagtgacgtgatctcggctcacctcaacctccgtctcctgggttcaagcacttctcctgcctcagacttccaagtggctgggactacaggcgcccgccaccacacccagctagtttttgtatttttagtagagatggggtttcactgtgttggccaggctggtccacgatccatccaccttggcctcccaaagtgttgggattacaggggtgagccaccatgcacagccagggttttgttttgttttgtttttactatttttttttttttttagagacaagctgtctcccaagctgtagtgcagtggcaccattcgtatctcactgtaacctcaaactcctggacccaagcaatcctcctgcctcagccttccatgtagctacgtctacaggcatgtgccaccatacccggctaactttttttttttttttttttttgagagttttgctcttgttgcccaggctggagtgcaatggcatgatcttggctcactgcaacctcctcttcctgggttcaagtgattttcctgcctcagcctcctgagtagctgggattacaggcgcccgccaccacgcctggctaattttttgtatttttagtagagatggggtttcaccatgttggccaggctgggctcgaactcctgacctcaggtgatccacccaccttgacctcccaaagggctgggattacaggcgtgcgccaccacacctggcccccagctaacttttaaatgtattttgtagagatgaggtctcactgtgttggccaggctggtcttgaacttctgagctcaagtcattctcccacctcggcctcccaaagtgctgggattacaggcatgagccaccacacctggcccctttgcccattttaaaaattaggttgtttttgttgttgttgagttgtaggagctctttgtatattctgcatttcggttccttattggatatgtgattggcatacattttttcccatccatggattgctttttcattctgttatagtatccttgattcacagaagtttttaatattgatgaggtcctgcttagtctgtgttttgttttgttgcttgtgcttttggtgttatatccaagaaatttttgccaaatccaaagtcatgaagctttgccctctgtttccttctgagttttatagttttaggacttaaatttaggttttcgacccatttttagttaatttttgcaagtggtataagggaggggtccagcgttattgtttcacgtgtagatatacagttttctgagtaccatttgatgaaaaggctgtccattgaattgcttttgcaacttttatttgggcatatttatgtgagtctgttactggttctatattttactccattgatctatgtgtctattcctctgctaatactgtcttaaatatggtagctatatagtaagccttaacactgagtagatagatttctcccctttttttgttctttttcaaaattgtcactggtttgtttttattttttactttatgcagataatctgtactatactttggtttcatgtatcaagtagtttgttccaagttgtgctttaagcagaacaaataaattttcatattgttctttgtgttaatctgcaatataaacctataccaaattctattttgtgtatttgtttattgtagtaatctgactgactcttttgcctccagactcatctctttcaaggtccccaactgaatcttgttttaggtggaacttagaagcagtagaagttaagaatctatttcacagccttagtagtctagtttcattctctatataatgttgtctatgcaagtgagctgctctccagtgccttagtttcactaatgttggggaaggtctcttctcttgttttggacttctctatcacattgcctttctcaagagaagacatataatgaaagttgatatctggtgttctaggacttcttcagaagcttgccagtttttcaagctgatttctctcactggcaactcttcagagtgctgttcctactccaccctcccctggtggtatgtatcagttttctactcatcagcacccacctactcctgcctactgtgtttctcagatgtctgctgcctggctagctcattgctgcttttgtcactcatagagctgtcttcttccctttttttggctttctgcctgacttccagggcagctgctctgtcattgcctgtctgccattctgtcttttttccccctaccccccacagatacaacatctactctaataccacacattctccatgttcaaactaacctcatcactttccccaccacattccccaaaactggtcatcctccagcttatagcattgcagttcactgaagttagacatctgggccttgcttacctccaacatctcattagccttcgattctacccctataaatcctcttctcagtctcctttagatattcctgccctgctgtgagatccatctggtttattggctagattacttcagaaagcttcagtcagtgaccctccttacttcaaaccccaccagttgatccttcactctgccatcagtcattgcttctaaaatctaaattgttccatttaaccttgctgtgataaaacctttggtagttcttcagtgtgttcagtggtaagttaaaactttcactgtaatgtacaggccccttcatgatatgatcgctgcctcctcgagcctcattgtgtgcatttccccgccccaccctttcctcacccaccctagtctttcatgtctgccatttttacattcatttagcagatatttattgaagccccctgtgatgtccttacctaggtctttcttgttgccaggaccagacaggctttttcaagcttccaagtcatctcagtttgaaagactatgtctgacccttgtcttggccaattactctttatccttccaagttcaatgattgtcccactgcactccaaccagagtgagagagcaagaccctgtctcagtaaataaaaataaataaataaataaataaataaataaataaatcagccataatttatttaatcatgtctctctcccccattgatagacgttaagggtatttccagtattcttctcttgaaaacaatgctacattgaataaccttgtacatgggtcactttgaaagtatggatatgtatccgtggaataagtttccagaagtggaattgtgtcagaggggttgtgcatttgtaattctgatgaatatttatagattatatgagagtacctgtttactcaaactcttgccaatgcagcattatcaaagttttttatgttcgccagtgtgatagattaaaaaatggtatctcagccaggcgcagtggctcacgcctgtaatcccagcactttgggaggctgaggcgggcagatcacggggtcaggagatcgagaccatcctggccaacacagtgaaaccctgtctctactaaaaatacaaaaaattatccaggcgtggtggcgggcacctgtagtcccagctactcggaaggctgaggcaggagaatggcatgaacctgggaggcggagcttgcactgagccgagatcgcgccacaacattcgagcctgggcgacagagcgagactccgtctcaaataataaaaaaaaaagatggtatctcagcattgatttctttgatcatcagtgaggttgagcatcttttcatagatttaagagaactgtatggttttttgtgagttatgtttcatatcgtttacccattttacttttaggctggaagcagctgttttagtggaatggtggaacaagaagccagattgccatggagagacaactctttctagagatttggctatgaagcagagtagagacaatgatagctgaaggattgatgtagatgcaaagaaatttttcatcttctttgaaaacttaattgtgttaaaaactggtatgaaagggaggggttaaagctagagatggtggtagaaaaaaatgcagggttcctaaaggactgagattcctggatggaatttcagggaaggggaaaatttctggatatagtgactggggagttaagggtgtctagtccaatggcttttattttcttggaagggtaggcaaggccaacagccacatgtgtgggaggagatggttagaggggagaggaggtttgaaggcaccgctatggagaattggagagagctaaggaaagacagaaagactgcagaaagtgcttagggttccactgaagcggaaatagtgatttgtagtgatacaacccttatgagttatttgatttttttttttttttaagcagcatctggcagtccaagtatagggctgacagtttgggatttttctttccatgttggtgtaaaagaagaacagtgtagtgaaggaagttaggacaaaagaatgattgaactgacaccaagttttcttgatttggtagaaaaggaaataaagatagagcagagatattgaaaagaattagagaggggttcaagagactgaaggcctgggtgaggtcagagagcaggtgtggtagacataacagagagaactacaaggatagaaagtgtggttggagagtgggaaggcaagatttattcagtatgggggcttttctgggtgatgacagcatctggagtacagccattgtcgtgagtggcccaagtgtagcagagataaagcgttgttggagtgaaggaagtcaaggaactgagaggctggcctagatggggattttggttgtcatccatgaggatattgaagtcatccaggagaatagcaggcctgggggacaggaaggaaactgagccacttacagtgtcttcagtgataggaaagcacagggcaaaaagctttcaagaacagggactgttaagccgggtacagtggctcacacctataatcctagcattttgggaggccaaggcgggtggatcacttgaggtcaggagttcaagaccagcctggccaacatggtgaaaccccatctctactaaaaaaaaaaaaaaaaaaaaaaaaaaagaaatacaaaaattagccaggcatggtggcacgcgcctgtaatcccagctacttgggaggctgaggcaggagaattgcttgaacctaggaggcggaggtggcagtgagcctagatcacaccactgtactccagcctgggcaacagagcgagactgtatcaaaaaaaaaaaaaaaaaaaaagaacagggactgttagagcaggctccaggagaaatgctttgcatatggcattcttgaggagtgaggaggacctcaaccctacttcctgaaatggagctctgagatgttggagtagaaatttggaaaccagagagagaagtaaggatagtgttgttgcaaatgcattgtatatggggggtcgggaagtcacaggagtttgcctcaaagtctttctcggagacggatgaggttttcactgtgattttcctggtcgtggtctatggatatagtacctgttagtgacatggatcttcttaacttctgatgtgtcttttcctccctagtgtacgcataccaattctctccacagcttccatcaccatgcatttgttcttttcccttgttcttgtattacctttctggaaaggaatttttattgtaggctaattgttactcccaccagtatttaaccactggatatttcatatgattgatctcttctgatttggaaaataaaaatgtaatctcattatattcatttgattagtggggacagtcaacacttctttgtgtattttcttagctgttcgtttttctcgtctgtaaattatctgtttaggtccttcagatttttcaaaattggactgttatgttttcagtattgttatgagttcttgtttcaattatttatgacagttcattttcttttttaaaatagactttttttttcttagagaaataagaaaaaataaaaattaaaatagactttgtgttttagagagtttcaggttcacagcaaaattgatcaaaaagtatggagagttccggccaggcgcggtggctcacacctgtaatcccagcactttggaaggccaaggtgggcagatcacaaggtcaggagtttaagaccagcctggccaatatgatgaaaccccatgtctactaacaatacacaaattagctgggtgtggtggtgcacacctgtaactgtacctactcaggaggctgaggcagaagaatctcttgaacctgggaggtggaggttacagtgagccacagtcatgcccctgcactccagcctgggcaacagagtgagactccgtcctaaaaaaagaaagaaagaaaatatagagcattcctaaataccacctgtccccaacacctgcacagcctcctcattatccacatcctacaccactgtggtacctttgttgcaattgatggaccaacattgactcctcattatcacccaagctttggtgttgtacattctgtagatttggacaaatgtataatgacatgtgtctaccattgtagtatcatacagaagaatttgactgccctgacagtcctctgctccacctgcttactcctctctcccttttcctaactgcacaaccactgattttttttttttttttttgagacggagtctcactctgtcccccaggccggagtgcagtggcgccatcttgggtcactgcaagctccacctcccgggttcatgccattctcctgcctcagcctcccgagtagctgggactacaggtgcccgccaccacatccggctaattttttgtatttgtagtagagacggggtttcaccatgttagccaggatggtctcgatctcctgacctcgtgatccgcccacctcggcctcccaaagctgggattacaggcatgagccaccacgccctaccttttttttaaaaaacaaggtcttgctctgtcacccaggcctgagtgcagtgatgatcactcctcactgaagcgtcgacctcccaggctcaagtgatcctcccacctcagcctcctaaatagctgagactacacacacacaccaccatgcccagctaagttttgtattttttatagaaatgtggtcttgctgtgttgtccaggctggtcttgaactcctgagctcaagcaatttgcctgccttggcctctcaaggtgttgggattacaggcatgagtcaccgcacctggccttttttattttctttttttttttttaaccagtgatcttttactgtctccatggtttttcacattggcttctgtcacttagtaatatatgtttaagtttcttctacgtattttcatgtttttagcttatttctttttagcagtgagtaatatttcattgtctggatgtgccatcacttatttatccattcgcctgctgaaggatatcttgattgctcccagtcgtggcaattataaataaagttgctgtaaacatccatgtgcaggttttttttaagtggcataagttttcatctcatttggttaaataccaaggagcacaattgctggatcatatggtaagagcttatttatttttttgagagactaccaagctgccttccaaagtggatgtaccattttgcattcccaccagcagtgaatgagagttcctgctgctccatattcttacaaacatgtagtattgtcaaatgttttggattttaaaaccaaaatccattttcatagatgtgtagtggtatcccgttttaatttgcaattacctaatgacttgatgttctgtgtcttttcagatgcttatttgccgtactgtttatcttctttggtgaggtgtctcttcaggtcttttgcccatttttaatctggttgttatttttcttgttgagtttaagaattctctgtcctttgtcagatctatcttttgcaaatattttctcctagtctgtggcttatcctctgattctcttggcattgtctttcacagagtagacattttatattttaatgaagtccagactatcaattatgttctcatggatcatgcctttgatgttatatctaaaaagttctcgccatacccaaagtcatctagattttctcctgttatcttcttggcattttatagtcttatgattgatatttaggtctatgattcatttttagttaaatttttgtgaaagataataaggtctgatatggattaatttttctatatgtagctgtccctttccagtatcatttgttgaaaagactatcttgctccattttattgcctttgctcctttgtcagttgactatatttatgtgggtctgtttatgatctctgttccgttccattgatctgtttgccttttcttttgctaataccacagtcttaattaccatagctttaaagtaagtcttgaagtccaatagcattaatctttgactcttctttaatattgagttgccccttcagaatcttaatgtctctccatgtaaactttagaatcagcatttttatattcacaaaataacttgctgagattatgattgagattgcattgaatctataggcttatttgggaataactgacatcttgacaatattgagtcttcctgtccataaacattatttatgatgggcttcttctttatgtttaggagcttttgttttttctgtcagatattccacttctacctttatgatttcttaattgccttttatgcttagaaagtttttcctcatcctgagctcacatattcatttattttcttttaaaatgtgttttcaagcatttaatttttaaacctatgtggaatttattttggtatatggaatgaggtggtggtctaactccctcctctcaaatatgtagttatttttcccaaaaccattttctattaatttatcaagaatagacatgtatacatatacatatataatagtcagccttccacttgttgtttgacccttgtgaaggaaattgtatgagtttccaattttggattaggctcaggtagtaattgagctgggttctgccagagatccatgttaattcactatccaaacagagttataaaatgtaagttttatgaaaatctaacagtatatcactggtttaatgatcacagcctaggaagaatggggaaattgtcaaaatcttctgtggatgcacctgaaggccactgctgaacccatttccctgctaggcacggctgctggtaccaggggcaaactcctggagtatatatgaaccacctacatctccttctcttccccccctacccttgagattttcatgtgtcccttaaggatgtgtgtcctacttcccttggagagtcactaccacattgaacactttagactgtgagtcctgtgaagatggggctcatgagtgtattgctccccagttgtttctctagcactagctcagtatagggcataaaaatctgaatggatgaacaaaccactattactggtggggacatgctactatcttacatggttcgaggtggaataaaggttgagaacagctatataatgtgttccttgaagggcagcagtacatcagtgcaatcagcctaccttctccatacttctcactctgaaaactgtaaagctgcacctagcaatcaacttgggagctttaaaagggactgctccctagctctcacccacaaagctgtagtctagcacaggtgacttttttaaaaaagttttttggtccagatgtgatgactcacgcctgtaatcccagcacttcgggaggctgaggctgggaggtcacctggggtcaggagtttgagaccagcgtgaccaacatggagaaaccccatctctactaaaaatttgccgggcatggtggcacatgcctctaatctcagctactcgggaggctgaggcaggagaattgcttgaacccgggaggcggaggttgccgtgagccaagatcacaccattgcactccagcccgggcgacagtgcaagactccgtctcaaaaaaaaataaaaaaggagtcctattaagacttatttttacaggttggatatctctaatcccaaaatctgaaatgctccaaaatttgaaactttttgagcgcagacatgatgctcaaaaaaatgctcactgggacattttggatttcaaaatttggattagggactaggtgtgggagctcacacctgtaatcatagcactttgggaagttgaagcaagaggatcagttgaacccaagagtttgagagcagcctagacaacatagtgagacgccgtctctacagaaaattttaaaaattagccaggcatcgtagtacatgcctatagtcccagctactcaggaggctgagacagaaggatcacttgagtccaggaggtagaggctgcactgagctatgatcataaccactgtctccatcctgggcaacagagcaagaccctatctcttaaaaaaaatctgaaacactgctagtcctcaagataagggatagtcagtctttataaagactcaattagttattggatatctgaggaagcatgcatatcaggctcccaaaagatcattggtttaggcacacattttaatagcttggaaatccagaatactcttctggtgaccagctcagacatagtcctgataatataggacctcatctaacatgactccctattttccagataagcatggattcctggttcattcttgttctgctcggcagtggtctgatatgtgtcagtgccaacaatgctaccacaggtaaattgtcatttgataaggctgctatttgaaatgaaattttgctttcacatttaatgagccacatttgaaaaccgagatggtatttgaagaaaggaatataaaaattttattcaaagtgatggtaaaataggtgtcttcagaaatcttggaattgaatgctcagcattgtttttcatacatacataactgctttaaataaatcaaagagattatgtgttctttcctgaaaagtaaaataaattgttgacatttacaactctatatatggtttctgaggaactaagtgaagaatcttgtgtctttctcccttaaaccgtagtcctttggaggaggtaggaaaggtccagcatgagataaaaacgtagggggtgggtggtgttgagggggattggtctttgcttggtctccatatgtttgagagtttattaaggcttgctgctttgtgtctcacagctttttagcctcacattcttcatgtgctatttccttgttttttggtgtttgtagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtactagagatgattctgtttgttcttttgctctttgagtttagtcttccttttattatcttgtttgtgttttctagccttaaaatttcttcaaataagtaaaattgctcaagtgaagtaatgaaacctgtatgtggaatttttgggttagcatgagtgaagaggaaagaagaaagattctggagaatatctttctgctaggtgggatcctggttagattgagaggacttaaatgtgtttaaaggtagagaagaaggcttaaaaagacaagagaaatagaggagctcattgacgatgcaagagactgaagatgaaaagatacagagaatgagtaataagattaggtttggaaagggagggatccgtggagaccatggaaaggagaatgggtattgatgtccatgacagttagatgtgagatacagagaatgagtaataagattaggtttggaaagggagggatccatggagaccatggaaaggagaatggacattgatgtccatgacagttagatatggagtggcaggccagtggccaggggtggcatcaggctctgggaaatggttacattgcagtgccagttgttcagggcctcaggttgaagcagtagtcccaaggagaaaatcagagacgtggatctgagaccagggcaggtaagacaagtttctgacctctttgaaccttaggtaccttgtctgtaaaagaggattagagataccctcaaagggcttctatgaggagtaaaggaaataatcattacctgattgctatgtaactgtcatcccttttctagcaaaaatcactctttcctcttctgtgttcccagttagatggtgagtgcccctaagcagaatcacatctcgctcatgtggaacattcaggaactgtttgctcagttgattctcatttgttactacagatgatatcttttactgcgccttataactcagacccttcacctgccagcttttccccatattttctaccgtaaagacaagacagcatttgcagttaagagcacagtcttcagtgccacactgagtttgaatcccagctcttccataaaccagccatgtttatggcatagctggcttactttatctctctacctcggtttgttcatctgtgaaacaagaatgagtgatagtaatagttcttacctcatagaggagatattaggattaaacaagttaatatgggtaaagcacttataaaggtgcctacacatggtaagcactatttttaagtgtgagctgttagtattgttgtggttattgctctgatagttaccagtaaaatatatgaaggtacctttaatgcagatggcatcccactattcttgatgagataggggactgcagacaaataatgtctgatacttgctttgtgctttagagttaatgtagttttgtcatagttattactgtgtgctaggcatcgtactaagagttttctagaataatcctatgaattaagttctattttatgttttataggtgaaagtattttacaatgatgaaaccataatttgtggaatgtttttcagtgtacaggtcatgacacaattcatgaaatcactttagcaggccaccactagttgtttgttttgttttattttaatggatgatccagttccatgtttattcttttaatgttacatacaattttttgaaattttagtaacaacataaaatgttgggttgtggccattgcttagggagaaaggcaggataacttgtacaaactgtatgagtgaatggaaaaggtggagactgtaacacaggcctgactgactgaacagcccatgttctattgtgtactgtctttcatttaacagttctgtgacatgaccatggataatcatctccttttaacagatgcttgatttcagactgtatatagaggttaaatgatttgttttagatctcaaggctgacaaattaggcctatttctcacttttgcggtctttccactctgcttgtagggaacttagttttccataaactgacttaggtccaaattgtgccacagctaagaatctagttattgtacatttaacacagttcacgtcataggaggctgagactatgtttctctagtggcgtttattcaagatgagtaaaacacaagaaaccattatcgcacatgggaatttcatagtcttaaaccccacatcccacttatcaccaccatttaccagtcctcctgtaacagttacaattttttattaaatcagtatttgatgtatattattgtaattatgaaatattcattgctgagctataagtataaatggattgtttttcttgtacagttttttttctggatttaatacttaccttattttttgtttatttagttttctatttagtcaggccaggcacactggctaacacctgtaatcccagcactttgggaggccaaggtggacagatcacttgagctcaagagtttgagaccagcctggggaacatggtgaaaccccatctctacaaaaaatacaaaaattagctgggcatgggtgcatgtgcttgtagtcccagctactcaggagcctgaggtgggaggattgcttaagcccaggaggttgaggctgcagtgagctgtgttcataccactgcactccagcctgggtgacaaagcgagaccatgtctcaaaaaagttattgctactcaattcttaccatgctctccagagcctctcaaaacagctttctacaaagtgagatctgttagataatctatttcttttttacctctagaaattcctcctgagccctccattgtcttattccagtctaggcttgtcgatctctagggctactacacagatacatcagcctgagatttcccttctctgtcattctgggaattccccttgctgctgcttcctgacttccatattgtcttcctttttgtcttctcatcattcggtagattcctgagaaaaggggtccatgggaggcaaattgcatccttacatatctaaaaatatctttagggctgtgcatagaatttgaggaatatttttcccccagaatttttaaagtaatgccctaactgacacctgtttaccaggtttggaggattttactgctatcttaatccctaattgtttgtatgctttctaggatcttctctttatcatcagtatcctgaaatttcacagagatgtatcttgatgtgggtctttttcgttcattattatggatacttaataggccctttagagccttgatcttgcatttctgaaaattttctcccatttctttgaaaccttctccccctcttccttttttttttttctcaaattcttaatatttggatattggatgtatcctgaattaattctttaatctttaaaatttttcctttctgttgatctttgctttgagtctttttctccttttaaaaataaacaaaggccagctaggcacagtggcttatatctgtaattccagcactttgggaggctgaagcaggaggatcgcttaagcccgggagtttgagaccagcctaagcatcgcagcaaaacctcatctctacaaatgatttagaaattagcagggcctaatggctcatgcctgtggtcccagctactcagggctgaggcaggaggattacttgaggcctggcagttgaggctgctgcagtgagctgtgatcgcaccaccgtactccagtctgggcaacagagggagacctcatctcaaaaataaataggcctggtgtggtggctcactcctgtaatcccagcactttgggaggccaaggcaggtggatcacttgaagccaggagctcaagaccagcctagccgacatggcaaaaccctctgtctacctactaaaaataaaaaaattagtcaaacgtgttggcatatacttgtaatcccagctacttgggaggctgagacatgagaattgcttgaacctgggaggtggaggttgcagtgagtcaagtccctgcactatagcctggggaacagagtgagacccgagactctatctcaaaaaaaaaaaatcagtgacaagtaaaaaggtagaatacctttttttttttctttgagacagtctcaccctgtcgcccagtctggagtgcaatggcgcagtctcggcatactgcaaactctgccttcagggttcaaacaattctcctgcctcagcctcctgagtagctgggattacacatgcccaccaccacacccagctgttttttgtatttttagtagagacaggtttcaccatgttggccatgctggtctcgaactcctgacctcatgatccacctgccccggcctcccaaagtgctggtattacaggcgtgagccactgcgcccagcctagaataccttttaaaaataaataaataggccgggcgcggcggctcatgcctgtaatcccagcactttgggaggctgaggcgggcagatcacgaggtcaggagatcaagaccctcctggctaacatggtgtaaataaataggccgggcgcggcggctcatgcctgtaatcccagcactttgggaggctgaggcgggcagatcacgaggtcaggagatcaagaccctcctggctaacatggtgaaaccccatctctactaaaaaatacaaaaaaaaattagctgggcgtggtggcaggtgcctgtagtcccagctactctggaggctgaggcaggagaatggcgtgaacccaggaggtggagcttgcagtgagccgagattgcgccactacactccagcctgggcaacagagcaagactctctctctaaataaataataaataaataaataactccttttacaaaagcatatatattcattttttccatttataatataaataatagatatgctgagttgatttctgcatattgctttttcagttaccctatcatacttgctctttgttttagtaaagagctgctgtattgaaggatataccttaatctctttatccagtttccccatcagtggacactaagattgttttcagagtactcttataaacaatacagtttgtcatttcagacacatatgagaatattagcaggatgaattattttaagtctgcatttataaatttatggatattgccacatttacctctgctaggaagtctattcctattaacaatatgtcaaagtgcctatttttctaaactctcttcagtgtggtgaattgttaaacttggggatctctgccaatctgacaggtgaaaaataacatctcagtgtaagtttaatttgcattttgctgagattgagcaattttgtgtaatttaaaagatcatttatttttctgagcattctctgttgatattctttacccatttttattagagtgtcaaggttttcctgactcgtttgtagatgttctttgtacgtttgggaaatgagtcctttgcctatggtaaaactgcaaatgttgttccctaggtggtcatctagattttctgcattgcagaagatatcattagctatttttaatttttttaatttaaatatttctcagtttaggttttctaggaattgggtcatatctaggaaggctttccttactccaagattataaaaataattttcttctggacttctatggtttcgtgtgtgtgtgtgtgtgtgtacacgcacttaagtctgtctcgaatttattctgatgcagagtgagctatggatctgtttttccccaaatatctaacttgtcccaataccccttaataatttatttttcctcattgatttgaaatgccacctatcttatatattgaattcagatatttatttacctcttcatatgtatttgagtatttgggaacattcattttattttctattaatctttttctctgtccatgtgcaaagcctcactgtctcaataattgtaactttgtaaagtatttaatatccagtaaaatgagtcattccttgttaattttatttttcagaattttgttagcaattcttattataaacattagaattaacttgtctagcaggaaaaaaagtttgtattgatcatgttaaatacgtagattaacagagaaaatggcatcttacagatgttgagtctaactatccaagaatgcaatatattccattttctgaagtcttttttttttaaatcttctgtttttgtaattataaatggagcattttcttccatcagatcttctaactggctgctgttggggatatgaaggctactgatttttgtagagacattttgtactggccaccttaaactctcttagtattggaagtaattttcttcattaatttttatggcttcaagtcatctcatctgcatatatcttccaaatttttagaactttctttttcttctgtttaatcgcattgatgaatacctccagaacaaagttaagcagctggtaaatgcagacagcattctcttgtatctgacactaaggaggacactttcagtggtttttcattatacgtggtactgactcttgagttgagataaacatattttattgtgttcaggatttaatgagcgtttatgttaggaatgggtgttaaattttgccagttgcctgttcaggatcaatgagaaagatctgaatgattttttttctcttttggtctgtttctatggtggattctattcctaggtttgtttgtttgtttgtttattttgagatggagtctgttaccaggctggagtgcagtggcgccatctcagctcactgcaacctccacctcgcgggttcaagtgattcccctgcctcagcctccgagtagctgggactacaggcacgcaccaccatgcccggctaattttttgtattttagtagagacgtggtttcaccatgttggccaacctggtctcgaactcctgaccccatgatcctgcctcagcctcccaaagtgctgggattataggtgtgagccactgcgccctgccagtttttatttattcattttttagagacagggtcttgctctgaattaattctttaatcttcttaatttttcttttctgttgacctttgctttgctttaagtcttttcctttgagtcatccaggctgaagtacagtggcacgatcatggctcactgtaaccttgaactcccagacttaagcaaaccccacctcagacttctgagtagctaaggactataggcgcatgtcaccacgcccagctaatttttaaattttctcagaaacagggactcactgtgttgcccagactggtcatgaactcctggcctcaagcagtcctcagccttagccttccaaagcactgggattataggcatgagccaaggccgcccaaacatattgtatcgttcctgtaacaagctgttgcagtctatttgatattatttcttatttttttcatttagaattttctctgtctagatattctcaaattatctctaaatgagattgatctatgtttttcctttgtgtgtgtattctttttgataagttttagtttttagtgttttgttttgctacatggaaaggatttgaaagtttacactaaaaaatatgctttttttttttaagacaggctttttcactgttgcctagtgctggagtgcagtggcatgatctcggctcattgcggcctgcacctcctgggctcaggtgatcctctcacctcagcctcccaagtagctgggattacaggtgtgttccaccatgcccagctaattttttgtatttttttgtagagatggggtttcgccatgttgcccaggctggtcttgaactcctgggctcacatgattctcctgtcttagcctcccaaagtgctaggattacaggtgtgagccaccacatctggccatttcattcatgttttcaaatgtatttgaatgaggaaaagttctcccttgtgattatttattataatagcctacagagctattaatttttaaattttgtttactttatgtctcctttttttttttgtttaggctgaataaccatttatttcataggtttattgccttttttcttccaaagaacttgctattgtgcatttatagtccttttatgtttacgttttctatttcattgatttttactttctaccttctttagatttattttgttctttttctatcttcttgaattgagtgtgctttaattgcattctttccagttaattaacatatttagtgctgtgaattttgaacaagcacagctttagccacatcccataggtgtttctataggcagttgtattaggatgcgctataagctgctctgacaaagataccaaaattcagtgacttaaataagaccaaagtgtctttctctccccagttacattccagaggtagacagggccttcgtctcagtagggaccaaattcctttcctcttgtggccctgccatcctaacaatattgcccttatctgtttggttagagatagttctcaccattgggttctagttccaaccactgcgaaggacaaacaaagggaataggggccatttctcttccaaaagatgtgacctggaagttactcacattgctttagctcacatcccgttggctagaattcatcacatgaccacacctagcacaaaggagtctcaaatatagtctgccaggagagcttggtgctcagctaaaaaacaaaggttctgtatcaaggcaagaagagaaagagactgatctgaggggaggagagttggcaggttctgtcacaaaacttctcgtcattgttatttttaaggtatttttccattttgggttttttgtttgtctgatttttttttttttttttgagatggagtctcgctctgttgcccaggctggagtgcagtggcgtgatctctgctcaccgcaagctctgcctcctggttcacgccattctcctgcctcagcctcccaagtagctgggactacaggcgtacaccaccacgcctggctaattttttttttgtatttttattagagacagggtttcactgtgttacccaggatggtctcattctcctgactttgtgatctgcccacttcggcctcccaaagtgttaggattacaggcgtgagccaccgcgcccggccgtctgtttgatttttgagatggaatctcactctgccccccttctggagtacagtggtgtgatcttgggtcactgcaacctctaccctcccaggtttaagcaattcttgtgcctcagcctcccaaagtgctgggattaaagacgtgagccactgtgcccagcccattttggttttgatttttttttttctttgaaatagagtctcgctctgttacctaggctggagtacagtggcatgatctcggctcactgcaacctccccctcctgggttcaagtgattctcgtgcctcagcctcccaagtagctgggattataggcacccaccaccacgcccagctaatttgttttgtatttttagtagagacggggttttaccatgttggccaggctggtctcgaactcctgacctcaggtgatccactgcacccggcctcattttggttttgatttttattttcaaatgttttcttactttgtcaatttctaattttattgcattgggacaaaagaatattgtactctttctactgttggggtttataagggctgtggatatttcactcgcctttgaaaagaaggttttctctgttagtctgtagagtttggtatgtaccaattagattttattacttatcattttggtcttttgtatccttacttaattttgtcctcttgaattttaatggagcaaaagacataaagtcctctaataacatgcgttctgtttgcattctcatactttttatgaatattgatgctgcactatttgtgtacccagggagaaggccagaccactgtccaaagtttagtgaatctgggcagccttgtttcccagttgttggaggatgcctcatggaggaaagcattcctaatcctggagcttgttttgttgtactctaattgaattgtaatgtgtttctttaacctgaatgaatgtttctattttttacttattacacaggtaattctgactcgaaggacagaagaggtgagctgctcaccttatatctgttgttccttttacacagtgtacagtattcatttatttcctctgctcacagtctgtggtaaccgtgtgcatctgtggctgtgttgtttgtttactttcccttaagttatttccatgttaatctcatggagaagagcaatagaaacaagtactgtattcagtatgttttttaatatagactatggattctaacagctatgatgtattttaacaagtaacaaaatatatcttactttgacatgtcactttgttaacattactttttggtgatattaggtcataatttctataccattagttacttctgatttctaggccacagttccctttaaatattctttgtgttgtttttcccctagtgtataaaatgtcaaccctttgtggctttatatggattttatggattttcagcccttaaatgtaaagtctctatggcctgagatgttgtgtctgtggtttaagctggactgctgagtccctggtcactagagagtagggggacatgggtacttgtctgcagaagtgtggcacattttgcctagaatgacagtaaggctgctatcaaagagcatgagagaaagagaaagagatcatctaacattctaagaagtgattattacatttgagttttaaaaatgttactattcgaagcagtgtttttatcataattttctattttatcaaatcagacttgagttttttttctgattctgttatttaaccatacacaattttccctgtgtaattaagtaatggaacacttggaggcatatgaagtcccactaagtagggagcatttgagtcagaaaagtgggtactctcttcctttatgtgatgtccatctgccattgtatttggtaaggaatagtgaggtgttaccatactgtgtacagatttccctcacttttccacctctcactttcctaaacttgggaactaaacattggattaatacagtgtctttgctgttcagattcacttgccagattttatcaaatgtagacttaaataggttttattgtgatagatatttacttgctccctaaaactgctctcttaaccagccttacaataaagtcaaaagtcaaagtggtaggcttcaagatgaaacataagatctgttgactccttcctctatttagtatatattttcataatattcagccttttcttgccccagatatcatatctattttacctacccaatatttaagtagtttccatgttgtgattaagaaaacaaaattaccataattacctagattattgctaattgtgacatatgtaaagtctattaatgtaataaatctcctttcttaagtcaaaaaataattttgtgtaattccaaacaggaaactgaaaaggcataggtattctcagcagtctctaaagtcccaaaatctaatggcaattttaccagagcagatctttagaagtattgctataaatttggatatcccattctaattttaagccaaatgctttttgagaaataagccagctgtttggaaatgcttgtattataatcggtttgataagcagttatgtcttatgcagatgaattaggggctacctgtttttatgcactggtctttggggtgcttttgaacagtagtgtctgatgttttaattgtcaaagcaaaaagaaatgagagggagggcaacttttcttcctcttctgaagtccaggaaactggttattttctcatgcatattattttaaaatatattccagccaggtgcagtggctcacgcctgtaatcccagcactttgggaggccaaggcgggtggatcacaaggtcaggagttcaagaccagcctgaccaatatgataaaaccccatctctactaaaaatacaaaaattagccgggcgtggtggtgtgcgcctgtaatcccagctactcgggaggctgagtcaggagaattgcttgaacctgggaggcagaggttgcagtgagccaagatcgcgctcttggctgcgatccagactgcactccagcctgggtgacagagcaagactctgtctcaaaaaaaaaaaaaaaaatcagactcttaatatttgtaaagaagtagtccttgagctactacttaagtctagaaagagttgatattcttgttttaagagtgttagggcactttgggaggctgaggcaggtggatcacttgagcccaggagttccagaccagcctgagcaatatggggaaaccttgtctctactaaaaatacaaaaattaaccaggcatgtggtacgtacctgtagtcccagccacttgggacgctgaggtgggaggatcacctgagcccaggaaatggaggttgcagtgagccaagattgcgtgactgtactctagcctgggcaacagagcaagactctgtctcaaaaaaaaaaagggcggggattatcatagtgccattattattatgagtttatgatggctttctctaagcaccttttacattcggcatttattcagtacctattaagcatcaaggagtccagaaaaaattttatatataaatatatataaaatatgtaaatatatatatgcatatgcttccctatctcaggaaggaaatatgtgaacatcaggaaccgaagtctactcagttacatgccattggatatatcacacaaagtgctgagggaactcagaaggctcattatatctggggagtgggaaggaggcacagagatgtgctttgggaagtttaaattaaaatagcaaatggggaaaatgaagacacaccagacagggcacaagcaaagagacatgaaagagtaagtcatgtgtttgaggatctgtgcgcagttgacatgtgtgaggtgtggggagtgatcagaggtggcctcaacagaatgggtgtggtggtccactgagttcaggagttggagcatctcctgaagatgatggtgagtaaggaagtaacatagtcagattttggttttagaaagatattccagaggacttaggggagatagatggacaatagaaatttaggtttctgaataatttggctcaaaacaacggtgattgggctcaacccagtggttagattctagaggcaatccaatgaatattgctgtttttagagccaataggaaacatttaaaacaacattacaaccttgcctttgagagctgataaatacttgtaccaaaaagtgtggcaataggtaaatgggccataggaactggggctataggactatggctattcctttactgactagtttgtagttgaccagtgtgtgtctgaagtccttaagtcactcacctgtttagaggtgagcccttcaattaatatggccctttgttttcaaggaaagaagttatagcaagtaggtatctgttgtcccgggacaccattttagtggttttcattttcatgcttgctccctggcctgaatctagaaagtaaaactttgctggaatgaagttggggttgaaacagtttcggtttgtaaccatactgtctctgtctcatctactcagctctgcctttgtaatgtaaaagcagccatagatggtatgtaaatgaatgaacatggccatgttctgatagcattttatttacaaaaacaggcagtgggctaaatttgggctatagtttgccgacccctcttctaggcaaagaactgcctgagcgtaggaagctggactgaggttctctgctagtgtgtgaacttgtggatgccaaagccaatctcttcccttcatgtcagacactttgcaaatgttacctcttttagatctcccattaactctaaaaggtggagggtgctattatgcttccatttcatacattgttctaagagattatcacactactagtaagttaggatagtaggaatttgaacttcaggtctgtcagaccctaaaaccccatgccctggaaatggttttctaaggctggcctgtggttcgttggttgatttcaattagaatttaagaattttttcagaatacatctaggtgtaaagatttttttgtcaatattactccacaaactagattatttcttttggcctgataactcaggaactttcttgtattacttctctcccttcttactggtttcttctttggactctcctgttgcacaggtattggatctcctggacctatccagttcctttcttttctatgctgtcatatttttcatctcttattgctctgtgttctgggagcttccaggacagttgctctttcacacaactaatttggttttcagttatatcagttctcctatttagcctttctttttttggaggcagggctggggcagactcatgctctgtcgcccaggctggagtgcagtggcctgatcacagctcactgcagccttgacctctgggactcaagcgatcctccagcctcagcctcccgggtagctgggactataggcatatgccaccatgcccagctaatcaggtgtttgtttgtttgtttggtagagacagactaccagagtctcgctaagttgcccaggctggtctcaaactcctggcctcaagcagtcctcccaccctggcctcccaaagtgttgggcttacaggcatgagccaccgtgcccggccctgttaagcctttctatctagattttttccctcctaatcatgttggtgtttttttgtttgttttcatttttgttttgttttgttttgagacggagttttgctcttgttgcccaagctggtgtgcaatggcacgatctcggttcaccgcaacctctgccttccaggttcaaacgattctcctgcctcagcccccagagtagctgggattacaggcatgtgccaccacacctggctaattttgtatttttagtagagatggggtttctctatgttggtcaggctgctcttaaactaccaacctcaggtgatctgcctgcctcggcctcccaaagtgttgggattacaggcgtgagccaccatgcccggccagtttttaaagaactccttcttactactcagattactcctttttaaatagtggcttttaaaaaatatcaatgtaggctgggcacagtggctcacacctataatcccagcactttgggaggctgaggcaggctgatcacctgaggtcaggagttcaagaccaggctggccaacatagtgaaaccctgtctctactaaaaatacaaaacttagccaggcctgcagttccagctactagggaggctaaggtgtgaggatcgctcgaaccaggaggccgttgcagtgaaccaagatcacgccagtgcacttcagcctgggtgacggagtgagactccgtctcgagaaaagaaaaaaaaacgcaatgcagcagtggctcacgcacataatcatagcattttgggaggccaaggcaagaagatcacttgagaccaagagttcaagaccagcctgggcaacaacaagaccccctccccccatctctacaaaaaatttaagaaaaaaaatttttttaaatcaatatggcatcctgttgcacaaattgcagtatattttgaaagatttattctgtttcttttgtcacctccatttcccagggctactgttgctctgtttgagctatgccctggaccattgagtggcttagactgtgctcacaataggtgtcccttcatcccttcagaagacaaacatggacatacgtcctaaaccaggaaggggttcagtgatggctcaggaaaatcggggcagggtgcagttatcctctaggcgagctgccgttttctttttcctttcctctcttgtggttgcctagaattagcttgggcactactatggtttttttctgtctgcaggccccaggagaccttctgtggacccaatatacttaacaatcatatgcagtgtagacctgctctggtgtcaattctaaccaaaacaaaaaaaaagcatttatgagacactcagggaaattcaagcagtaactgaataatattagatgatactaaggaattagtgttactttttaaattggataatagtattatgtttatgttaagaatcttgatctcttggtgatacatacctaagtaattgcatttgaaatgctaggtctcggatttgccttaaaagaattcagttagaatggcgtgagtatagaccagtggttccttactgggggctatttcccccacaaaggcatttagcaatgcttggagatacttttggtcatcaaaattgggaatttgctacagacatctaataattagaggctagggatattgttaaatgtcctacagtgcacatgacagacccacataacagagaattgtatagcccaaaatgtcattagtgtgacgttgagaaaatatatatgcagcatatgttttgtaaaaaagaagcccttaccagtctctgtgacaaactctctactctgtgtagagcactgtttttccagctgagtctagatgggaagccccgcttgtcatttgggctgtgggtgtactggtgctgggttggcaggcctttgcttaagtaccatcctggtacctcaaggtccactttcaaccccagtcccaattccctctgagcttgaggtgtttccaggcccaaactggtagaactagtacttagttttcagctggaggctctttggctctgtttgatctcttggacatcgagtctggtctgttttgtcttccagaaatctctcaaagattctgatctacatatgccaccgtttgctgcctttcagatatgctgttgattcattagtatttttatatttcttctaccatgtcagtgtgctttgggggaagatgaagtaaattcatggatttagcccagtgtcttaagccaaaggtgcctaattactttcttcttcttctttttttttttttttttgaggcagagtctcgctccgtcacccaggctggagtgcagtggcacgatcttggctcactgaaacctccgcctcctgggtacaagcgattctcctgcctcagcctcctgagtagctgggaccagaggggtgtgccaccacacccgctaattttgtatttttagcagagacggggtttcaccatattggccaggctggtcttgaactcctgaccttgtgatccacccgcctcggcctcccaaagtgctgggatgtgcctaattactttcttataatacctgatatactgccccctgttgttggaatttaacaaagacatttagtgataaattactatttttttttgttctttggctcaacgtaatccattgtttgttttgtgcctgttatgtgtgagaccctgtgctaggttttaggtgtacagtgagaatgaagcagacatgtaatccttgctcttgtggaatttatgctataaaggagggatattcattaatcaacaaagtcaaatatgtaattataaagtgtgagaggtattatcaaggaaaataataaggtccttgccttacaaaaatagtataggaaataacagcaattttttttttttttttgagacagagtctcgctctattgcccaggctgaagtgcagtggcgcaatctcggctcactacaacctctgccccccaggttcaagcgattctcctgcctcagcctcctaagtagctgagattacaggcatgtgccaccacacctggctaattttttttgtatttttagtagagatggggtttcaccatgttggccaagctggtctcgaattcttgacctcatgatctgcccacctcggcttcccaaagtgctgggattgcaggcgtgagccactgtgcctggccgtaacagctaaaatgaagtacacactgtgtgctagttactgtgccaacaactttacatgaaagatctcatttaatacgcagaataacttatttcagaaatgaggaaactgagacttatgatcctaatttagtattaggaagtcagagaagacctgtgtgggaaaagtgacacacagagaaccagacaagtaggagataaccaggcaaagaacagagagaggctgtgtaaagcagaaggaataacatgctcaaaggcctgaggatgaatgaatgaaagcatggaaggacaccagtggctgaaattgagtgagcaaggaaagagtgcaagagatagggcaggtaggggctaaatcgagggggttgttagagtccaggataaggagattagatttcattctgaggcatgagaaactgttggagggttttacctaagagtgggacacaacctgagttgctttcctagagatcactctgctttgtggagaatggattggcaggggcagaggcttactgtgatccaggtgagagaggatggaggttgggactacactggtggcaataaaaaaaatgcaaaaaaaaaaaaaaaaaaaggcagacagatttgaagttttagatatatctccaaaatatattatttgcagctgtgctagatatagaagataagtgtgaggaagaaatcaagggggtttccacatttcttacttgagcaacagggtgggttggagtactagctactgaatggtgagggaaaggttttaaacacagaaagcttgtgttgcctatgaaatttaaagtggaggtggcaaataggcagttgagaatctggaactcagaaaagaggtctgatcaagcaaagcaactgtgggaattgctagcatggcatttatatttacagtcatctctctgatcagattaactagatatagagaagagtgccaaggacagagccctgaggaattcccacatttagagatctggtgttggaagaggaacagatagtgagggaaactgagatgggcagacgagatagaaggaaaatcagaggagtgtttcgttgtggaaagctaagagaggaaagtgcttcagagaggaaggagtgatcagccagtctgaacactcattttaaggtgagagccacataccacagtatgtttgaaacttaccattaacaaagaagcgtcatgtaatgtcttccatctctaaaaacaaaaccaaaaaaaacccatctgtccacctcactcacatctccctccatctgtcattcctttcctctgcatcccttaatgttaaaagtccccacgaaaggacccagtgtctcactgtcctttttctatctttatttcactccatttaggctttctcacccatattcaactgaaaatactcttggaaaggtcaccagtagccaccgtcttgtcaaatctggtttcacttctctgtctcatccttcttaagtctgtaggcagtatttgattgaattgattgctccctccttgaaaaactctgctcttggcttctatgacactacattcttagattaacctctcacctcatggctactgcttatgggtcagtttagcttttaacagaatgtaaatccagttatatatctcctctgttcaaagcccttcgatgacatagtgtttctcatcacactcagaattaaatccacaatcattacaatggactcccaagtcctaagtctgctggcttttgcccacctctctggcatcttatattgaactggcctttgtgctgtttcttgaacctgccaagctcctgagagctaccatgcttgctgttcccagtgtctagaaagctcttcacccagatctttgcgtggttcacttcacgttatttagagctctgcttgtatattacttcctcagagagaccttcccagaccactgtatcactgctccccaacctgtcactttctctctccccaccctgctttttattcctcatagcacttgtccctgtctaaaattaagtattgacttgtttataaacagtgtcttccttcctccccacagaatggaagctttctatcacttgtctccttgaacacttctctgttcctagtgtctcaaacaatggcatgcaattgctggcccacagatatttgaatgaatgctgctaaaaggttgaatcagatgaggatgggaatgttcctgttggatttggcaatatgccatttgttggtgttctggctgagcagtttaaacagagcactgagggtgggagtcagggcaaatagattaaggagaacctgaaggtaaggaattagacaagacgaattagacaactgtgtttcggaaagtcagctgagaagagagacgcgaggctggtggtagctgggggagggtaaatgaggtcaagaagacaagtctttgagttgacagcagtggatgtaatccagagcacacatgacaggatggaagagacttgtcttcccttttagcaggtaggaaaatggtgaagatagttaccaagccactctgatggtgtagttcatggagtcgggtggagggtgagagtggaggcggatgagtcagtgcctggccagctgcatgagaaaacaaggctaggtattgggtgaaagggagccaggccctgtggaatgaggtgggattgccatgtcttcaaaccagatgttgccatggttggggtcctggcaaaaggtgactaagggagcagggtgtggaaagaggaaaaaagaagcaaccagcagttttgttacatggtggctgaggatctaataatgtctccttgttttattttatttttatttagctggtctcaaattcctggcctcaagcaatccttctacctcagcctcccaaagtgctgggataggcatgagccgccacacccagctgtctccttgtttgtttgtttgtttgtttgtttgtttgtttgtttgttttgagacagggtcttgctctgttgcccagggtggagtgtagtgtacaggcccggctcactgtaatctccatctcctaagctccagtgatcctcctacctcagcctcctgagtagctgggactataggcgcacatcaccacaccggctatttttttaatttttagtagagatggagttttaccctgttgccaggctggtctcgaataccttggctcaagcaatccacccgctttgtcctcctaaaatgctaggattacaggcatgagccattgtgccctacttgtctccttgttttaattaggaacagtattctctgtgcccggaaaccatttgggtttatgataggaaaactgtctttttcccttcctctcccatcttcctctagatggaacccattgaggctgagagagtgtacagtgttggccctgcatacctaacttgccatcagaattgaatgtgttcatgcctccagatattccagtgctttttatgtgctaagtactgttttaggctcaaaggatatagcagtgagtaaaacaaagtgtctgcctttaaacagcttttattctaatgcagggagacagagtaaataaatgtatgatagtcagagatggggtgagcatgtcatcctgggccccatgctctctccccacctcacctcaatagccctggcatggcagtgggaggtgcacactcatactttcttctctgtttccatttcctggcatctgcagaaggactgaatgagctcttcctcttcagggtgttgccctgaatggctgacttaagccctccattgcacaacacagtaatgacttgttctgttgtcttgatttcagatgagacaccaattattgcggtgatggtggccctgtcctctctgctagtgatcgtgtttattatcatagttttgtacatgttaaggtgagcctactaacacttcacattctcttagattctgtttcaatatcccagtgtcccaatgaacccacacagtccagtagacagtaggatatacacaatgaataggatagagggggaatgacccatgatagtgctaaaattgaagttctacttagaaattatttaaaagctctacatagtcttccttaagtcctaagccctccctctttcttccatctgtccaagcccagtctcccaactccagtgcaagctaaagcccagaatggtagtttggaggttgaggtaagaaaccgcagtttgttattagtgacaggtgttacaggatctctaggtctagccctgctgaagcaacccctaaaagggccccagtaagattacatgctcaacaaaagcctactgtatttctggctggggctttgtccccagacccttctgggacccctggccctggcatgttgagttgagccatgtgagttgtgagttacaggatccctctttctaaccttctttcagggtcctctagacgttaccactcaagcagaagcaaggaaggggaacccaagggagagaagagggtggtgcatttattctcttcctgctaaagctactgccctgactaattggatttagccctgccttatctttggcctaaccaaagatgttctgtgctccctctgttcttctgcagggataaagagagaggaatcatgtgccccctataatttgtcatgtgtctctatcattctgcaggagacttgtggccaggactgtgtccacccaatccaaagctctgggcttctccctgggtctcccaggctacactgaggaaataccaagatttttgtttgatatatattgtctgtctcccccagctgtattccacccactcaccctctctctacctggtgtggctgtgctctgcagtgagccacatgagcctgaatatactgttggggttccctggttggattccagtgtgccaagggtaaacaggagtatcccgaggtactcggtcaccccagcatgctgctgcctcagggtgtgcatgacctgtctctaaaaaagcccgattatttttaaaggcgatttagaaaggctgaattgatgagcaggaatacagaggtgtgatttgcctctcccacctctgtgctccattcttcactgtgatcattttctcattaggtttaagaaatacaagcaagctgggagccattccaattctttccgcttatccaacggccgcactgaggatgtgggtaaggcattccttaatgtcatggggaaccttcacaaggaaggaaatcaagaaattaggagtttctccatccttttaaaagaataagacaataaaaagaggaaaaaagatttttgaagaaaacagtcctagttcttacaggcttggtccatgaggtagaaccccgtttagcctccagaagaggggctaggttctcagggtacctgactgaccttctcccttgtgtactgcagagccccagagtgtgccacttctggccagatccccaagcaccaacaggaaatacccacccctgcccgtggacaagctggaagaggaaattaaccggagaatggcagacgacaataagctcttcagggaggaattcaacgtgagtactttgttgaggctggtgtatcagcagggaagaaggcagacctaaagtcagacctttcagatctttggagtcatgaagtaaaaaatgggcttttaatgtttaagaggtgagaaatgttttaccaagtttatctgactccctgtatgatcatggataggaaatgaagtgagatttgcctcacctccctaatctacccatccattcagtcatcatcacatctcttacttcttttgtttaataaatacttagcaagcatctaatatttgtcaggtaatattctagttgccagtgatatgatgaggagcagaaacagatccaatccctattctcaaggaactcactgtccaggagggaaacctcacaaacaagaacaaatataactgtgtaagttcaaacagcagtacagcacatgaaggactggtgcatatttgtaggcatccatattaagaggttgcctttttgagtctagagcaggggtgtcagtgtttaaagtagacagtgggatagatcagtgtgggaaatgacgaccatgggagactgcagagcacaggtctcatcttgagtatttagattcacattttttataattcccacaaggaagcagaatatgtttttaatccaccagttggtgatcctagcctaccagttctgatcccagatcagaagagcttctggccagcacggtgactcacgcctgtaatcccaacactttgggaggctgaggcgggcacatcacgaggtcaagagatagagaccatcctggctgacttggtgaaaccctgtctctactaaaaatacaaaaattagctgggcgtggtggcatgtgcctgtagtcccagctactcaggaggctgaggcaggagaatcgcttgaacccaggaggcggaggttgcagtgagccaaggtcacgccactgcactctgacctggcgacagagcgagactccatctcaaaaaaacaagagcttcctcgaataaatgatattttaattgatacctaatcataggcaagggtggtggggacaggggattggggagccttccagccactggaaatagcaggagaattgtcaggagtgagtgtgctgaaggagggcacacccagaacatgacagggctgtgtgcagctgaagaccagagcttcaaaggaggataagaggtgaaactagtgtggccagaccacagaccttgcagatagtcatgagagaagtggcaagccatagagcagccagatttacatcttgaaaaaatgactcagctgggcacggtggctcacgcctgtaatcccagcactttgggaggccaaggcgggcggatcacaaggtcaggagatcgagaccatcctggctaacacagtgaaaccctgtctctactaaaaatacaaaaaattagctgggcatggtggtgggcacctatagttgcagctactctggaggctgaggcaggagaatggtcagaacccgggaggcggagcttgcagtgagccgagatcatgctactgcactgcagcctgggcaacagagggagaccccatctcaaaaaaaagaaaaaatgactctggcttctgtaaggagaatagcccatgggcagaccagaatagttgcgggaatacagttaggggttacaggtgttaatatcagaagtgctagtagattgacctaatgtcatgactaggaaatgggggatggatttaaggacacagaggagcagttccagagttggtaaatacatcagctggggcattgctaaaccatcagtttccttcacaactttccactaagccatgtgtcagctttgccttataggctggctccttttttatcagtgggaaaaattttcccaaaagcttctggagacttctcttgtcacatgctccttcttaaaccggtcgtgagcaagggagaaaataaggttactgtggttggctgagactagtccagattactcctgggtcaaggccaggcatgctagctcacacctataatcccaacactttgagaggctgaggcaggcagattgccttgatcacaggagttcgaaaccagcctgagcaacatggtgaaaccccatctctacaacaacaacaacaacaaaatacaaaaattagctgagcatagtggtacatgcctgcagtctcagctacttgggagatgaggtgggagtatcgcttgagcctgcggggtggaggttgcagtgagtcagattcactccactgcaccccagcctggacaacagagccagatcctgtctcaagaaaaaattttttttagatattcatgtgggatatggatggataacctcacagaataggaggtctggtaaaggaggaatggttattgggtcagtgggtcaccattcatatctgctccatgacagaagggcttagggggagtggtgagtgatgtcagatttgcattttgagaaaataactaactacaatatagagaatagataaaagggagaggcaagagttgaagtgggagaccatttaccaggcaagagttaacagaatagcttggaccctttttgggggctattggaaaaatagcaccatttaatgttcattattgattgataagatttaccacatcctgccaggcacagtggctcacacctgtaatcccagcactttgggaggccaagccaggcagatcacctgaagccaggagttcaagactagcctggctaacatggggcaatcccatcccatctctactaaaaatacaaaaattagccaggcgtggtggcacgtgcctgtaatcccagctacttggaagtctgaggctgaggcaggagaattgcttgaacctgggaggcggaggttgcagtgagccaaggtcgtgccattgcactccagcctgggcgacaagagtgaaactccatctcaaaaaaaaaaaaaaaaaatttaccacatctcacaagacagcactccagcctcagtaccatagctggatctgtgctaggcattgtactgttttgtaatctataatgccaactgcttctgggtgatggggtatgtgatcccattactatactttttttctgacaaattagttcttttctttttccataacattaaatttacataagcatgaaacgaattatttgtttggaggtaatattccctgagactccatggtaaggtatttcagtaaatccctggatggtgatggtattcctggaggcatgacaggtaaattcggatagatattgtggtgagagccatttgctgtgctaccatggcaaccgtgttcacgagctcattgggccagcactagggtagtgagggaaagggctgaccatcatcacctgggtttctagcaatgagtgccatcttgtgagcattcacatggaacataaatattttctttcttgtgctagttatccactacccagcgattggtttagatcctgacttccagtgagataagtggtgtgataatttgcttgaagttctcttcactaggagaatttctcttttatacacattcaaagccatcacttaagtagtataccccatagcagtctacttccagcccagcatgggccagcatgtttcaccaagcagtttatataccaggccggactttttcttcttcagttaactgttgatgtcaataggaagtcagaagtatctattgcggcagtgggttgtgtggtaggcattttatagagatcacttccagctgataatgggattctgctgggcatgtccaaatctatggctaattgaatctcataatacctagtttacgagaccggcccggtggctcatgcctgtaatccctgcactttgagaggctgagttggacagatcacctgaggtcagaagttcaagaccagcctggccaacatggtgaaaccccgtctctactaaaaatacaaaaattagccaggcatggtggcaaatgcctgtaatcccagctactcgggaggttgaggcaggagaatcgcttgaacccgggaggcagaggttgcattgagccgagaccacgccattgcactgtagcctgggcgacaagagcgaaactccatctcaaaaaaacaaaacaaacaaaaaaacccctagtttacgatggggagttgaagtcatttggatacctgtctgtgatcaggcttgcagtctctaccctagagcccagtactaggctaggagcatggtcttaccaataggatcatggtcttatatccatatccaaatattacgattcttctgtttaccttactacaaacactctagagctccatacaatctaccagagcttatttctctgtggcctggatcagcaggagcactttctcttttcagatcactcaataaattggtcagaggctgggcacagtggctcatgcctttaatcctcgcactttgggagatgaggcaggcagattgctttgagtccaggagctcaagaccagcctgggcaacatggcgaaagcctgcctcttcaaaaaattagctgggcatggtggtatgcacccgtagttccagctactggggaggctgaggtggggtattgcttgagcctaggagtttgaggctgcagtgagctgtgattgcaccactgcactgcagcctgtgtgacagagcaagatcttgtctctatgtaggtaggtaggtagattgattgattgatcagatggattagatggattaaattgagagatcagagttggatgcaaggataaggtatctgctgtctccaaaactcaaaatggcccagcaagcattgctcctctttgttagcaggagaggggtggtggggcaaggggcaacaagttgtcttttatgttggaggagataccctgacgtgctgcaggcctttgactttcagaaaatttggctgaggtggcaggccactgtatttttatgtctgacatgtacatctaagatacataacttcctgcttttcatgtctcacattgatgtcattagcatagttgtcaaggtaatgtcctgtgaaacagacaaaatcttgatgaaccagatcacaacacagaaaggtcaagatgatttatcactgaggctgctcttgccatgagcaagaaaaactgcttcaagtagtccacacaacttaaaaagaacacacacttacccctagcagtagtctaggtaccaggagttatatgttaatctgcagaaagtagagtacgtctggaaaagtaactgcaaatctgcaaagtcttctgtagcacttaagatcctgcggttcacatggagacttcgccttttgctaaagagatcactgctctaggagcttacatttgctctttctgtgatggttcttatccagtgggctagggaatctgtgtgtctttgggcattacctaatggccaatgttattgaaaatcaaggtggcacagagggaggtctagccaacttcacagagccgggagcatctagtttctttccctcccttttggaggccctgacagacaggcaggcaggcagacagacagatcgacagacaggtaagatagattagatagattaataggtcctaatgtgaagccacctcaggccaaaattccttccatcagctggcctgcaaaggctccgttctaactagcatatcttagcgacattctgagttcctagcaagtagctacctcaaggccaggacctagcagaccccaaaagatgcatttccctttacctagtacagttgccatggcaaatatctgcagattattaagaaaagatgaggagggaggtttataatatatgtgtgttaatgcgctgtggcagggttcctccttacagatgcctggcctccctgttattgaagggttctgggtctgaaatgacccaggcctacgagttggatgagggggccccctctctagcatggtggtctagtaggctgcctaaactgacctggaaagctactttccgtttccattactgggagcttcacaatgaattattcacagccataaacgtctgatcatggtctccaacagtctttctagcccacttagatcaggaatcccattttgaaatagtcccttccactagcatctcacgctgctgaggacagccaggaaagcacttctgaaagattccagtgctttcctcaccagtgtatagcctcagcaaggcatgtgatgtggatcccatcaagggcatactgaaggtgtcagtagaaggctgagcctttagagtccatatgccactctggtctcctctactttgtgcccaggtttttctggcttttcattatcacctcactaaatccagcattcagtccaggtttccactggcgagcctagctcaacattaaaaccatggccagttacctgagctgttacactacctgcagaagttcttttgaccataccataattagaaatttggctttatccaggctgggcacaatggctcatgcctgtaatcccagaactttgggaggctgaggcaggcagatcacttgaggtcaggagtttgagaccagcctgaccaacatgctgaaaccctgtctctactaaaaatacaaaaattagccgggcatggtggtgagtgcctgtaatcccagctactcgggaggctgaggcaggagaatcgcttgaacccgggaggcagaggttgcagtgagccaagattgcaccactgctctccagcctgggggacagaacaagactccatctcaaaaaagaaaagaaatttggctttaaccaagtcatactctcccttccttgttataacgtctccaaaatctatatcaacaattgttcctatcatttgtaatgatccagctcagtgaattcctgtagtttcttctggatatttattagctctttactttttttcccccgctgtagagacggggtcttgttgtgttgcccaggctggtcttgaactcctgatctcaagcagtcctcccaccttggtctcccagagtgctgggattacaggcatgagctactgtgcctggccagcattttacttttctaccttatttatgcattttaccctcaggtcatgttatgcttgcattctggtaatgtgtgggcaatgcaggctgggttgtggggcagttttcatcatgacagcaagatgcagtagagagcataatagagatttttggaaattaactttctttgggtcctctcttttatcatcatttctgttgtctcacttaaagccttatctttctcatgagcaacccaggaaagatgtgaattctgtggcattaaaattcagcaactcgcaaaatttggaaaccttaacatttcacttagcaaaatacatatatagtaatgtaaaggccctgagtcttgggttttcatttcaaggtgagcatttgatattggagctgggttatttcttgttttgttctctaatattgtcagaagtaatcctactccttggtttcaacatttcccctctccttttaattgggacacccctactcgtttaccaccagcttgaacacatcacaggtaattgcaagcaataactaaaatagtagttgtgcagctatgaactgtgagcagcttgctctttcccatcctggcaattggttgtcagtttctttccttccatctgaacccagtaacatcacccacgtttcccctagcagtctctcaactacaacccactctgatagtaattgctaaatcagttaaggtcctctagttaaaagcaagagaagtcacctcaactaaattaagcaaaaacaaacagaactattgatttgggaagacactggaggagctggcagaatcagaaggtaagttggagtaccaagtctcaggtagagccgaccttggtggctttggggcccttctagggaagcccctgcttcttcctagttttcaaaatcctgggagagaatctgattggctcagtatcagtcaggtatgactgtgtttggatcagtcagccctgggagagaagaggagaaataacacatagggcaaacaaaccaatttgtgtctactgtcatagaataatatttttagtaaccatcagatggggaaggcctttctaagctacttagaagatttagatgccagaatggaaaagtttgaaagatagcaaatatattaaaatgtgaaacatctttgtgacaaatgatgtcgtaaaaaagtggccaactgggagaatctatttgccataggtagacaaagaatgttccagaatatacaaacctgtgagtaaaaggtaaacaatccagtcaagaaactggcaatttacagaagaaatacagatggtctataaagatatgaaaagaagatcaactatatctagtaatcagggaaatacagattaaagctaaccattattttggacctatcagatttgaaaatttaaaaagctttatatcaaatgtggacaaaagtatggggctgcagagacttacaggtgggggagtttaaattggtattgcattggagggatgattctggcagtaccaatcattatttaaatgtttgagttttctgaccaagcttctgagattcttaacagaaaaagccatgtacaaagatgtttatgacagcattatttataatagcaaagaagataaaaacgcaaatatctgtcaaatagaatggccagatgatttcttatatccattatgatattctatactatcattaaaataaatgtgttcacatagatctctaagttatattgttatgtgagaaaacatatgtgggataatttcatttttgttttcaaaaatatgtatatctgtgtgtgtttgggtatgttaatgcttttttttttaagtctgaaagactacaaattgtcaacagtggctgcctacaagggggctggaagagaggagagacataatagggaactttgttttctactaaattatttgacttaaaacaagcatattctttttataatatttttaaagcagatttttttgaatatgggaaataaatctaatggacttagtttgcttcgatggatatataacatctagaataaagaagttcctatgcctagtttgaactgtgtcaggagtcttgtggtcaggtctctataaaaagggatatcaccaaatgggatgttgttctggagagaaactggaccatgggggtgaataactaaaggaacaacactcataggacatgacagctgttttcagatatgtgacaggctaaaaggagactgtagcatttccgtgaatgcccacctgattagaagttctaggctgtggctttcatcctaattacaagctggagcttttttgttcaccagcatttgtctttctaggaatcattgaatttattcaaaagaaatactttgaaaaaccactcagaagcccccattttcagggaaaattgaggtctttaaggcattatcaaggtttaaaaagaaacaaaaagataaaattgtgttagcttctggctgggtgcagttgttcatgcctgtaatctagcactttgggaagccaatgcgggaagattgaggccaggagtttaagaccagcctaggcaatgtagcaagaccttatctctacaaaacaattttttttaattagccaggcgtgatggcacatgcctgtagttctagctactcagggggctgaggtgggagaatcatttgagcccaacacttggaggctacagtgtgagctatagtgctaactttatagagctgcaggagctacagtgagctacagtgatcaccgcactgccctccagcctcctggctaccagagtgagactctgtctcaaaaaaaaaaaaaaaaaaaggcttagctcctgagaggaatgggataggagagaaagaaaagagggaaagaggtgaagccagtgaaatagtcagaatctgtgcgatgtgagatgtgaccttcctcaggacctcacatctcttagattgccaggtgaagaaggcatgtgtgtgtcactagtgatgggactgagtgtggcatctgagttgagatgggtgaaatcgcctctacattgatgagttgtcccaaaataagtgaatcagagtcacagtcctgtgggaattagcaggaactgtgacaagggctttggaattccactgtccagagagttgggagtttgcgttttgcaaggggcagaaaagatgcccgctgacatctgggttttacattgcttagtacgagggaaatgcaaaagaaattgtgtgtctgggtgttgggtcgttttaaacagaactgttccaagacctaccttggaaggtagtaaatttcccatcactctagtgttcagtcactggtgactattgggtgagagtattgaaaggagattcagacttaaaagtgaatgagattcagacctgtactggagatctaggcaagaaaagaaaggtataaggattgcaaaggaagggacaaaatataaatttttcacagaccaaatactgtcttcagaaaaacccacagattcatcagacatattatagaattaatatgacatattatattatagaattaataaatatgacatatttataatttattatatatgacatatttataattaataaatatgacattatagaattaatatgacatattatagaattaatattcatcagacatattatggaattagcaaggttgctagatacagaagcagcataaaaatttaatgcatttctatacataggccacaaacagaaaacctaataataccttttaaaaggtgccaattacaatagcatccaaatgtaaagtacctaggaatggatttaacaatttagagaaaattattaaaatgtttgaagacattaaaggaaaatagcttaaattagtgaagagataggatcaatggattaggaggctcaattttgtaaagatgtcaattctcccccaagatatatagattcaatgcaattccaataaaaatcccaacaggtttttttgtggaacttgacaagctgattctaaaatttatatggaggagaaaagattcaagaatagccaagacattcctgaagaagaagaacaaggtgaggagacctgccttaccagatataaagagattataaaattttagtaattaagacagttttgtattggcactgggatagacagatcgaccagtggaatgaaataaagagcccagaagcagatccatttgtaagtggaaacctatttatgacagaaatgctcttgcagtttgggtggggaaaagatggtcttcacaataaatagtgcctgggaccattggtaaccctgtgggaataaatgaaattgaatgcttgtcacatatcaaacacaaaaaccaattccagttgctgtaaacactgaaatttaaaggacaaaaatgataaaatgtagagatcataatgtagtaaaatatacttctgatctcacagtaggaaaggatttcttaagacttaaaatgttgataaaagggaagattgatgaatttacatgaaaatgcaaaacctctgttcataaatgataccataaagaagatgaaagggaaggccacaaccttggtaaaagataacacaggtaactgataaaggaagagtatccagaatatataaagaacttctacaaattgttaagaaaataagtaggctgggcgcagtggttcatgcctgtaatcccagcactttgggaggctgaggtaggcggatcacaaggtcaggagttcgagaccagcctggccaacacggtgagaccctgtctctacaaaaaaatacaaaaaaaattagccaggtgtggtggcgggcgcctgtaatcccagctacaggggaggctgaggaaggagaattgcttgaacacaggaggtggaggctgcagtgagccaagattgcgccactgcactccagtctgggtgacagaacaagactccattttgaaaaaaataatccagtaggacaacggggaaaccacttgactaggtacttcacggaagaggaaactcttttgaccagtatgctatggaaagatgatgaacctcattaataatcagagaaatgtaaatcagttaacacaaagtctgacagtagcaaatgttgataagcatacggaactggaacactacattgctggtgggagtataaattagtacaacttctttgaaaaacaatttggccttatctggtaaggttaaagatacctatacctgaaattcttgcacatatgcacaagaaagatacaaaaatgtgtctcaaagcaggacctttaactgtaaacaacccaaatattcatcagtagtagaatggataagtaaattttaacaccgtctcaaatggagcactacaaagtagctgaagttagcagccaggatgaatcttaggaacgtaatgttgagccaaagaaaaaagcaactcaccacttaatcatgattccattttcctcaaaaactagactagcaataataatacattgttttggatgtaaaaaatatgagatacaaataaaggaatgtaatgataattataaaacttcaggtttaccagtgagaggggaaggaagaggatataaggagaggagcccaaagagagcttctaagttaaattatgtgatggatactttttaaaaaataaatatcaacaaatgtgaaaaaaaaatttttttttaaccgacatgtctttaaaaaatgaatgagtacttagccttggttccagttaaggcttaaacaagagatgaaacggtcttcgatgccacctagtgtttctagagagtttaacattttatagacttctgctctagctgctccttcctagctctgtgagctaggtttttcagagtagaaaccaaaaggagtaggattcaccttgttttcatccgtgacgcaggctcttcattctgaacctttgcatctagcgctgtgttctccagggcaagccctttcttctctcttgttaaacaatggctcctgtttcttcctgactctttttaggagccttagtccacctggagacctagtttttctttatcatgactgagggagctagggatgctgatagggctgtgagatgtagtctttgttattcctgacatttttgtattgaagactgttttcaagagtcttgctgtccctacgtctgttctacattttagagaagggatgcacaggaaaactagtgcctctggattagccatcagggcttaaaaaactgacatctcatcctgccctgtacttgggtggaaacctgtggaaatcttatgtgaaggaagagaatgcaaactgtgggtgaactgagaaattctgatctaaaataatggtctctactgcgtgtgtaagagtccagcccaggaaaatcttttcttccttttgtggtattcacagcatagggtcaggggtaattgcctctgttagtaaaataacatgcagaacctccagggttttaatctgaaaggaaatctcttgagtaggtgagggcagatggattttgaggtcctaatttccctatctttgggtctttcactttaatttctcctatcactgtcatgctggtttccagtaaatatatttgctcctttcttaaagctcttgcttcccagcctgggcaacatagcaagatccacctctacaaaaataaaaattaaaaaattagccaggcatggtggtgctgtgcctgtagtcccagttactcaggaggctgaggcagtaggatacctccagcccaggagttcaaggctgcaatgagctatgatggcgccactgcactccagcctgggtgacagagcgagaccctgtctccaaaaaaaaacaacaaaaaactcttgcttccatctgacaaaaaattggttccctttgggttggcatttcctttattcagtctttttttaaattattatcaaagacagaaacgttcattcttcatttctgcctcttgctcttcccagtccacttttgccttcattccatctccaaatgtagtaatttttttttttttttttttttgagacagagttttgctctttctgcccaggctggagtgcaatggcgcagtcttggctcactgcaacctccatctcccgggttcaagcagttctcctacctcagcctcccaagtagctggggttacaggcatgtgccaccatacctggctaattttttgtatttttagtagagatggggtttcaccatgttggtcagctggtctcgaacaccagacctcaaatgatccacccgcctcggcctcccaaagtgctgggattacaggcgtgagccaccgcgcctggcccaaatgtagtaattctaattccagaatatgtctcaaatgcatccatttccttgtatcatcatttttccatgcttctcttcttgctcctctctagtccattttccatacaataacaagtaattctttaacatggaaaatggatcacactttaaaaaccttcaatgatttccttatgcacttaacataaaatttgaactccctattcaaggacctacctggaaatggatgatctgactttgccaggctcatctcttcctacttcctcctgccatccccatcaacctcaccttctgcgtgatacctgcactgattttcggttcctcacacaaccaagccttcttccacctctgggttaccacagatgctgttctctgtgtctggaatactattttctatactcatccttcctcagagagacccacctgtaatccaaatttggtgctttctgatacttcatctctagtagcattctgttctttgattgcattcatcatggtatataattatatatgtatttgttttatttgtttaatgtctgcttttcacccacaagtttatattgtccttgagggcgagaactgcacttatatttgattccccactctttgctctgtatctagcccagtgcctggtaggtacaaaatatatatttgttgaaagaatgaatgaaaagtaatgcatgaattgttcctctactgctgaatactacggttgttctcagttttgggtcattctaaataatgatgaagtaaataattaggacataaagatttttatttcctaagggtatgttctcaaaattgaagttgctaggccaaaaagtatttttgaaaagtttttttaaggctcataaaatgtaatttccaagtcacttactcggaattagtgttggaattttaaagtgcctccctttttgctttcttgtttgtttttatagtgtcagagtctcactgtgtcactcaggctggagtgcagtggtataatcatggccttgaactcctgggctgaagtgttcctcccacctcagccttctgagtagctgggactacaggcatgcaccaccatacctggctatttttttttttttttttttttttaatgtagagacgaggtcttgctgtgttgcccaggctggtctcaaacttctggcctcaagtagtcctcccacctctacctcccaaagtgctgggattacaggcatgagccaccacacccagctccttttttcatccttaattttgaatatatgaaacatacaagaggagaacagatcaaataataaaatttagcttcccactctgataaaactcatttatttgaatacttattctttgctacacatgagattatttccttatgtggcagatgttgttgttccaattttatgtatttatttattatttatttttgagacggagtctcgctctgtcgcctaggctggagtacaatggcgtgatcttggctcactgcaacctccacctcccaggttcaagcgattctcctgcctcagcctcctgagtagctggggttacaggtgtgcaccaccatacccagctaattgttgtctttttagtagagacagggtttcgccttgttagccaggctggtctcgaactcctgacctcaggtgatccacccgcctcagcctcccaaagtgctgggattacaggcgtgagccacttcacccggccccaattttacagatgaggaaactggacctagaaattttaacagatgtgctcaagttcatacaaacacagactatctcatgtcagatcattgtgtgataacctccctgcactaactaatctacatttgctccagaactgctgcaaatttaatgtcacctcacccaaatcttctgcttcttaactgctgcatctatatgaatgccctcccacccacccaccagtccttgcttccttgccacatgatgctagaggctggggtgccatgcccccttagatccctaggaagagattaaatcagctggccatccagaaccttcctgtgtggttcactctgagatgcatgtcatctttgtgtggtggtaattagcatgaggataaatggcccattccttcaggtatgtccccattccaatttacaagggtaggcccttttggcccagtatcataacaacaggctgctaaccacatagtaatcatggaaagagcatgctatacttacataacagaaagggcattctgccccctgaggattcttgtgttgttgaactctaaggagcttgtggctgtttcgggggagaggagcattctctgtgttaggctgcaggtattcacctgggcccatgtttttccccccaggaaaaggtagaacatgctaccaggtcagggtttggtgcagcagtttgcatgtttgatgtttatccctgctaataattcctctaatttctcttaacctttcaggctctccctgcatgtcctatccaggccacctgtgaggctgcttccaaggaggaaaacaaggaaaaaaatcgatatgtaaacatcttgccttgtgagtgtctttagtgtttcttgggatgtaacctgaaattacatctctggagggattttctgaagatggaaagaatcttgcaattgggcacagcagggtgaataacaagagtgcgttcatggcagtactcagtggctcatacctgtaatcccagaactttggaaggccaaggtgggagaatctcttgagcccaggagtttgaaactagcctgggcaatatagtgagacctcatctctacaaaaaccttaaaaaattagccaggcatggtggtgtgtgtctgtcgtcccagctactcaggaggctgaggtaggaggatcccttgagcccaggggggcagaggttgcagtgacccaagatcgtgtcactgcattctagcctgggtgacagggcaagaccgtgtctcaaaaaaataaagtaaaagaaatgaaataaataataataaataagataaataaataagagtaggttgaagactttgggctgaaagagcctttatggatcccacatactcagagtcaattaggatgatccaggaggatttttgtgtcaggcctaaagtttctaggaggtcctggagaacagcttcactaggatcaggcaggaagcagggggtaatggtggtggtagagatggttttttgtggtattcattgaaagaaattctaatgcagagttctctgtataaacccttcccagagttagccattgctaatcagttgatccataagctaacagacatttttctagtccattggtatccagaatgggatatgcataatttaatgagatatgagaggaagatgtttgaacctcacttgatttttatatttgcttttcaaaaaaaaaaaattcctaatcctcagaacctgtgaaaatgttttttttttaattttttgtagagatggtcttgctgtgttgccttggctgatctcaaactcctggcctcaaacagtcctcctgctttggtctcccaagtgttgggattacaagcatgagccagtgagcccagccagtatatttgccttttaaaaattcatccttttaaattttttatttcatttatttttttagagacagggccacccaagctggggtgcaatgatgtgatcatagatatgtatcctcgaattcctgggctcaagtaatcctcctgccacagcctgctgagtaactagaactacaggtgcatctaccatgcctggctgattattttttagacacagggtcttgctgtgttacccagcctggtctcaaactcttggcctcaagcagtcctcccactttgacctcccaaagaattgggattacgtgcatgagccaccacatctagaccctaaaaattttatatttcagggtatatcatacattagcatatgtgcataatttatcaataaatgagcatgtattagagatgcctgctcacatttttataagtgaagtatggaaccaaaaaattaggaccactacactatgcatttacagatacttttgtctttttcttttttctttctcgctctgtcacccaggctggagtgcagtggcacgatcttggctcactgcaggctctacctcctgggttcaagccattttcctgcttcagcctcccaagtagctgggactacctataggcacatgccaccacacccagctaattttgtatttttagtagagacggagtttcaccatgttggccaggctggtctggaactcctgacctcaagtgatgcaccgcctctgcctcctgaagtgctaggattataggcgtgacccaccatgctcggccttgtcttcttatttatgtgcacatgttggaggagggggatgtgtgtatgtgtgtgggtgtgggtatgtgtatatataatacatattttttaatatgattggtatactgtacacatttctctcttttaatagtatatattgtcagttcatctgtcaagaaactttcttttttctcaactacttagtattccacattgtagatgcatcttaatttatttaactagtcccctaatgatacttaaggtattcccaattttttgctgttatactgttggagttatattgttggagtggcatctttatacaagcgtgagtctgtgcacataggcacagatgtctcaactgtcctggttgcgtcaggttctgtgagaaataaattttgattttactgaaatattgttggtttgtttcctagatgaccactctagagtccacctgacaccggttgaaggggttccagattctgattacatcaatgcttcattcatcaacgtaaggatcgggtgctttccctgtcacttccctgcctgaccattgccactatctgttggctcctccccagctgtgtgttaggagaaatatttgtcatttcatgttttccctgacaagtctggtttttttaagtgactgaatttttttttaaggtcagtcaaatagttttaatcattttctatatttaccctgtcgtcattccctatggtttcccatgtagaaatctgtgtctaaatatgtattttgtgataagagtcagtgaatcctttattgagctgattctaattacaaacaaaagcaggccttgccctcaacagtaaaaataagggagaacaggacaagaatacctgacatgacaccagctatattatatatgtgtgtgtatgtatatatgtgtgtgtgtgtgtctgtgtgtgtgtatatatatatatatatgactatctggttagccatatatgaaccaaggcctgagggaagagctgatactaagaggaggtttttaaagatgatttagagaatgtttatagaacagtctgtatgagagatttgaggtttttgtttggttggttttgtctttggcagtagcctgaaaaaacacataaagagttaagaatatgttttataggtttgggggaagcatcctgtagagagagtgaatttgaacagaaaaaagagagagggaaagctggcaaaagcaagtctgactcctgatgcaaaatgcatgagaagactggataaaatttccacttgcatgtttatagcagcattaatcctaaaagccaggtgggagcactccaagtgtccattgacggatgagtgaataaattaaatgtggtacatgcatacagtggaatgttattcagcctttaaaaggaaggaaattctaatacatgctacaacatggatgaacctggaagacatcatggtaagtgaaataagccagtcacaaaaggacaaatattgtatgattctacatatagaatataaactatatatacatatgtagagtagtcaaattcacagggacagaaagtagaatagtggttgctgggggagggaggaatgaggagtgggtacagagtttcatctggggaagatgaaaaagttctgtagacggatggtggtgatggttgcacgacagcgtgaatatacttaatgctacagaactgtacacttaaaatggctaaaatcagccgggcacggtggcacacctgtaatctcagcactttgggaggccaaggcggtggatcacttgaggtcagaagtttgagaccagcctgaccaagatggtgaaacctcatctctactaaaaaaaaaaaaaaaacaaaaaaaaaaaaaacaacttagccgggcgtggtggcaggcgcctgtaatcccagctacttgggagattgaggcagagaattgcttgaacccgggaggcggaggttgcagtgagccgagatggcgccactgcactccagcctgggcgacagggtgagactgtctcaaaaaaaaagaagagtcaaaatggctaaaatcgtaaattttatgttgtattttaccacaagaaaaaaaaaggacactgatggagagattagtgtgaacataagaagggctgtttcttcctctgagagtgaagataaaggagaggacagaatggatagagacgactcgtaggtgtgggtaaagcaagttgaggcaactcacccgtgtgctcatggttgtgtactgaacaaatgagatgggactgtgacatgagagcttcgaaagtttagaacagcttctgaggtccctgagaaaaggataccaaagagagaaagcaaaggacatgtctagtgggatgtcattgatgggggtggggggtgctgagttgtgtgattttttttttcttcatctgcaccctgggattggtggtaaatgcagaggacatgtggtactcagacaaaagggaaggtcagtggctgcttcaagtagtcagccaagggcttcagtttcagtagaaaagaaaagcgttaggaagttgttaggaataaacaactattcctaaggtggtaggattgaggaactggagatcttgagaaagtgaaagaacaggaggttgtgtccaaaaaataggctattagatggacttcaaaaatggggcagtccgggcattctcactggagtgaatttgctgaagttcctgtatgtatgtttaacattaatggttacatgtttgtagttttaaggaaagggaccctgactagacaaataattgttgtagtcgataaggaaaatggagaaaggctagtaatcagcaggaattcctagaacttacatcgaagatcatgatgaagagattaggtggaataggttgactttaatgttatgcagaagagaagagcaagatcagttagtgtgtccagctgcgggtaagagaatactcaactaaaagttgtctagatgggaacattttttttttttctggagacagtctcaccccgacacccaggctggattgcactggtacgatcttggcttactacgacctctgcctcccgggctcaagcgattctcatgccttagcctccctagtagccaggattacagacatgtgccaccatgcccagctaattttttgtatttttagtagagacggtgttttgctatgctggccaggctggtcttgaactctgagcctcaagtgatccacctgcctctgcctcccaaagtgctgggattacaggcgtgagccaccgtgcccagctggaacatttatttgtctcatatactgtgaaagcaaatggagaccagttcttgagttggctgattccatgggtcagtgacatacttacaaaaccaggtgcttccatctttctactcagttatccttagccctgtcaacagtctcatggccacaagatggctgcagcagtcccaagcattcctcataaacacagcatccagccgggtgcggtggctcacgcctgtaatcccagcactttgggaggccgaggcgggcggatcacaaggtcaggagatcgagaccatcctggctaacacggtgaaaccccgtctctactaaaaatacaaaaaattagtcgggcgtggtggcgggcacctgtagtcccagctacttgggaggctgaggcaggagaacggcgtgaacctgggaggcggagcttgcagtgagccgagatcacgccaccgcactccagcctgggcgacagagcgagactctgtctcaaaaaaaataaataaataaaaaataaaaaaaataaacacagcatccagcacagaagaggaacatatctgcctatgcttttctctctgttagggagcaaggcttttcacggaatcctccccaccaccctgtcctcaggaccagcaggccaggattggatcacatgttcacatccctctctaatcactggctaggacattgagaatgatcatgatttacccctctgagcctggggaatgggcaccttccaagccagtgaaaggttaatgtccaaacaaaattgtggctctaatggcaaagaagaaagggaggaatggatttgagttagtaaccagcagcatctgccaccgtaaccagtttggtcccttcccacattgaaggtgaaaactgacaaaagttaattgtatgttaaggctgttaagcagctgagatggggatctcttcatggtaatggcacagtagaaagaaacagccttatcccttgaccatgtttatttagagcttacactagggcattccataatgccttgatggttattagacagttattagtaggcagagtttacatgaagagggttaaatgggggaccttatgaactcagtgaaggaacaaaagcagggaaaaacctgtggttaaccataagtgggaagcagggattaaagatttggatttcacagtttattaaactcagtcaacattttttgagcacctgctgtgtgccaagcactgtgggtaggcttaaaggttacagaggtaagatgtaatccctcatatactacacaggtagttaggttgtttcctgtaatgtgctacgtgtgcaaaggaggtattgccaggttctgtggagttatgagaaaaaacattcagcccagcctggtaacccagtagagctcattattgaagagtgagtcagagttcaggagaagaaagttgggcagaaacttcaaagcaaaggagaaacatgagcaaagtcacagagactagaaacagcagtcttaggttataaggtataagatgggaagtggtgggaaatgagacttgatcttgaaaggtagtggatgtcaagtgtgtccattggagttcttacttgcagactatagagtgtacttttcatccactcttttaagcagaaaggggtttattataagatactgggtaccttaacaaaacctggggaagagccagtgagccaagctcagatgctgctcagcaaagagcagagcagctatagatctatgcagcatgtgactgtcatagtgaaacctctgcacagtgctgcagaagaactggatgcttctactaccgtgcttgcccaaagaccagatttctagcacagtcgttatctcatgttgctcatttctaccccaagtcttgtgtgggagcatctgctaggaagaagctaggtctcgtggattgctgagctgctagggagtctgggaaatgtagctgtaagatagtcaagctagaagggagcaggagtgggtactaagtgaaccacctaatagtgtctgccagttttcagtacagctgagcggttttgatgaatttatctaggccgtggggtaccattgaaaagtgttcaaggcagggagtagtgtgaccacatttacatattgatcactggggctatcatgtacaacatggatttaggaggggccaattgggggctattgcaatagcaggtagatcacaaatgatgagggttgacaaggaagcggcgacaaagtgaaaactacgtggaggtagaatttagcaggaattggtggttgatttatatatgagagagtagagggtgatatatccatgtagatgtatccagcatacagttggtcatatctagagctgtggacttggaagtaataaaggagtgggccaagaacagagcccttgggcccacagcccctgccaggcacattgaacaggtgctcatgggtgagatggaaggagaccaagagaagagagcatctgagaaggcaaagataaagcatggctcaggaagtgtttggcagtgaagagggttatgtgcagattagagatcagtgggaaagaggaacagattttctttggacttagtgtgtagggcagcatcctttgctgaagcaaattcagaggccgtttgttgcatcctttttgtgggctgctagttaacacttatcaaaccctttttttcccctaacattgaggtataatatatataacataaaattcacccattttaagtgagaattcagtgattttttggtaagtttaccaagttatgcagccatcaccataaatgtcttagaacattttctaacaactttattgagatgtaattcaaataccatgtatttcacccagagtttacaattcagtgtttttttaagtatattcacatataactgcagcccatcaccaattttagaacattgtcatcccctcaaaagaagaaccttacactctagctgttgcccccttagttttagaacacattgctcaccccaaaaagaacctcagtgtctaaatacaattaatctccattctcaccccccggccatcacttaactttttgcgtagagaactgagaccacacacatggatcttgaagggaactaggcaccatggagtagtggtgaaaggcctaggaaagtggggtctgtagtttgggaaacacataggtcagctaacctaacactgttcacaggaggagatgaaacagaggcagtggcacagttggcaggtgggcttccagcctagagccttaggagaaaccagtttccttactcatttttagatgtctaagaatatataggatttttttttttttttgagacggaatttcactcttgttgcccaggctggagtgcaatggcgcgatctcactacaacctctgcatccggggttcaagcaattctcctgcctcagcctcccaagtagctgagattacaggcatgcaccaccacacctgctaattttgtatttttagtagagatggggtttctccatgttggtcatgctggcctcaaactccctacctcaggtgatctgcccacctcggcctcccaaagtgttgggattagaggcatgagccaccgcgcccagcctagaatatataggatctttagacgtgtttctttttagaggtaggaatgtagctaccacctagagcccactgagattcagctttcagaatctagagacatctcaggagccagggagccacatttcatctttcccttgaacagaacacaagatcagtggctttgcttcattctcattactctgtattagttaagcagtgccgccacatcactgtacaagcatgttttcaggaaggcatatgacgcactcctggtaagatggggcaggaagcactttggggctgggccttccaaccaggtgttcaggctgttcagggcccgcatgctgcaatgagaatttagcagtgactcctcatggagcaggaatatgatgcgcttaacgtattcttaaggacttctcagttttaattataagtttagtaatataagcagaatttaacatccagaattaaggctatttccatttccattctctaataaataaaaacatttgttgaaacttaaattgctcttctcaatgaaaactttaacaagtcttttgttgctgactaaacatatccatctctgaggcctaaagctttctccttctgtgttgggcagcaaccctgccctgcccttgtttgaactgaaattgaaagtggctcctcagaccaggcacggtggctcacacctgtaatcccagtactttgggaggccaaggtgggcggatcatctgagttcaggaattcgagagcagcgtggccaacatggtgaaaccccatctctaatttttgtaaaaatacaaaaattagccggccgtgatggctcatgcttgtgatcccagctccttgggaagctgaggcaggagaatcacttgaacccgggagcagaaggttgccgtgagccaagatcgcaccactgcactccagcctgggtgacagagcaagactccgtctcaaaaaaaaaaagaaagtggctcctcagatttaggccacttcttatatttggccactgccttgcagccttgtagttcacattgccaccctggtgttggtgtgacatggtgtcccatccctgaagctgcctcccttgttactcaccttattgctgtctgagaaaggaaatgggtgattcacaatccttaaatcaagtggctttctcttacctagaacttctgaattgaacatacatttaaacaatgacgttgaaaagatgtataactggagcaataaagactgaaaaagaaagctgcggccagttgttagtttttccgaggctccttatctgttgagtggcaccccaggctcccttgctcttgtcccccactgcctgtgatagagaagcctcttgttaaacactgggagctacttcaccacactcacaggctattcccagaaagattttgcacctgggtaaagcatccttgagaaaataacctgttttctttcccagagtgaacccagcttcatccctggaaccaccacatatgcttttcccctggtgggttcttaacctgttaacactgaaatctacattgttagctgctgataaagcatcagaaacatggtctaatctgggagtcagtatttggatttcttttttctttctttctttttcttttttttttttttttggagatggagtcttgctctgtcaccaaggctggagtgcagtggcgcaatcttggcttggctcagtgcaacctccacctcccaggttcaagcaattctcttgccttagccaccctagtagctggaattacaggagtgcaccaccacgcccggctaatttttgtattttagtagagatggggtttcaccatgttggccccatgctctcacactcttgaccttagatgatccgcccaccttggcctctcaaagttctgggattacaggtgtgagctaccacgcctggcctggatttcttattctagtatttattaataattcaatttgagaagactacctagactatttgagttttgtaatctctaattcctagctctaaagctaatcccttgtgaatatctagactggaaatccccgttaagtacctgcacattttcaggttttgttaactggttggagtcagactggagaatttcatttctattcatttttggttttctctttctttttctttccttccccacaccccagggctaccaagaaaagaacaaattcattgctgcacaaggtaaagtaatgacaacttttttctgttagatttaaccatgatcacataatgggtttggtttttttctcccaaatgctgagtggattaaccagaatgctgtagcttttctgtactttttaccacctgaaagaattataatccattatacaggtttacagctaacagccttcatcttgatgacttagtatccagggatccattaaaagaagtctttttgtgtatgtatattaaaaagactggaaaaggctgtatacacaaaacacagtctaataaggccctctgtccttggggctagttaaccttaggttccagccaggctgctcagagtttgaattaggaatcagtttccagagaggatcagccacctcacagggtccaggctggttctcccccagctcatgggcctgagcctcaccattattcacagatagttggtctaggaaccctcagatcagggacccagcaccatgtcctttatgtgttctacacacatttccaggcctgctgttctaacaactgtcttcactctttgaaccctagcaaaaatatctggatgtttgcagcattaaaaagtaattgaggccgggcagggtggctcatgcctgtaatcctaacactttgggaggccaagacaggaggatcgtttgagcccaggagttcaagatcagcctgggcaacatagtgaaaccccgtctctactaaaaattagccaggcgtggtggcacacacctgtgatcccagctacttgggaggctgaggcacaagaatcacatgaacccgggagccagaggttgcagtgagctgagattgcactactgtactccagcctgggtgacagagtgagactttgtctcaagaaaaagagtcattagggactacaagatttataaaaacaaagttctcctcccttttcttttcacttttttagtctaatgcccctggggcaaccatttttatctattggcttcttatgatagatgacatcatctgatccccttacagagcacctccccctcagtcagacagacgtgtacccacatatcctccccattctcccagaagagtcaaatcacaatttggggttaaggtatttattattattatgagtttacaaatattcacagccgaaacacacagtattatgttattttttgtatagtttttttcccccttcttttttagtcattgtgttttttatatacctactactgattttcctcccaaactctttaccagaagtatatatcttctctcagtacctttagatacatgaggtttaatttttttatcttgggatccttctagaatcttctttcttcagttgcattgtggattggttgctctctatcctctggcagagttatcattctaagaccagtaccctgggaattccgttagcctctctgctgtgttggatctcatttattttcctctgtttgcctctcatttttgtttagaattttctagtgactttccgaaaaaggttatatgggaggtaaattttgaattctagcctgaacaagtcatccaacctttctggggctgatgacacccacctcagagcataataggaaggagtaaatgccatatgaagcacttagctcactgtcaggtccataatgtaggtattctgtgagcagtcatgatttctaattcccaactgtaatatccttgggagacatcattcgtgttctgtttatatttttgacagccttccacccagccccatccttgtgcagtgcctggcacatacatggtagaaacatggaaaatactcaattagtaacggggtggatggatacatgggttagatatttagctggggacatttgggcacaagcttccaaaagtcaggaatggatgttcccagcctcccagcatctttcttcttggtgtatattctcttcatttttgctgttggctactttaggaccaaaagaagaaacggtgaatgatttctggcggatgatctgggaacaaaacacagccaccatcgtcatggttaccaacctgaaggagagaaaggaggtaagtggaaaaattggatgtgaacagcagaaggatcactctgcatataagctctgagtttaagcctggctgtctatcctttgtgggtgctgtaccagtagttcatccagaaagacacaggctgaagtctatcagactttgctatggcctggaagccccagatatgaacctcaggtgtgtgcctagagcacattccctgtatttggtagtcaaacaactcaccctggttccagaacagcctgaaagagactgacttgggccatcagctaaggaaaagccacagaggggttttttttgttgttgttttgttttgttttgttttgtttttttattgatcattcttgggtgtttctcatagagggggatttggcagggtcacaggacaatagtggagggaaggtcagcagataaacaagtgaacaaaggtctctggttttcctaggcagaggaccctgcggccttctgcagtgtttgtgtccctgggtacttgagattagggagtggtgatgactcttaacgagcctgctgccttcaagcatctgtttaacaaagcacatcttgcaccgcccttaatccattcaaccctgagtggatacagcacatgtttcagagagcacagggttgggggtaaggtcacagatctacaggatcccaaggcagaagattttttcttagtatagaacaaaatgaaaagtctcccatgtctacttctttccacacagacacggcaaccatccgatttctcaatcttttccccacctttcccccctttctattccacaaaaccgccattgtcatcatggcccgttctcaatgagctgctgggcacacctcccagacggggtggtggccgggcagaggggctcctcacttcccagtaggggcggccgggcagaggcgcccctcacctcccggacagggcggctggccgggcggggggctgatccccccacctccctcccggacggggtggctggccgggcagaggggctcctcacttcccagtaggggcggccgggcagaggcgcccctcacctcccggacggggcggctggccgggcagggggctgatcccccaacctccctcccggacagggcagctggccgggcgggggggctgacccccccacctcccggacggggcggctggccgggcagaggggctcctcacttcccagtaggggcggccgggcagaggcgcccctcacctcctggacggggcggctggccgggcggggggctgatcccccaacctccctcccggacggggcggccggccgggcgtggggctgacccccccacctccctcccggacggggcggctggccgggcggggggctgacccccccacctccctcccggacgaggtggctgccgggcagagacgctcctcacttcccagacggggtggctgctgggcggaggggctcctcacttctcagaccgggcggctgctgggcggaggggctcctcacttctcagacggggcggttgccaggcagagggtctcctcacttctcagacggggcggccaggcagagatgctcctcacatcccggacggggcggcagggcagaggtgctccccacatctcagacgatgggcggccgggcagagacgctcctcacttcctagatgggatggcggccgggcagagactctcctcactttccagactgggcagccaggcagaggggctcctcacatcccagacgatgggcggccgggcagagacgctcctcacttcccagacggggtggcggctgggcagaggctgcaatctcggcgctttgggaggccaaagcaggctgctgggaggtggaggttgtagcgagccaagatcacgccactgcactccagcctgggcaccattgagcactgagtgaacgagactccgtctgcaatcccggcacctcgggaggccgaggctggcagatcacttgcggttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtaccgtccagcttcggctcggcatcggagggagaccgtggaaagagagggagagggagaccgtggggagagggagagggagagctgttttgttttgttttttgagacggagtctcgctctgtcgcccaggctgaagggcagtggtgccatctcggctcactgcaagctccgcctcccgggttcacaccattcttctgcctcagcctcccgagtaccacccgccaccacgcccagctaattttttgtgttttttttagtagagacggggtttcactgtgttaggcaggatggtctcgatctcctgacctcgtgatccacccacctcggcctcccaaagtgctgggattataggcgtgagccaccacgcccggcccacagaggagcttttttcccctggtttctctagttccttatttccctggttttctgccccacctgctgaggcctttggtatatcctggatcagcagagggagctttatgaactgagaccctgcaagccaaagggaatttgaggccttggcctaatcctggaggcagcctcctaactgggccttttccttttgtggctaccaagtgcatgcctggcctaaccagctctatcactgggccacagccagagccaattctgggtcctggggtcgagccccagcgaggaatacctatttgttaccgtgtttctcaaggatggcccttgagtcaccttgatcctagggtatcgggtgtcatgatcaacagctccacagtggcatgggaagacagtgctagggctgggctttaggttagtttcctccaaccaaacctcttgctcttggaagctatccaaagctcaggcaacagaaaaagctctaggcctctcatggcaggtttacagtctgcatcagtctaccctggtggccccctcatagcagactgctggttcgaggggttcaaacaggctttctcctagagcatgacctgaaatgttgtgaaagtgcagattttgtaggtaagatggcttcagattcgccctgaaccaagggagtgtgggtgggaaacattgagaagtatggggctagggctgtgtgtaagttaggagactgtgctcaataggatggcggctaaggaacttgagaaaagggcaaatttgaataagtaagtgtgcaactgactgagatagagaagaggtcaaagggccttctgggggactttaatctgggctttgtgggctcttccttccaggccctttgcatctgccatgggcaggaggtctaaggtcagggaatgtatgtctttttctttccagtgcaagtgcgcccagtactggccagaccaaggctgctggacctatgggaatattcgggtgtctgtagaggatgtgactgtcctggtggactacacagtacggaagttctgcatccagcaggtagtgtctcctctgtcctttctcagttcttatgttggatctgctgaccagtaagagggaacaggctggatcatcccgctgtggtcaggagttgctgagtatgcagtatgtgaattctgaaaccagatatccgggctcaggggaacttgtctgtcaaagctaaaggagcagtattttcatgactggtgaaaaattacctgttgagatgaagtctgatcatttagatatgaccaagcactgtggaaagggagcatggggaggcagtgcagtctcctaggtgcttgactcacctttctcctcctttcctactccaaagactcctgacatcaaggatgtgatgggcctgcccctggccctccaggcaaccctggagacctgagcaaaggtcaccttcagccaaggggcagtgtggtactgcgaaaagaggacttagctgggagcactgcattttagttctgaccctgccactgactagttgtgagaccttgtgtctgtggttaactaactcccctgggtacacttacttttccattgtcactgacaaccacagctgtcaccttccctcccctggtactgcccacccttgggtatcagggccaacacacaggatctcctcacttcacaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcaggtcagtgtggcctgacccttgtacccccacccccacatttcgcccccatggccagagcaggggaacagcacaagggccctggctgaggaggctggcacagagtagatgacctactggggcaccagcgcaacagccagagactccaagttctagtgcagggtggagaatatgacttgaggaaggagggtagggcagtcctccaagattaggagttgggagaccctgctatgaagccaaaagactgggtcaagtgctggccatgtatttttgcagccttcggacccttctagctggaggtcaggattcaggacatactggagttgttggctcctggagagccccagctctaccccattcagaattaggatttagaccctgaaggaagagcccctgcctgtgttgcccctccctatctgctcccacaaggcaggctggccatccctataaccccctgctctctggctacagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatgtgagtgatctgtgggtcaggtgagggtggggggttccaggactaaaacatctgcccacattgaggattcactcagtctcacaggttattgtaaatgattactatagagtgtgattgtgggggaaagaaagatagatcacactgttaccgtgtctatgtagaaaaaggaagacacgagaaactccattttgttctgtactaagaaaaattcttctgccttgagatgctgttaatctgtaaccctagccccaaccctgtgctcgcagaaacatgtgctgtattgactcaaggtttaatggatttagggctgtgcaggatgtgctttgttaaaaatgtgtttgcaggcagtatgcttggtaaaagtcatcgccgttctccagtctcaagcacccagggacacaatgcactgcggaaggccgcagggacctctgcccaagaaagcctgggtgttgtccaaagtttctccccactgagatagcctgagatatgccctcgtgggaagggaagggtctgtgctgaggaggattagtgaaagaggaaggcttctttggagttaagataagaggaaggcatctgtctcctgctcgtccctgggaatggaatgtcttggtgtaaaacccgatcgtacattctatttactgagataggagaaaaccgccttatggctggaggtgagatatgctggcggcaatactgctctttactgcactgagatgtttgtgtaaagtcagacataaatctggcctacgtgcacatcaaggcacagcacctttccttaaacttatttatgacacagagtcctttgctcacatgtttttctgctgaccctctgcccaccattaccctatagtcctgccacatccccttagccgagatagtagagatagtgatcaataaatactgagggaactcagagacgagtgctggcgcatgtcctccgtatgctgagcaccggtcccctggcccactgttctttctctatactttgtctctgtgtcttctttctttcctcagtctctcgtcccacctgacgagaaacatccacaggtgtggaggggctagcccctttcatgtgatgaagggctcttataaattatgtattcaaagaaatcgagcacagaggaggttgtggtttcatgcctgggagagtcaggaaggcagatgacaggttactggacttcaaagattagggaacaggcagctgaaagagccagtgcccagagacatgatgaagctcggccacatctgggagcagcagtgagattggctctgcagttggggcatagcaccaggagggaggcagggaccagactatcacgggctttgggtgtctccagtttctgacagccccttcagactattaaatctgcactctcagaatgaacaggaattgagtttgtccttctctccaggcgtccaccacccccaagatagacctggacccttcttcccaagtaaagcacccccacagggactcctgcatttcaagtcccacttcactaaattgggataataagagggagtccttttattcctgctaggatcaaaggagaaatggactggagtgaagtgggggtgggaacaggtgatctggcatgagaactatgttgtatgtaaccaagaacttctgtgtcattcatgtttcagatgcagtatgtcttcatataccaagcccttctggagcattatctctatggagatacagaactggaagtgacctctctagaaacccacctgcagaaaatttacaacaaaatcccagggaccagcaacaatggattagaggaggagtttaaggtgagttggagctggataacctccttcagattgaaggatccttgtaatctggggaacatgggatgcctgactgtgcatttgccaacagtaaatccccttgtgaggcatgccagtggttaaggagatggtcctttcctcgtactctggtaactctcaactcatcctgcacgttggaatcactttggttgtgttagagtagggagaagcaggcaacagtattttaaggcccctagccctccgaggtgattatgatacacagcaagagcagttttttctgtaagagccagataataaatattttaggctttgcagcccacatggtttctatccagctacttagtgctgtctttgtaacacaaaggcagccataaccaataggtaaatataatgagtgtggctgttttataaaactttatttgcaggcagcaggcagcaggccagatttggcctctggaccttagatcactgatagctcctatatgccactagacaatggttctcaacacacctaaggcatatgtcacactgtcatcagtaaaagtgctctcccaggctgggcacagtggctcacgcctgtaatcacagcactttgggaggctgagacaggtggatcatgaggtcaggagttccagaccagcctggccaatatggtgaaaccccgtctctactaaaaatacaaaaagtagccaggcatgatggcacatgcctgtagtcccagctactcaggaggctgaggcgagagaattgcttgaacccggaaggcagaggttgcagtgagccgaaatcatgccactgcactccagcctgggcgacagagcgagactccatctcaaaaaaaaaaaaaaaaaaagtgctttctcagaagcaggagattctgggttggggtggggaggaccacttagagaagttcttctcaaatatagcatgtgcacagatttctttgggatcctgtcaagatgtgggttctgccaggcacggtggctaatgcctgtaatcccagcactttgggaggccaagtcaggcagatcacctgagctcaggagttcaagaccagcctgaccaacacggagaaactctgtctctattaaaaatacaaaattagccaggcatggtggcacatgcctgtaatcccagctacttgggaggctgaggcaggagaatcacttgaacccaggaggcagagattgcagtgagctgagattgtgccactgcactccagcctgggtgacagagcaagactctgtctcaaaaaaaaaaaaaaaaaagatattaggttctgattcagcaggtatgagttagagcttgagattctgcatttctttttttcttttctttttttttgagatggagtttcactcttgtcacccgggctggggtgcaatggcgcgatctcagctcactgcaacctctgcctcccgggttcaagggattcttctgtctcagcctcctaagtagctgggtctacaggcacgtgccactacccccggctaatttttagtagagacagggtttcaccatgttggccatgcgggtctcaaactcctaacctcagttgattgcccaccttggcctcccaaagtgctgggattacaggcatgagccaccacgcccggcttgagattctgcatttctaataaggtgaagccaacgctgctggtgtatgggctacactttgagtagcaaatgtcaagaaggagcctcaatcgggaagggaggatgcaattctgaataagtttttttgaagagccttaggcagcctctgggggtggaactgcagagtggacacactccctcctacgatgctggaatcccttgctccaggatcacaaaattccaagccaggagaatctcaagagagtccacaggagcctggaaggtagcatttcccaaacagtctcttggcttcagggttccagctgaacatatgggaacagaggtcagggccctggtgagaagagcagtatggagccagagtggcctggaggtgcaggccaagggacaggcataatcttgtcaagttcagttactgggatcagtaatgtttcccctccccttcccaattcagaagttaacatcaatcaaaatccagaatgacaagatgcggactggaaaccttccagccaacatgaagaagaaccgtgttttacagatcattccatgtaagagccctcccgccactccaaagccttattgccccatccctcaattccctccaccccttccatttctcaggtactagttaatgattggcgtatagacaagaatcatggcattgcctcttgttgcacccacttaacaacatggcgttgccttttgttgcaccttagtggcttctggaaataacgtaaaagccaaaggctttctccctaatgagctaggaacagacatgtccttgcccagctgggattctgtctgcccagggcctgaggtgggagcaatgcaaggagagggagaggacaaatgatattggctagccataagccgctattcttcttacagatgaattcaacagagtgatcattccagttaagcggggcgaagagaatacagactatgtgaacgcatcctttattgatgtaagtggtgggtgtgacccctgagcccccaacaccccgtggagattcagccagcacttgcagtgcctccctcccatacctgctggggaggatcatgtttgaatcagtcaacaaatagtgaattgatactcacccacccactcaccctgtgcattaggtctgtccagctccatagagcagaaggtgggggaaaacagatggcatgcagtagtataatacctggaagaaaaagttcacagagcagaccacagccaagaggaacctggctgccccctgatctttcccattcctgccctcttcatcctagctctaatccctgttccacttccctgtctcttacagaaagcaaccagcttgtcagatagggtttcgtccttggccacaggggagctctgcatgggctgagtttgcctccgagcagtccccattcccttctagtggtctgtcttctccactagtccctctgtgattaaaccatctcacccttgcaattaacctggcctgtgcagggctaccggcagaaggactcctatatcgccagccagggccctcttctccacacaattgaggacttctggcgaatgatctgggagtggaaatcctgctctatcgtgatgctaacagaactggaggagagaggccaggtgagttcaaaaggtcctgggtggtgagagacagagacagcatgaaaagatgtgtgtgtaaatggggacgttgggaaggcaagaaggtgtttggaccttgtctttgacttatacggtccaaagagtacgtttgcatagtataagtacatacttaaaggtatataaatacatatgcatttccaggattgcccagcccgttggtgtctaagcagtcattagcttctcccaagactagaaaagcaatgtgatctgagcctccatgttattcccagacagctcacacccttgcactttctcctgaatacagtccccctagcctagcctttgcacagtgccccaggcggggggggcaccctctccttcccagtgccccaggcagggcagataggtcaaggttctgaggtggacccaatatgagtgtccctaagaagggattgcctcattgctgactacataaaataaagcagtagaatttgagaaattatacaaacaagaaacttacagtctaatattcagtaataaggaaatcttttaaagaaaaaagccctcaggtctattaaaaagcagagctgtccggaaactcatactaaaaagggacactagcagtcccctaggtcaacttcctctcagtataggaaacctcctaatattgttcctgagtcagaatcatacagcctctactaagcacattcaatctcagggatatctccctcaccccccacattatggggggacccagtctgtgttctgacaatgcttattcttttaaaaattatttctgttgaggttgcacattgcagcaaatgagcggttcactatgtctggggtgtcacttagcagggatgagaatctagagaatgggcctggagagaagctagcaaggcctggtgagaaaattccttctaagccacagtgaagagtttggtcttcctaaagcaattgaagagcccttgacaacatcccatttgtgttttttaaaaaatccctctggcagcagtgagaaggactcattagaaatgcgaaagctgtggcagtaatgctggtggcctggactcgggtggtgagagggtgctgtcccagaaagggtgaagtgaggaggaattaaggatggcacccactcatgactcattgaatttatagtcaaacatttaaaatacaaagtatgttttacattagttgtctcaagtcactagttgttccccatctgtacttgtgttaactttggtacaaggctttacacatattttctcaccctgatgtttcattacatcaggattttttttttttttttggttttgtttgtttgtttgtttgtttgagagagggtctcactttgtcacccaggctggagtgcagtggcacgatcttggctcactgcagcctcaacctcccaggttcaagtgatcctcccacatagccctccaagtagctaggactaaaggcacgtgccaccatgcccagctagtttttgtatttttttgtagagacagggtttcaccatgttgcccaggctggtcttgaactcctgggctcaattgatccacccacctggttgacccaaagtgctaggattacaggtttgaaccaccttgcccggcatttttttcaattttgatcagtcatttaactcattagctattcttcctagacttgtatcatgtacctaatcaacagacatactttgtaggtcttcatcatcttttttttttttttttttgagacggagtctctgtcacccaggctggagtgcagtggcacaatatgggctcattgcaacctctgcctcccaggttctggcaattctcctgccacagcctccctagtaactgggattaaagacacccaccatcatgcctggctaatttttgtaggcacggggtttcaccatgttggccaggcttgtctcaaactcctgacctcaggttatctgcctgactcagcctcccaaagtgctgggattacaggcgtgagccactgcgcccagtgtcttcatcatcattaataacaatactgatgaggtgggaggttcggttaaggtgcttggctttgcactcaaggaagcacacacctgagtaacaaaagctgtttaggaaatgagccactgtgttctcaggagctaggtgcctgttcctgccgtctctgatcagtcgtgatggaacctgcagatcagaccagggccctacctgtggttccttctgcacccctgcccttcagatctgtgatgggcaggaccaaagagcaggccgaagagctggaaccacgagcacaaggaccatctcggcccactgccctgtgataaaatgtggcccagtgaacatctccgcctctgtccagtcagatgcaggctcttccatccttgaaaaggacctagtgagagtaaagggcagggggcaggaagcatttcatgtgtgtggcggtggggagaagagtcgtgcgcacacaaattctgctgcctgttgagtgaggcctctccctctgccttccactgtagcttatgctctgtcttcctaggccagtgaagcagacagtagtgcttgccctcaaaagcttctgagtggattggaacaggatgttagtgatgttctttacaaggcctcactggcccccaagttcactttctgttccattcatgttgtcaagtgtagctcccagaagtaattaacgcactaagcctaaatgatgcaatgaaaggtgcctacacttatacagtgacactaccatcctcacctacaatattaagttcccagagaaaaaaattcgatcccataatataaattctgtacttacaaattaaaatctcgaaggaattaaaaatttttaattatctccctctgctttttttttttttttttttttttttttgagatggagtctcactctgtccaccagactggagtgcagtggcacaatctcagctcgctgcaacctccacctccagggttcaagtgattctcccacctcagcctcccgagtagctgggattacaggcatgcactaccatgcccagctaatttccatagtagagacagggtttcgtcatgttggccatgctggtctcaaactcctgaccccaagtgatccgcccgccttagcctcccagagtgctaagattacaggcatgagccattgcgcctggcctccttctgctctattttaatcaaaagggtccaccaggatgcctgggttccctcagcagctgcagcttggaccatcatcagcctgggcagacagagcagtgccaggaactcccatgctgggtcaaccctaggcctagcccaaccctaggcctcatcctgcttctctaaagcatagtgaaacctgatagcattagtcttcacaaagctgtgtgtccccatcaccatgtccgccttagacctcataagagacataagacataagagacttcatgctatctggtggaaagacaaagtaggagaaaagacagaaaaccttccctgtttcacttctttaagatgctattatctagaggccgtaacgtgaacacacaaatctgagatgaaactccagtccccagcttttcttctactggtcttgaatccccattccccatcttctgtccctcacccactgatgactttaacacctggcttactgctccttttgagcccctgttcctgactctgcttttggaggcatcagtcaccatgtggatgatccatctatcctcaatctttctattcctcagcttcctcagccacctgatcccatggtcaagtcaccatctgccctgtatctgcactgcccttggaatctcaacaaggcatccgccctgtttactgcctccttcctcccacctcagtattctcttttattccagtcatttttgtcttcatcaagtccttagagttattgatgcctccactttctcaacatcagtcacaccgaacatgtcctcaccttcctccttactctgtgtgtttttgagttctgtttttgagcgtttgagttttctgatttgagtttttgtggtatgtcattattacctttccttattccctcatgctttcttactttcatagcaaactctctagtaaaacccagttatatgcctctatctgatatagcaaacatcactgggcaaaaacacaaaacagtgccaaatgctctcacactgaactcatgaccacaaatctcatagaggtaattggtgccacctagcaatgctattgctctttcttttcttcctgaaacctccagcatctgctcttgcctgtcccatcatactcacaccttagcttgtgacctggcctcattcttctccaagaaatcagacaagaacactgtcatcctcccacccccaaacaaccagcctcttcaaatctgtaccaactctattctctcttgttacagtggaaaagggtttctgcatctctcaatccacctgtccactgtgctcttggccccattccgtcctgcctgctcagggatgttgctgctataaccatcttctctcccacctccatcagcagttcccctctttaaccactactctcatcagcctatacatgttacatttcctatcttttaaaaacaaaaaatctgctaatctcactttcccttccacctactatcctatttctctgcaccccttcccagcaaaactcctttaaagagttggctttcggccgggcgcggtggctcacgcctgtaatcccagcactttgggaggccaaggtgggcggatcacaaagtcaggagatcgagaccagcctggccaacatggcaaaaccccatctctactaaaaatacaaaaattagctgggcgcgatggtgcatgcctgtgatcccagctactcgggaggctgaggcaggagaatcgtttgaaccagggagctgaaggttgcaatgagccaagatcgcgccactgcattccagcctggtggcagagtgagactccatctcaaaaaaaaaaaaaaaagagttggctttctccctgcaagttctctgttcgctctgttccttccaggcttggccccactgggactgctttagtcaagatcaccagtgactgtcctcttgccaaatccaaaggtcatttctcttttctgatttttttttttttgtccttacagcagcatttgaaagagtcagtacctccctcctcttcctcagaacacttacttccgtagcatcaccccactcactaacctggcagctcctttgttatttctttgtgacctcctcctctaaaacattggagtatactagactcgggcgctagcccactctgttttcttttgacacactagcccttcaggatctcagccagtcctatggctttaagtacaacccatatgccagggatcctcaatctgcgtctctaggccagtcacctgtcccccttcccaatgtgggctcctgatttcctccttcccccgacaccagtccaccccactcttagccatctaaataaatagtaccaccttctgcccagttgctcatgtctaaaatccgggagttaccttccttcctcccctctcctcacccctcacatccagtctgccactgagtcctgatacaggcagagcctccccacttttctccagcgtaactgctgtcatctgaacaagccctcgtctctcactgcttgcccgtgggactgtgggcatgactcatatgcgcagcctcgtctgcagtggcctggcaactggtcctcctgctctcatcctaacccacttttagtttttcaaatggcagctgctggtccttttgaaaatataaatcattgtcactccttgtcttacaaatcctgtttgaggccaggtgcggcagctcacgcctgtaatcccagcactttgggaggccgaggcgggtggatcacctgaggtcgggagttcgagaccagcctgaccaacatggagaaaccccgtctctactaaaaatacaaaattagcgggcatggtgatgcatgcctgtaatctcagctactggggaggctgaggcaggagaatcacttgaacccgggagccggaggttgcagtgagccaagatcgcgccattgcactccagcgtgggcaataagagtgaagctccatctcaaaaaaaaaaaaaaaaaaaatcctctttggtcttccagagatcttgagagaaaatccgcccatgtatacaaaatttagagacttttgatcagatgtggtggctcacgcctgtgtaatcctaccactttgggaggctgaggcaggtggatcacctgaggtcaagagtttgagaccagcctggccgacatggtgaaaccctgtctctactaaaaatacaaaaattagctaggcatggtggcgcacacttgtagtcccagctacttgggagtctggggtgggagaatcacttgaaactgggaggcggaggctgcagtaagtcaagatcatgccactgcactccagcctgggcgacagagcaagactctctcaaaaaagaaaaaaaaaatgagactcttagtgttgatacctagtccctagacttgatatgtatttctgtctgagagatcatgctcaattcctccagcacacacacactgtggctcacacccatggggaccttatggttctgatggttttaaaggcccagtcttcatcccagctgagacactgtgtaaagcagtgttgagaaggcactgtggtagcaaaatccattccacccaccagtgccataaaaactaatataatgcctgatcgaggtgagccttaatgagaatttttttttttttttggctgttctggttgaagagaggcccagggcaccgatccctgaggcatccccagggcttctagagaacatgggtggaaaagcactagtccagggcatgttcttgattcaacactttaataatcatgattttatttggactgtgagactattcacaatttctttttctacttaatttttttccaaatctttcaatgacattatatgtatggttgagaatttttcaattgccagtagtgaagaatctcagatcttacccccaaattctctaaagaaatgggcagcataactgtgtgatgttatatttatgtatttatgccttggcttgttctgcagacattgaacaaattcatttaccagatactgagagcctaccatgtgccaggcattgtgcaaggtgtggggaatacagagatgaaaagagacgcagccactcccacaaggagctgtagagggaagtgagccaggtgcaagcaaagacagacagtagaccacctcctgctcactagcaaggacagaaaggcgagtgctagcaacttgaaggtaccttgcagatcaaagagataaaggtaaaagggagaaaggatactgtggcctgggcggtggtgaagcccatggctgtgtgggaatgtgaattggttctgattttctgaattagcagtctggcggatgtaagcagcattaaatatgaaaacaccccatgggagaaaaagaaaggaattggaacaaagattttcactcgtcctcctctccctgcagccaccaagtattggataccctgtgagcctgtagtcagagtcctttacagaccccggcagtgttttagatggtctctggtgaggatcggaggttaattggaatgatgtgatataatgatcctgcaagttttcaataccttggggacgaagcgtatcagcgtaagaggtggctgtactgagaggggtcaggctgctcgtgggcagtgctgcttctacacatgtggtactctgagctcctcacctctccaacctgtctctccaggagaagtgtgcccagtactggccatctgatggactggtgtcctatggagatattacagtggaactgaagaaggaggaggaatgtgagagctacaccgtccgagacctcctggtcaccaacaccagggtaagatgggtcgtgggtggactctgcccacaggaaaagcagggttacccctgcctccctgatccccttttttccaaaggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcaggtatggctcacccttgccctcagcgggagagagaaagcgaggaggggcagataggggaagctgatgaccatgggtcagactgaagaaagccatacaagagcaagatattggtgagcacatagtagttgagattgatgccaagacaggattggatgctaagagagaggaccttggagcttgaacttggcacaataagtgctaggggactaatgttcagatagtgggcaggagagcagcaggggagactggcagtggagaccccggttgtgctatgaacagagggtgaaagagaagaggagtcaagggtgtctcccaggtttgagcctgggttggtgtgaccagcagaagagagacagtaaagaggtttgtttgaggggaaaagttgaattttgtatggggcatgttgctggaggttacgttttagaaaaaatgcactcctttacttagaatcctaacaacagcttacaaggcccaatatgttctgaggggtccctggccagggccgggagaggatggtgtgcaccatgggctggctctgagcacactcctgccatgggcctgagatgccagtttcccaggcagccacagggctttgcccaagccttccctgagtaccctgccagaactcccactcctcttttctctttccttaccacacatcttcttgtctggggacattgctaaaccccacagtccctgcctcagagtaggcactcagtgtctggtgagtgaatcagctgatgacattgaatagggggatattgtcaaggtcagagtctggattccgtggatttgggaagaaagtgaaagacatggaaaggaatcagcagatacacaccagtgtagggagtggggtttgtcagaaaaagggaaagacaggactagagctagttctaactgagcgaacagcaggtcagaacaacctaggccagcatgtgcaggtggacagcaatggctctgtgctggtggggtgtgagtgaaggtcgtcccccacggtccaacaggtgagtccctccacagcacatggggccatgcaggaagggcacagggtacactgcctcccgacccagaacccctccaggctggtgggtccacagggcaaaggcgagcaccagctgcctgcccccacctcttctgccactcaccactgtcactcacccccttgcacagagggccatcacaggtgtggtaaatgtgtctgctctgttgcagcgccggggcaggaaggacggggaccttctgtgccctgagcaccgtcctggagcgtgtgaaagcagaggggattttggatgtcttccagactgtcaagagcctgcggctacagaggccacacatggtccagacactggtatgctgcccacatatttgtccctgccaccacaccacctgcagcccttctctcagggaggaggctcttcagaggggcccacccagtagtcagaagactgtctaaacacagacctgcccttgccctcccaaggtgccccaaatacacaggaaacattgggaggcaggatggcagcaatgggagcatagcccctgttgccagaggttgggccaggttagaaggggtgtctgggtgccccacagggctcatctgtacttctctgtgggtcttgggtaaggaagatccatgaagagtacctgcctttgggcttgggctccctgttaagaggtctgactttaataagccgcacatccacagaggttttcctgaatcccatggagctagaaatgtttggggggtaaagaaaagtgaatgttaggaggtttgggagacgaggttctgagagccagggtgcatgctagcctggcagccatggtaagcgtgggccatgctcagctgcactgtctcccagcccagcacatgcctgtctgacctctgtggggcctgggtcagctctggtcagctctgcttgtagaaggtctgctgcattcagcccggaaggggaatgctgtcagaactctggcaggcagatcagagctcaggtgaaagttcaaaaacattcagttcctcttgattttccatcttcaacaaaaaaatgagtctgttaggaattacaggtactgtgtgttcttcagtaaccctgactttttccctacctttcactctccaggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctga

SEQ ID NO: 2569 - DNA, 118509 bp, Homo sapiens
tagaacaacttttttgacttcctgcaaagaggacccttacagtatttttggagaagttagtaaaaccgaatctgacatcatcacctagcagttcatgcagctagcaagtggtttgttcttagggtaacagaggaggaaattgttcctcgtctgataagacaacagtggagagtatgcatttatttatttacttttacatttttgattcgtttttacagagaaaaacttctacagagataacaattattttgcttttcagaaggacgcatgctgtttcttagggacacggctgacttccagatatgaccatgtatttgtggcttaaactcttggcatttggctttgcctttctggacacagaagtatttgtgacaggtaagtacaaggatattaatattttttaaattattttttctcttttggaggaatgtttgaaatagacataaaaataatttaaatgtgttggtaactggaagtgagaagcctgctgtaaaccatcaagattgttgtctcagggagacatagctagttgtgtgacagaatacattgtttctgtttacaaagacataaatgtttcgggacaaaaaatacaattttaaaaggaaagcaatgtctatctgtatctttatttacaactgttcaaagatattacaaaagcaacattattacttaacttccaaagtgacaataacacacatttataaaagcctgagaattttttaatgataaaataagtgagtttttattcttttaacaaatttgatcttttaaaaagtcataaaacagctttggttgtatgtaagccactccctcttttcagacctgaagtttgcttcctcaaattttgaatttaattgacatattttattgaatacttgggtatataatagttcaaaaatatattgagatatttagtaaaatattaactttctgcaatttttatcacagaatgtattttaaatcaagtttttagtttcttgttaatagttttaatacatttttgctttagaaattcttgtggagccaccgcccttcctgggtggtgggtaaatattacagccttgatgagatagaaatatttaaactcttaaaaatcatgcaaatgctgtattcagtaggaaaatgcaactagttggacttccagtgcctattaaagtttgaaatctttgcacatttatggtctattcaatggatagttcttgagcggcgtcaatatgaatcatgagtacatttcaatagattatagaatgtaactaataattaatatttaatatttctctttatgatgtagtatctaaaaggacattgaaaataaaatttttgtagaaattccaaaaagtataaaaagtattttaaaacaacttgcttattacaattcactttgaagtctttttttgacttttaccgttcttctttcctctgaaagtcagggaagtagctacctcttgagcatgttacattgacaatttctatttggagaggaaagaaagaggaaagaaaaacaacataagatttttgttgttgttgttgtggctgttttgctttttattgcaaaggtgaattttttaaaaatctatatatttgcagcatttgtcttagtacagaaaatgtttatcaagttaccatccctttaaagcttatgataataaaaagtaaattataaagaataataatctcaatgaagtgatatatgtatattatcacaaatcagaacagattttcatttaaaattcccactcaggaaatgtcgaaaagcatttttaaatgagcataaagaaatactgagacattttgtaagccagaatatttttcttctcttcatattcatttaacttctattattttcttcaggtctagctccattgctttttattccaggcaaacttcccaacctcctgaatagaccaaatatcctattatatgcttaaatcagagtgtgaaatatttcctttgtgaataaaaattcaactcattctattacaggatgtttttttaaccataagacacatctttgaatttataattgaaataatatgatggggtctagaaacctttatatcaactttgctgaatgatttataccatagcaaataaatggatatacataaatttattttgaaaactcaactttatcttcagttgctcacataaatattgagagcaaacatttttctaaaagacatttgtagactccctgagatatatgcttatttgtggaaaaacatatacagatataatcatttgtatctgcaaatattgtttataatcctttcaagttgcaagaaacattttgtgatttaatgtataatttggaaaattcttaatgctttaaattatttatttttcttttttagcaacaaatgagttggattctatgtttcattttaacgtgttaaaattagtttagtgcctacaggaaataataaacttttggggaacaaaatttatattgtatgctgtaaaggcataaagaaatagagccaaatgtagagagccatcaatggtaactctatgcataattcaaatattttatttaatatctaaaatgcacacacggacaaggccaaagttaatctttgccacggcaacaaccaggcagggttcagttttactcaagacttcctaatcctcttgctctgtgcctctttgccatggcaactggaagccaaactttgtttagaatttctaaataatgttaggggacaatgatggttttaagaaggcaggtgaaggtgagtgttctctggttctaataaagttgtaatgccaggcagatctaccacactatagcatggcagttaggagtatatgagttatggtatgtgaggtatatgatgagttttgttatgagtcataacagttaagactcatttcctggacataattcttcatttttccatctgtattaaaaatatatatctcatgttataaacatggactgtgccttgcacatcacagacattcaatgaaaattatttaattgaatttggtaagcagtcctattaagttctaaatactccataatttagagatttgggaatgtgattagaattacttattaatttgaaaaaaaatgtcctactaaaaacctgcctgtgacctttatcattgctaaagtttgaaatgtactttgttacaggaaagactacggctagggcctatattatctttttctcttttgttctgtgtaagtaagtataggggcagagtagttagcttgaacttagttctttctttgttctggactatttgctatcctctcaccagtgacaattaaccagtatagaaatatagatgtttctacattgttcatatacttgaacatatatttctttatgtagatactcacacataaactagttatatatttgtgggttatatatactagtcaatctatctatctgtctatctatctatctatctatctatctatcagttctccatgtttgtctatttggcgttcccatgaacttcagaccttcgcctgtgttctcttttctccatttggttacgtatcattgcctactatgtgttgatcactctgattctccatctctagactcatccctcagaaacacggaacttactacctttcctaaatccagacattaacatgctccccaagtcctgaaattttgctttgtaataatctctaataacttcttgctttgacacctccattgccatcatcttaattcatggctttattatttctcacctgtaaaattgtaatagtttttttaatcagtctgaagtctcatcctttttttaatgtaatctacagcttaaaaagtaaaataaaaagtgaagggttactgatttcttctcattgcctttggtataaattctaatcttttttgccagagaaactggttccactaatgatctgggggctaggcctggagctgggaagggatcttttttcttttctttctttcttcctttctttctttctttctttctttctttctttctttctttctttctttctttctttctttcttttttctttctttttcttctatgattgattaaaagaaaacaaacaggaggtagttttaacacccacctctatactttctcaaggtgtttaaggttctgggcaaatcctacttcttctattatgttctcttatgtcacttttgccacaaaatatttccattgaattgcacactttttatcaccttttcttggcatttttcaagtcatttcaatctgctcttttttgtgatgatgattgatgatgatgatgacatgtgaattagtggatttcttgacattgtaacctacatgaaatcaggtataggagacacaaaaggcataaactcatagttcccatacctaatttttcaccagacactgaataaatcatagattaaaaaaataaaactgcatattgtagtgacaaaggaaaggaaaattttcaaagagggaagtcaaaaagagggagaatatgagataaaaaaattaaccagaggcgaagtgggaggatgaagacagcaggactattttgtccagattaaattaagttgattttggatctagatgtttacagtcttgcctttttgtttttgtttgtttgtttgtttgttttttctttgctccctttcttactctccttatctcacctctcgtctggaaagagcctcctgacttcctaaaagttcatagtttgagaatgtttttcctaaattttctttgatctgctctttggacattctaggtaatgtaatttggagggtcaattttatttttcagatacacatacccataggagaaaaagcaaggaatgggagggaaatacaaatgtagcggagtgataacacaaacagatcaggtccagtcatggcaattgctggtttgaacactgatgctagtgctctgggattgcttgcaagggcagatggaatatggtgcaccctaggtgttgcattatttgcacgacaaaagtttgtagagagctgggaataatttctttacagacagtgtggtgatgaatgtcaatctgagtaggtaaggggcagagatttgtactgaggttgattcattctcttggtaaatacacaatgttcacaaaggcaaggtttcatcttcagaccatgtgtgtatatgtcaccttggtgcagagagagaaatttttcatcagtgctgacctttgatttttttttctagacatcttatagatttatgtagttatttacatgggaaacaattagaatggaaatttaacatatcttcagtttaaaattaatttctgtctagtctaaatatctttgtaagtactagatactcaatcccatagcagtggccttttaccaaaggcttagtgctatgacttttgcatacataaagacctcactttttaagatatgatacaccagaaaaaaaatatggcaagactttagcaatatgatttgatgcctatttctatataatacccaaatatacaggaataaaaattatggcaatcactggattttgtgtacctggctctaaccaatatttatattagaaaatatctaattattgtctaaaatatttaatcttcattcctgtttgtatgtcagtgtgctacttcaatatcagtctgttaaaagagtctaggaatgactactataagcagagaattatatgttcaggaatcacaacaaaaaacaagaacaaatagagaaacaaaagctttcctactctttcatctaggacaagaataaatacacataaagtcaatattagtgaagtaaacaagcatcttctatatccattcatagtaccttcaattgattgatttcttaacagacaatcagcaaaattatcagtttttattagagattttagtagagaccgagcttaaacaaatatattctatggtgcttaactctatagtatttaaagattcaatatttatttcctctaaaaatgagtcaagtgtctgaaaggaaaaagccacctaactgaaacttcagtttctactatacagggtatttattataaaactgtaattacaatgcaattatattgaagtataaatgatcatcattcatttatttaagaatataatcaaaatttgcatacctggaagaaaccatccaccctccaaaatagggatttgctaatgtaggagtagaaggcaaaagttgagggtaactcaggtaacacactcatacgtattaggatatgaacagctggtatagcaaacttgatagaaatcactgatagacaagaagacattctctgcattttaaattaaagtacaatttgtctgtggtcattcaagagatagtttagagaaacctatacaaataacaatgatgctaagagacaatatcaaaatcacaataaatatcatggcaatacagtgtggccactatattttaaacacatccacttgatgaaaaatataataatttactgataaaacatattaagcataatagaaaatgaggcagaaaccactccaagctgggaaacatcatgacatctgtagtgataaatattttgaaaatctaactctatgaatcttgtgatttttagctaaatcaattttcacccttgagacccaatttcctcatctataaagtgttgtaagcattaaaagttataatatttgtgaaaatgctttgaaattatgtgatactctgagaagtaaattttttcatgtgagcccatgaaatcagagcacatagccttttagcataaacttgattccaaatgatatctcttcctttcagacactgtgagcagataaagggatagtttaaggttaagtgatagaggcataatcccttataggcctttgaattcttttaactttgcattctttatttcagagatttttcaggcttctccagattctacagtctaaatagtttgtaaatccacacacttctactttgccagggatttcttagtgtaaaaatatcctgaagtctcacctgccttcaatccttactgtgtccatacccaccattaccaggataatctttgtaaaaggcagaacttacctttgtccattcctcttttaaaagctcctattggtagaaaatatactgaacccgtgatttgataccaagtatgttttggctcaacttttatgaaaacaaatatttaattagaatataccaacatttatgagttttccttaaagataaattttggaggaaaaaaactccattagaccaatttaattccctgatgattatatatatattacctagtgaaatccttggcagtttttccattttaattttaattttactgaactaatgtttagcagcatcactttcatttaatttttacaataactattagattcatgaatccattttacccatgtcaagttctactgaatatagcttatgcttggaattttcctttgtgattattacttttctaaaggtaattcttcttttcaaacaatacagatctaaattttccaaaaccatttaaattcttctctttggccagaaacattttctgtgtgtagttttggctaccgctagtttagtttttttaattggttttgtgtctcaatgctacaaaaaatataatttatgtaatttttcatttttgtcaaacttaaatcgggcaatattaaccattctcaattttttgttgtgttgaaatttctatcagtgacattaatgtggagattgacagctctttgagctagattcattttgaaattttaagactttcgattatttcttatctagccaatagaaactttagaaacacttttaagactgcttgatagcctggaattattatgtttgaattctcattcatttgtatggtattcctcttattagctttcacacttagtaccaatttcttattcattattggagcaaaaagtaaagagaagaatcaaggtgataagtttaaaatcttctcaatgtaaaatagtgtgtggggaaagtgtcaaatcatcctactttggtctttgtgcatttaggaaaaataaaagcaattagcattgcacacacatatgtaattgaatctcttcagatttgtctggctttatctctaaccactttgtgactctttttgtaacttgcatttttctaaaaatgtgaccttgtttggtcttcctactgttggccatgctgtttttccttctctccacatctttttatcaatggtgcaaattataaattgtattcaaatttactgtaaagatcatgtcctctagacagcccctatcccacttgtataacccttgctcttcagcccctttcacacctgcataggtattcttctgctgtgatgatcctttgaataattctcttggagttctctttaccaggctctcttgcagcaactggtgagctcatgtaggctatcactgggtctctgcttatttgccagtgcctgcaggtcctcagtacctgtttgctgaacaaacgaatggtctgtcagcttaacccaactctgtatgtagaaggcacttaataattcttaaaaacaattttgattctgtccttttattgttatttatgggaattatttatggtaaaaatttctacataatagaaaatttggaaaatgtcaagaaatagaaggaaaaagaaattgcttagagcccatgctaacattttgtttttcttcctctatcttttgatcacatgctgtgtatgaaatttcatgttcaattttttcccaagtaaaccttgattattctagacaatttgaaaaatatagaaatgaatagaaaaataagaatttcaggtttccagttctcaggatctaaaaactttttgagtatttcatttgactaggacaactagatctattcagttatttattaacttattagttcatttgataaacaactattttgtgagtgttttccatgtaatttgggctgaggacacctatcccatgaagcccgtattttctatcagtggcttcttggagatggtgttttaaatcttccaaaatcttcatcagcaccccaaaacttcctcctcaaagtaacaacataccttgctacagataattattggtgttatcaatgttttataaattataaatttaaaaatcactatcttaagatctatatataacatattaagtaaaacttatattcttacaagacttcctccaggtccctgttacaaccagattttctttgcagacttttaaattatggaagttctggtgctgccactgagttgtgtagattattattagatattcaataaataaagttggtagatgtgaagaggtactagacaatagtcctattttgttttggtttgtttgttttgtaatttattctgaaaaaatgtttatgtggagagaaaagggaaaacatacagaaatacacagcacacaaacaaattcttacttttttttggtagtctttctaattttccaaggtcaccagctaatagcaaatgagagttgtagggggtggggtgaaggctggggtcttaatcggggtctatctgattctagatagaccagattctagattttccactcggttactcaatcttcttagtggtcagtttaataacctggaatttaagacatgactgtgtgatgatgggcaaatcacagcaggactgaatgggagctggtaatttctcagaggttgtttgtgtgacatatgcatgtaagttcattcacctgatttagctacttacatgaaccattgtgcactgagctgcttctatatctttagcatattctgtatctatgtaaaattcacataagattgtatgacttttataaaaaacaaaaagacatctttgattaatttgtcttcactatgaatactgatgtgatgtgttacaatcatcctgaaaaggaggctaacaaaggacaggactgagtctgtcttgaggtgagtgatatgatggaaagaatggattttcccccacccaactcatttttgatattacataaagtgaaaaacattaaataattcaccaaagtatctagatttttttttgtttttgaagtgcaagggaagtaacttgacctttgttaaacactttgatcatggaaaacacataaggttctcatcttattccaggaagtgtagacactagataatcttttcatagtcatccaaaaagcatattaagtgaaccaggtaaatccatcctacactttttattccagagacaagttggctaaactttgaggagactaaaacaaaacaaaaaaaaattattgtttggttcatttgataaatgtggattccaatcatataatttaggccaaatattatactttgacttcttagacttagatttccagatagtctggtttataaaataagattttaactatgcttactaaactctatgtatttctactttccaatgacccatgttcttattttctgaatttacttattgatgctttaggtatgataaaggtatgtaatggctaaggaaacataaatgaagcataagacatcagttgagagttttgacggaaaggaagtggtgatatgaaggaaacagataaaccaaagaaaaaggaaaaggtcagggagctgataaaagtaacttgaagaaactttagtgcaaatgttggattcagacaatcgctacttttaaagtacttaaagaagtcagtctttgaaatcttgcccggattccattccagtttcatcattggagacttccaatgatgaaaaattggggaagaattaccttccaaagcctcagtttcctcgtgtgtaaaatggaaataatagcaagagatattaaatgagatgattcactcatcgattcatcaattgtttatagagcccctgctaagctaaaaactgttttaagtgttgacacagtggtaaagaaagcagaaagtgtaactacttttatgaaactgacttcctagtggtgagagataacaagaaaacaaacaacaaattgagataacttcagttatagataaatgctgtgaagaaaattaagtagtgtaatatggtagagtttaatctggccagacccagatttaggggtgaatgcacttttagacagagtgatcggggaagatccttatgaagaagaatcattgagctacctgttggctgacaagaatatggggatccatgtgagggagactggcaagagtaaaggttatctggcaaaaccaaacaaattggtaggttcgaggcacagaaaggtcaggcatctgtagtatggtgagtaagaactgagcaggttgtggtgaggctagaaagataagcagaaggcaggtcccacagggccttgatggaaatggaaagagcttgaattttacctgaagtataaagggaaggaaccattttaagttcttaagtacagaataacctaatcttctttctgtgttgaagagatcactttgactgttatgaagagaatagattggaagtaaggcaaagcctggaagcagttatgaggagactgaatgggaggatggagaaaggggatggtgatctggaccaagtgttggcagtgcaggtggaaagaaaggaaagactgacatagaattaagagaagtggctgcatggaaaagacaaagacattttagagaatgactttttttccccatgagcactgggatgggaaagagccaaattagggggtcagaaatccagagttatgtttgggctgttattgatgtctgattttcattaggtggtagagaggtcaagaaatccgttggagataagaggctgaggcccattcagtaggtctcaactggagacataaacataggagtcattgcattcagatggagcttaaagctaagggactgcatgtgacagtgtaaataaacatgtagagagtagcagatgactggtttctgagccttgggaaacttcatatttggaagagacacaaggaggagctaggaaaagatagtgagaagaggtagccagtgaaaaaaagtagaactatactttgctttgaatgttgaaaagggttggcattatagtgagaattcagtaaattccacataaaaatctgaatttatgtctcccctagaaaggttggttgtgaacatgcaattggtaaatatctctattaactttaatattgttacaaaagtaatattaaggaatttataatatttggaagaattagatgtctttacctaatatatcccttgctagcttaacaattagaaaaagaaagaggtacatcttaacataatttgttttaataaaaactacagaatatattgagagactaaagaattagaaatttaactgaaaatttcatgcaaaggtaatgctctgttgaaccattttgtagcttatgttttgttttgatacatattttaaaatattgtttaagacaatacttgaacagattgggattgtgtgtgtgtgtgtgtgtgtgtgtgtgtgtattggttaaataactggtttatttttaaactgaaattaaaccttccatttctttgagaaatttaaaaagtagttgttatcaatgtggcagatattaggtagaatctaatatcgtgaaaattaaactgcacataaatagatataaatccttttgtcagtgtgtgtatatctctgtgtgtaattttgatctcaggcttggcaggtttccttaaaacttttttttagagctacttaattttgtacttactggtggttagctaataagaaaaagctaataaaaaatagtgcttactctgtgccaggcacttctgttaacattttataaatgttatctcatttaacaagctcatgtcattgtatagtctagcttatacttgtctttaacataagcaaatttgttaatttgtgtttcctgatattatcataaaatttactggttgtcatatcctaaaagggaatagttcaatttaattttccttgttctaattttaaatacagtactaaggttgagaaagaaggggtcaggaaagggaagtaacattgagtgtctcgtgtgcctggcactccatatgatgcttcaatgcacaccaggctattcagcctcagatttgtttctacattgcttctagttctacagattattcaacgaatgtacaatccttggtcactagtcttaatagggaaaacagaattatggttaaaacaaaagagtaagtaacttaaatatgatctatcggtatttattttgtattatgatattttgcttaagttgaaaaaagggcgcatcaggtgttttggcagtttactgtgatctcaatagtgagaatgtattgaaaaatctcagtacaggagaaagctgtgcagctttctcttcctgtcgctgcttaattttcatgtagatataaagccgcagtttaagcacatctgcttaatccttatttaaaagactaggagagaactagaaagggagggagggagaggaggggaagggggaagagattgagagaaatctctcccatataacacaaacactgtattagtgtgtgagaagcagataatcgtgcatgtaggcactatcatttgtgaaatcagaaagcataatttactcccaatgctgaataatctagttgtgtgtaagcaccagagagatatttaaatacctatccaataaaagataataaaagcctagcaaacctaagtaatccattttcagatgttaatccaattacgtaaacaaatattacccttttttttttttggtcattgtttcaaggataaagtgtaaatgaaagaaatagcattccatctaggtaaaagaggaatcagcatcattgaaatgtgaatagctgtgattcctccttgctgaatggtaactttagaagagagggaacccaggagtccatccagaggctcaaggaataagaggttctcacccataggaagatgaaaaatactttcagggtgacccatgagggaaaatcaccaaagcctttgaaataaaagattttcccttttctaagaataaaagatggtgttatgtcaagggcggctcgatggtgtggatgaaagaactattgggaatggctactgaaagatcaaaggcaagtggaacctcaaaattctggaagtagaacgagtcagatacaatataagaagtacttcaaaggcaagaaaataagaataataaaaatacctttagttgtcaaatgtaaaatttgtgccagttttgtcacattccatttttcaggaacactgtaaaggtattttctattaatatcaatttaactgtacatatcttcccatctatcttaattagtcacttttcaagaacaaatgtgttatgctcaaagcatccaaaggacttttttgttagccttaataaaatgctttctcttaaactaaattttaatttagtttacatgtctacgtataaggtggttatagaaaatgaatgtaaaatcacttcattaagtgtaacaaaacaaaataatatgaggaattgttatactgtttaagcatttgaaaaacgataaaggagtatagaaattttgttaccactactatgattagtttctcatttggtttttcactttaagaattggaataaaagttgaaatcttgattaaaaaaacaagaaatgattcacaaattattttacaaattgaaatactgaaatacagaatgttcaaccactgtcaacatgaactcctattctgtaattaatctattctataaacatctgtatttgctaaagagcaacagatcaaggaaaagaaaaaataatccttgccatccatagagccatgatttttgtggaatcttcgctccagtttaagttttgtcagtgtctggaagaaaatacttcccatggatcatctttttgctaaagagtattctttacattttaaaacatatgaatatttacataaaggtgtttgtggaaaaggaaattatgtgccttttattttaattcacccattattctattccacatgtaaagtagaaaatactactttaagacaaaagtaaagcattatttatttaaagatctattttgtccatgaattttatcagaggtaacgcttcttaatgttattcagtgccataacttgccttttttctaggcctccattttatgaactgaacatctggatttgatggcaagaaaacatttccttccgctggcttttctaataactccctcttacagatatgcatgcctcatgtttgttaataaaattgacgtgattttaatatctggtattttaacacactgtgaattatggaattttcagtggctttatttaattaaatgcattttaaaatccttacaaaaaaatattaagagtaactctaaaatgtattagagccacagatgttttcctttatagtgttaattgatttaaggtccatcaaaatgctgttaaaatgtctagaggttaacaataacagtggcacatgggtcagattaaaattctttttgagtaaaataaataaataaatgacagcttattttcttctgatttaaaaaaattagctagtggattgaaacaacaatgtgatagctaagatttcattctctcactttataatgaaaggagatttaaaattagggattatatggtacacgaaaaatttatatacacagattacaagtactagtttttttagtgaagaaaagacaactatatattttctctttttatctgttgtcctattttacaattgtagcaattaatctgccaaactctttaatcaataaaatatggtatttaacaaccaaatttggcccctccctccccttaaatatatttccaatgctccttgctccattttaaacctgctgtcctttataagagaataatatattttgtaatttgagaaaatcatgcaaaggaaagtttctcaaaattcacattaatatgtaataatagtaataaatatgtataaccataatatcttagaattttacaatattttatagaaaacatgaatattaaagtgaaaatttaaacacatcaatttttcatgttaaaattactaagaatgaactacagattcatgaatactaagggcaacttttatctcaggaaatatatcagtggactgaaaatgtcaaatcaattcaattaaatcagtaataacactttgctgtttatgtggctgttttttcttctatttttattgtcttagattgcatggatacaatcaaaataagttaatttgtatacaggatataaatggaccagagaatgtgtcttctattaaataataacaaataagaataccttttattttgtgatggtctttactatttactgagagacaagtattgttcaagttgccggttttttttaattagctgacatatttcctgcttttatttgagttagaattcctgtaccaaacattttaaaaagagaaaaaaaattaaagaaagagaaaaggaatttggaaactactataatgtaaagtagcattatttatacaacaattaattttagagaagcaagagaccttagaaataatctatttcaacgcatctattttacaaaaaagaaaattgaaactcatagatatttagtgacttgtcctttgttacaccaaaaatgagggaacttggtctagaattcctccagcatattatgaggtatttgttctgtggcctgatacaatgaaatgaatgttggattaggcattttgggacaagttttgaatcctaactctattactaattcctcttcactagactgagattctggtatgtggtattcaataagtgacttgacttctttaagcctggtttctttttcagtgagatttacagcttagactagtttctgaatcttgaccctgtggacaatctagttggagaactgagatgacctgggcattgtaggatgtttagcaacattcctgcctctgtaaactagacacagcagcacatttacccaacctgctctgactgtgacaaccagaaatgtctccaggcattgccaaatgtcaactgagggcaaaattgcctaccctagccaccttaactgaaaactacaaacttcattgaaataatttctttatggctcccagcagtaacactgtgctattctagaccagttggttaaactactggatgcttcatcagaaagcacccactaagcatcactcaccatgaagttcgttgggtactctatacaatgaacaaaggagatatcacataatttttaaaaaacttaaaagattcacaggtgagaattttgtagtaacaattaagtattaactattagaaaaatttaagaagttttaacaaaatgatataaaaatatattcactataagtaggatgtaatttttgtcctgtaagagttatccatgtatttacgaattgtacctaccagaggttacaaaaatttggtcattatttgaaagattaacagggacttatttccaatcatagatgttcactatactattctaagacatttgcaactgtgtaaggcagtcatttccagtaagaattgctagaacaaacattaagcatttcacagtgaaaagggtcataggtatattttcatcctttgcatatagaagaaatagcaatctattattctcagtttttgacttaaaaggtattgttgcttccctttctttccctcccctactcaagtttttgcccatggatccagatacctacaagggcctaatacagggaaagtgcactgtgtatgagctatgaaggcacaatggaagcttgcctggcaatcagtgccagaacagacagctagtctgatgaattctgctacacatcacagggctactagttttttgttttttgttttttttttttttgtcatacattactgcaagttccctgaggaagtttactgatctgtagttttacgagaaatgcacgtcatggaggtggcgtgggggagcgggtgaacaaggaaactttagttgctataaaacaggagctgagagctcaagcaggttggttatgttctgccagatggagataaaactgtggcagccacatcctgtgactagaaattgtttaagtaggcagacctgttggaggactaaagaacattaggcaaggagattaaattagtgtaggaaaaaaaatcagttttgtttaaaacgaaatatctacttgtgttaatagaacattctaactccaccataggatggaatcaagaggttttttttttaatacatatagtgtatatatataaatatatatatacacacacacacactgtatgtattcctatgtagattaaatattttgatttacctctttctagtaaagcaaagttcattctgaaatccaaaatattcacttactagagcagaaaaaaattagctgtgcatttatgctgatcacagtgtagataattaatctttaagaaagtaggtttttatgtttatagttgataaagtgttagtggcaagaactttttctgttattgaatattatcatcagattactcgtgctttccattttattcctttaaaaaaatccaacttttgtaagccaccactattttctgaagattttatttctctctaagctaagaaaggatgtcaagaataaaccattttctccttttaaataaaaatgcattcactatagatattcatttgaaatctcaaacatacctgaattaagtatactcagttttgtgagtgaaaattaattattatttaaaacaaaacaaaacaaaaaaaatgttcagtgttttcattttacttctcttgctgcttttgggctctgactgggcccggaagcagaagttgcaaaacattatgagaaaacttttgctcttttcttttttttcttcaatctccacccatatggaaataccagaaatctgaaaccccattcttgctaaatattcttctcaggattgtatctctactgcaggtcttctatgacgttttacagctggcctctttccattcagaattgctgttcatctttgaatgtctctgctttactcctgaatgaacacaaacacattttttttaggtttcttgttgacattggctttctttatagcccataaaaaatgcatttgtggcatctcttccacagacaaaaatagtataattatgattcaatactcgatgaatgtgtgttaaactaaactgtgcccaagctctgtgcaacagtacaggtttttcacctttccaggggagagatgtggagcacatatacatttcagccatcctacatgcccacagggacatctttctggtctgtctcattggaatacccttccttatttggtttttagtttctttctgctttaagcacctttcagagagagagagatgttttcctttgtctttgtataggcagtgcctatcgttacagagtagcctttaaatacatatttgttgaattaataatgatacacatgaactgatgaggctctataattctatgagataatctggtatcgtgggaatattttagcatgttttgtatagatagactgacactatgactggtaatctgatagtaaaaatggcaaaatattgagcctgagtattattttattatgttgctttcttatacaaggagggaataaaataaagtgatgtggactgtaattgtgctcatgaaagacacaatgtatacatacctccttgagacggaatgataaggataacgtagaatgtttaccatgatttatcagtctctcctatataagaaaaatatttcttgtcctgaagtggtaactttggtgaagtcttttgcttgctcttttacagactaattaacaagttttctatgccggctctgtcctttcctctcctctcacccctgaaaagtggttaaaagtttggcatttgttacccagaatactaaatgtaacacatatgtggcaagatttgatggaattgcacttctgttcttattatgttcctttctggaaaattatgacaatttgtgtccccttagagagtgtagcacagttttctggttgctcctcatgataatccaaaaaaaaaaatccagctaacccttaccttttagagtaagaatctttagaagaaagagtgctttcatcaaatcatttgagaacgttaagttgaataactgatacggtactaccctacagacatgcgcaggaagtatctgcatttctgtggcgttctgctaaggaaaagaattttctttccagacaagatttttcaaaatcatattttaaaaatatcttaatgatgaatttgaagttgagaaccaacttatttcaagtaaaattaaaattttgagagataagagaatatactttttttaaggttagaactcagaggccattatgacaattaatgggctagtggagacacctggtctctaagaaggagacaccagcttcttcatgttttgatttctgccttgttctcttgtctgtcaccactagacacatactattttatagtaattacttgcatattttgtagaaaaggcagctgtgttttctacaaatatttcacaaatgttagtattgctctatgccaaggaacagaagacaaatttgtggaaaagatacatgtggcccctccccaggtgggatttcttgtgtaggccccatgcagtggagggacagagggggccagtgctcattttgaggacacgatagttcggactgtctgaggaaatcgacagtgtgtgtttaatgaccaaaccaacatggctttgaagaatacatatatatttttttttttgctttttttttttcattgcccaggctggagttcaatggcatgatctcagctcactgcaacctacgcttcccaggttcaaagaattctcctgcctcggacttctgagtagctgggattacaggcatgcaccaccatgccttgctaattttgtatttttagtagagacagggattttctatgttgttcaggctggtctcgagctcccaacctcaggacctcaggtgatctgcccgccttggcctcccaaagtattgggattacaggcgtgagccactgtgcctgaccaagaatatttttcttaatttttctgtaaaactagttgttttagttttcaaagaaagatattttggtagtttttctttaaaatgcatatcatcatacagaaatcattgtccacgtatatggacatatatatctatataaatagattatatctatataaatatatagatatatttgtccatatatatgtccatatatatatatatatatatatatatatatatatatatgatcttttttttgatatagtgtcctagacctggaattcctgtgttaaaaaatgaaaacattttcagtctcttcatatatattgacaaatggctttcagaaaagttgtttcctctattctcttcctaacattgtatgagtttcctttcacatacttttgtcagagtttaattttatcattttcaaaagtgttacttttataaaaactggtatttcttcaatttaccattttgtgattaatttaatttttactgtgttcagggttttatcatatgcttattatttacatttcctttgtgaattgtgttcctatgatttgcacatttatcttttgtgcagctgtgtttaaattttgaatataaagttatatgaaagaggaaatatgtaatttacataaacacacccaaatatatgtgtgtgtgtgtgtgtgtgtgtggtgtgtgtgtgtattctgtgttgaaataaatggtagaaccaggacaacaggtagaggttatgaggttgtcatctgtgacacagtctagaggagaaactgtgtgggcatctatcaacttacctttttgaaagaatcttaactattagtttctggaatattcagagaagacttgtaaggccaacatggactctagtttccatcctcctgagaagacattccattatgaaatctaagtaactttgacagcaaacccttcagtcttatcattttcattagataatctaccaccaacacaatgatccaaaaatgcattatattcttgcactggagttcttcactttttgcttcaccccaaaactgccgctcctaaccacatgcttagctgctaactttcacaccaggcttatgagaacagtattttcagtaagctctcttttcaattcctttcacaatggagctgcagaatctttgagttgaaagaagccttagaggtgactaggatcaatgtatatatatccctcttaccacacacactcactgaatattttctaaaaactacattaagaaaaaaagaaaagcctaatttagtgctgaactgctgaaatattttgaaatttgtggtttcaaaatcttaacactgttaattgaaaccaatgtttctcatgccttttagtctctggactcctttttaaacattcttaaacataaacctaatttttagcataattgtggaatataaagaggttttgtctatgtgggttatatatatttattgtaaaataaactagatagaattttaaaatatttaattatttattaaataataataaatcaatatattaatataaatagcacatattgtatgaaaaacaaccagatattataaaacaaagatttaataggaatagtgtcacttttttgcatttttacaaatcttttaaatgtctgtctgaataatagatagctggattctcatatatgctttaatattctctatctgttgtaatattatataccatatagtttctggaaacattaattttctactaatgagagaatgagagagaagaagaaaaataacttcttagtactgttaggtaaataataatactcataacacttaattaatattattttgaccttgaagaatctttaaaaggttcttggggactatcttgagtctccagaaaacactgagaaccactgatacgccaacaagataaaattcttatccttaccgcagcatggaataggaccatactttcttccttataataatacttcaagtatttgaatgtatttattgtattttcatctatactattattttttaggacaaaatagacttctttaagttttccgtatttgacacattatcttgctcccttccccactacctacctccggttagcctcctctgaatactcttggatttcaatttcatttataatgtgtgatattctggactggacacagcacttcagggacctggtatcttgaatcaacaaagacttgtcttccaaacgatggtgattaagaagccaccatgtccaactggtcagccagtttttatattgtacaaatcagcaatctcagagtcaacctaaccagatttaggcaaggcacttccatgatgtattgatgtattggctattttattaatagtaatatcaataaaaataatcattaagataactgataatattcaggacttcatatgtgctagatgctatgtttaatgcatacatttattcactcttctaattcttaacaactttataatgtatatgtatttcttattcttattttatagataaagaatctgaggcatggaaaatgtaggcaatttatttgagattacagagctaataagaggcagagccaatgtttgatctgaacaacttgattctaggatcattttggctgggaattttctgagagctgtgtgtgtgtgtgtgtgtgtgtgtgtgtgtgtgagagtgtgtgtgtataaacatgagaccatattagtatatacacaaatgtcaatatatattttaaactggaatgttttaatagagtggcttatatgatagaaataagagaaatagaggaggatggaaagggacaaaaaaagggaaaagtaattaggaatattgaaaaacctaaaatgtagttctctccatattctggatactcctgcctttttcttccactttccacacattgaccagtattcctttctcctttcctaaaatagttttacagatactatagatacccttagctatttgacagttatgtttctgttcttttaacatgtctgcttctataactgtcacacttaaatgttttcataggaatcatgaaaactatagtttttcctccaacgtaaggatctcatatcacgctttcattctgaactaaccattccctctctgcagttgatgtaactgtgccatgtgaccattgtacacatgtgggagggaggagctgaattacgcctgacccctggccagagcaagagctactggccaaaggggagattgagcatctgtgttgtacttcccacgtctcttcacctaggaagtgcaatagatttctgacgagtctatgattacccactgatgaataaagacaatctccctgcacaattgcactgcaggcaagactgaacttatgaccaccacttctgtgtaattttgaatttcttagacctgaaccctgctgagtacacctgcttccctctattccttgctgaagttcattcttttcagtgcgttaatggagccaaaccaagctggtggtggtaacaatttgaataataatagtctttaactttttatcttttgaaaaatagaattctcaggagcacttttagctataagattccttcatccaattaaataagctttaagcttcatgaaaagtgtaaaagggcacaggtgcatttgtggaaatagaaggaagcaatcttgagcctgaatacattgaggtactggcaagcttctggaagtagttgaagaagacttcagttagaagcttggtcaaatggacaaagccctgacctggacattggagacctgtagccaccttctgaatccacagctgacctagtggccttgatatataatattgattgcaggatagttttgtgatggttaagattgcaggctttaataactagatttcttggatttaaatcccaactctgccacttactgcttttctctgggaagagtgattaaccgctttgtgcctcagtttccttatctttaaatgaaaataatttgagtgcatacctcacaggtactaaagaataaatgattggaaaataaacattattgaatatatgttagtaattattattttcattgttatgctattattatttttattattaatgtatgacatcatgttacctgcctaacaacagagtattgagacaaaagcaaaatattttttctatattaataatcataataaacaccactaatgtttccaaactatacttttttttaaccctacatgcctttagttcatggaaagaaaagtatgttaaagatgctatgggggtgaagagaatgataaatattattatttaagacaatgtttgctataatttttatatatcaaataagtttatatgttctcagaaaattggtctttgaataattgaggacagtgtgggtttttattctgtttctggaaggcggtgcctgtggctgtgagaaataaggaacagaccatcttcccacatttgagagggaactatacaaaaatgggaaaatatttgttttaaatatcttttggatgtgaattttgtcataattgcaaactgttttggcagcaaaacgaattatttcggtagcaagaagagacttaacgatgctatgtgggagaaaaactaagtccctactatctttctgagagcacgtctcagaggacatgatgtgatcctgtaagtttgtagcaatcttattgtgccccagtgcagacactccttcctacttccctgtagaaaacagaactgtttttttaaaattctttctcaactaccatttttaatagtcatgttacttgatgacaaaatctgatacagtggcctttaatactatatagtgaatgatttttgaaaatttggaaaactctaaccgaaatataccaggaactgctctcctcttcatctcagatgtctacttcctcttcagacctgtgtgtgaagctctagaataggctgtttgggaagactacaaaatctcctctccgaggtcccttataaccctgatagttgctagatttgaaatcaaggatttattctccccctgccctgagcctctcccttatgtccacataggctctagcattggaagaaatattttaagatctctttctttttgactttgtgatactcccatattaaaaatggcttatgacaggaaaaggacaaatatgctatattttttcccttaaggctaatgttctcgggactaccatgaaaaatccaggtatcctaatctggagggttaccctttggatctgaatgggattggagtcagtacaaggggtggggagtgtttttagaacatcccggcagcatttttttttttttttttttttttttttgagacggagtctcgctctgtcgcccaggctggagtgcagtggtgcaatcgcggctcactgcaagctccgcctcccgggttcacgccattctcctgcctcagcctcccgagtaggggggactacaggcgcccgccgccacgcctggctaatttttctttttttttttttgtattcttagtagagacggggtttcaccgccctgctgccttttaaagcaatttaatacatgagttaaatatcatattttaaaaatagattttattttttattataattttgatgaatgcatttttgtcaaagttgtcaaagtcaagaagtcattattgagaccctgagggtaaggcaggagccaagtgagaacaagcagatgtcaaagatggtgaaaaactagaacagccaggtcccccaggcatatacagagaagttttgcaatggcaggtccccgtggttgtctgacccagacttccaccttgaggtaactggggtaactataacgatattttcatcctgatctcttcatgcagttatatgtttccaagaacagataaactgtgaacttaatacaagtgtctcctttccttggattctcaccatctgggtggtaaacatgacagaaacattcaagtatgttcaatgtagtacatggtaacaaatgctttagcacagactagggagcatgtctggcaacatgttggcaaataattaaattggcacattcaggataaaatgagaacatggaaaaacagaatatgattctctttccagccctggaaagacatcccaagtgtacgtattgtttatattatgttattagtatatctttaccagcaaagggcaggtcatcatcattcaatatgctcaaatactcacatttaaagacataggcactttgagaggccaaggggggagaatcacttgagcctaagagttcaagaccggcctgggcaacatggcaaatcccatctctacaaaaaatacaaaaattagctgggtatagtgcctgtggtcccagctacttgagaggctgaggtgaaaagattgtttgagtcgaggaaatggatgctgcagtgagccatggtcacaccactgcactccagcattctagcctgggcaacagagcaagaccctgtctcaaaaaaaaaaaaaaaaaaaagagagatgtagggagcattgtggacatctattcatggagggttaaacaatagaattagacaaccatgtgtatgtgtggaatcatgtgttttttccacacatgtaggaaggagaaggtaggaacaatgaaaagattcttttagtgatcatagtggctccaaaacagatgctttggtatatgtaatacccatttatcttataaagaaaataaagaaataataaaagcatttgctaaccatgttagatgctatagtaaatgtaaaaataaagggtctgttaatctattaactgagcttaatatatgatgtgatataacagcagccttcaaatatgcggagggctataacagagatcatgatgaacagacttttattctggcttagaaagactagacacagaaattaaaggcataaattactctacaagcaaagcaatcttaacataacactcctttcaaggtagactatgaatatttccaccaataatatatttattaaaatagattccttttcatttgtctttttaagttaaacataatcttgcttgaatgaggatgagtataagatacctcagtcatgaccttgtagatcactgcatcagccagctttgtattcagctatcaaacaaaataaaatgtgatcactagtggttcaaatacattggagttctacaactaaagatctaaaggaatgaaatccatgactagtacaaagacataataatgccctaagcaacttacgatattttgatgtttcttttctgacaccccattcgataggcttttgtcttcatgctcagcatctcctatctcatttgggatgctatgcgtccacacctttcatcacattccagcaaaaagaaagggaaggcaaagtggtaatatatttttcctagtgaggttttgcctctttattcagggatggaaaccttccccagaagcttttgtctacacttattggccagaaatttaacatataaccattcattgctgtcagaggtgggaaggagtccctgagaaagaaattattcttgttttccagcctctattgtagcatttaacaaggaagaatgggattatgaatagctttggaatgtttatcatgtcttctagttgccatagctcatagtcattttatatgattgaatctatattaggccttttatctgacaagtttcccaatgtacaaagactgaaaaaaaataattttcctcagatgggaataaagaatgtcaactggtctggccaagtgagtttggaaagctaagatttagccttgggtgcattattgatggacaataaaggagtaggtggcactcatccattcattcagttattctagctgtgctattgaatacttgctaactgcaaagcacagagctagatcctagtaagaatatagaaaagaaagtcacagtctctgccttgaaaacatatttattttatttctaggacaagacatctacacatatacaaactgtcaattcataacatgtcatggaaacataaaagaaggtatcagtgaaagtggagtgtttaaggaaatttccatgcagttgatagaattttaatcctataatttcaataggtagtagctgtgtctcaggcattctaggcagtgcacagcaagagaaaagattgagataaagataaaaactggaaagaagtaggcaatcagtcatatttctgcaaagcaatgttagaaaattgcatgtgttagcttgtatacacaacttagcttacaatgttagcttgtagctaactgaatacagatgtgagagttaaaatatactctcctaacagtagaataatgattgttagagtggcagggatgatcttatagaaataaacattggacaaccagcaaaaacagtgaaagccagccatatggctatctggaggaagagcattccagctactcaaatccaaagtggtatcatggtgtgatgtctttttttttatttttgttttagagacagggtctcactatattccccaggctggtttcaaactcctgagctcctgtgattctcctgcctcagcctcctgagtatagtcacatgccaccatgcccagctaagttatatataaacataagcacagagtaacatggtagcaaaaaataatgtcacccaaattagggttttgaagacaatacaggagttagatagataaagaagagagggaagggcataacacaaaggaacaggaagtattaaaatgtgcgtgttatggacttgcatacaaattgagtgctttaattttgccaagcatctttcataacactataaggaattaacagtatgagatagcataagtaagggggcctgagaacttacataaacacccttggtacatggaaagtaaatataaaatggtgctgataattctaattacatagtttatagaaaagatacatgaccaagcttgaagcaagaatgattgataaggaattaggtaggttctgtataaggaaaggtgatttcagatcccaaaagggcatggctgaatgtttagcctttcagagttggggaatccatttcttcctgtggaaggattagtctttaggtgaatagatatgtatcgaagggaaattaagagagcataagaaaaccccactttacctgccatctatccatggaagcagcaataagaccacctgagagctatggtacaattaaattgaagatatttgaacacataaagtaggtgtaatgtaacatataggctcaaacatttgaaagtgatgatatttggtcattgctggcctacaaaagaaatgattttatgtgattcagtctaatggtaatagttacaaaggattgacttcttcgcaaataaaatggttgaaatagtacccaaaactagcagattgggcaaaaattacaaagaaatatctaagtggttgcatagtaaccacaaaaatgaacacacttattttcagagttcaaaccgtggtagatttgagagtatgtttggaaatgactaatgcttagtgttgtttaccctgtcaccacattcctgcataaggctctttatctctgactggtcatgctcacatctgttttctgccagccttttctggtgcccgcaggcacccacctgcacccaatgtcctccttttatgctttctggcctcctttcatgtactgtgtggtccaccatactacctaatctgctatatactcacaaaactatttacttcttttgaaaaaaatgtattattagatttaaatatatgtatttatatttcccttcactttttaaagttttcactttatttttatactatgttttaagcttccctaatatcccactgctgaatcccaccgacatggaatccacggcatggtgaatccctgacttacccattcctactagaagtagagccagaatctaatccagacctcctgccagccactcccagaccccttctttcccccaaagaaaatgaagaacatattttttgtgcaaagagatacaatcaggaaatttttttaaaatcagcttttattttaactgaatagcttacttagtcctggggctgtaaagtcaactgaatgatggagtcatttttttcaaaatgcgacatcttcttacccacttctcttattactctcatcattatgaaaatcacatttgtgaaaggaaatgaatttatatcaggttttctttggcatcacccaaaggaccttagtaaagaaaattaatactaattttattttctattgtgagcaccttaatacggaactgtaagaataattactatttttaatgccaaatgaagcatgtaagtattactagcttcttttttgtattaacttctatacttatctcaggagtttttatagtgatatagacattttgtgaaatagatcatgagtgaaacatagacctggtatagcttgactggggcctactttacagatttgtccttaagtactgaatataaatgtttctgcttcttattttccttagcatttttaaagaaagtcctggaagccaaaaatctccatgatgaaatatttataattattaatcactgttatatgaccttattatgtatgaaaactatattcaacatcctaaatatgaaatgtgattagttctgattttaaagatttgtgataaaacaagacaccattgatgaaatacatagaaaaaggaagacaaaatagcttgggacacattaataacttacacaaaaaattttaaaaattaaatcttctaatagatttgatatataatataccccagaaatatttacattatattttcaaagtctagagcatttcttccatagactccaaaactatttgtatatattatcatcgaaacacaattttgagagaagttggaatggcagtgcagttagcagataaaaaaaatacccacttttctttacaagtctctatctaattcatactccctattgctctttcctgcttcacaaacttcttaaaagattttttcatgtggtgtgaatatttaaaatctgtcttagcaattttcaaatatacaatatagctggccatctgtatttgtgggttttgcatcctctgattcagccaaccatggattgaaaatattaggaaaaaatgacgaaatacaacaatacatcataaaaataatacaacttaaaagacaatacagtataacaactatttacatagcatttattttgcattaagtattataagtaatctaaagatgatttaaggtatatgggaaaatatacttaggtgatgtacaaaaactttaatcatttcatagtgtatacatatatcaaaatgtcacattgtaccttataaatactcataatcatttgtcaattaaaaataatttaaattttttgaaatgtaaaaaaaaaaaatttttctagcctcccagtctacactctcacttttcactaacccatttactgctttcttgcttgttctcccagcacaccacaaaaacaacttccatgcatacaccagtatcacccccctcacccccctgtttccaataaattaaacccaatggaccaagctaaagcatttattatacttcacctctcagaggcatttaacgctattgacaacttccttcttttcaaaaccctgtcctcccctaattttcatgaaacatgaaactaccttctagttctcttatttatctcagccatctggctcctctttctctattcccttgttacctattggtgttggtatgtattccattctagaactttgtctcctctactgtgatgctatcatttagggtgaaatcaactactcccattgcttaatttgtcttttataaatttgtgacttctacatctatagctccagttctgctgtcttttttgtattaaagaccaatttctccaactatgcactagacacttccaactagtatcccactggtatctcaaattcaacattattgaactcaaaaacttcttttgttaacttgccttgctgtcatatttcctgtattggtgaattatatcagcttccatagacttgcctgagccaatataacctaggacatattctccttttcccttaactcagcattgactgacaaagaacatgctaggaagtctgtattcttcatgtcttaaaatattcacctctgcttccattgccacagctttgatttgggccactcacatttctgcagtagtctctgagattgttatcatccatatctctgcatttttcttgctaatgagaccttcattaaaattattttgtaagtatttaattatttagcagttcatgcctttccatatgacttaaaattccattgggttttgcttttttcctgtaacctaaagttacatctgggttggtcaaagtgaagcatagtaactacattccctttgatagtgctgcaattaagaccaatgaaatgtgaaggagttttagggaagctttttcctcagtcttaaaaagagacaaaaggaaacaatacccctctcctgtctctggttcatatttgatgagaatgtggcacctagtctttttgagaccagtggggtagttaggcccacaccctgtggatgtcagagcaaaaatatggaaggaatctgggtcctgataccatcatcaaaccattgagctaattccgttttgtaagataataaattccttactgtttactctgttcgagttccttttttttctgttagttgtagctgaaaccattttaactgttgttttttgtttggtttggttttgtttaatacggagtcttgctctgttgcccaggctggagtgcagaggcgccatctgggctccctgcaacctccacctccagggttcaagcgactctcctgtctcagtctcccaagtagctgggattacaggtgcacgccaccatgcccagctattttttttttttttgtatttttttgcatttttagtagagatggggtttcaccatgttggccaggctagtctagaattcctgatctctggtgatctaccaatcttggctacccaaagtgctgggattacaacccactgtgcccagcaccattttaactgtattctaaaagcattttacagcctgctaatacataacctcatctccaaccttgcttcctaagttccactctgtgttccacaaatgggattaatcacctactgaaagctctataataattcctgtcacctgaggatattgttaaaacttctcagtttgtagaagagggccttcattatcagcatcacatttattttccagaaagatatctagcacccctctaccttacatcttgcttttcagccaggaagaacaactttttctttctgaaatgtactagaatctcagtgttgggccacattgcttttttttttctaaaagactaatcgtcttcctttcccacctaactcaaacatatccctcttaacttagacattacttattttggggaagtcttccatgattaccctaagaatagggtaggcattctttctctctgcttccatagaaagtaggaaactattgcacttactcattgtaatgtggctatattttgatcaaaataattaaaaaatactgtgtggattcaaatttttctcagctactcacaagctgaatgatctcacacaagttatttattgcaccttattgtgctttctttttctctgaaatagaggtaataattatacatacttcatattattacaatgattcaggaagctaatgtatatggtatacttacatatatatatgacctagtataacgcatgatacataataagtgctgtgtacatgctcagtcaaataatggtcatttgaaaacatttattgagtaaatgaagaggaaagtgtttattttcaatacattcaaagatattgttttggttatttccattacagaggcataatcagtttactattcagaaaaatgcaagagtacatttttactgctcctccagtgatactatggaaaacaatgttttagaaaaataaagaaggtgtgaataatgattaaagaatcatacactctcaaagtgaaacaatttcccaagaaatgcggtagaataagccttttggtttctgattttttttcttaactttgcttgtatgttgtagaaagctaatctaaatttaagaaattgaaattttgaagtattaataatgtacttctctcccaaaattgttttaatgtaatgatttttgccatatggatgaattatatatgcatctagaggctaaaaaccataaaaacaagcttcttcttagtagacttttgttgtttattttgtacagcataaagcagcagtcaaaaagttttccaaacaaattatcttatgtattttgactaaacccagatttatcttcttaaaatgaagacctttgttgtagttgcatttgttcctcatatgcagtagaatgacccagcctctttggcttagaggtagtgcctcctttttacgacacttggagcggcatctgatgctcatcacttcagttggataaggaatgctgtccagtcacagagactcatgagatcatgtccaatgaaggcatttaacaataaattcacaactagtgagtgagaattttataaagcagtttcaagtattaagtagataggtaggtaagctttattatattttttaaatgtgaaattttacaattgtgaaaatttacaattttacaattttacaatgtcaggatggataacattgcctttttagtaatggtagccttcactatctgcattatgactgtacaataataacatataataatatatatagcatatatattttatatatataacataatatataacatatataataacatataattataacataataactggggctatgattgcaaacatttataagatgtggtatgaaaatgtcccaatcacaaaaacactcaatttaaaaatgaaagaaaatgaatctatgctatgctttgcttcatctttctctgaactagttacaaacaaaccttttaaaaataagctttcaatttgggaataattttagatttacagaaaagttgcaaagatagtaaggaaagtccccatttgctcttcatttggcttcctctaatattaacatttgccaaggttacatttgttaaaactaagaagtaaccatgggtacaatgctattaaccaaattacagctttcatttgaattttgcccatttttccaatattgttcttttcctgctacagcatccaatctaggacctcatgttgcatttatttcttatgcatctttagtcccctaggatttgtgacggttttctgtcttttttcttttgaagactgttcattgcctctgttagtttaatgatcctctgagatgttattcacagtaaaatagcatgtgaatttcacctaactaaaaagtttatttgatccaaagccctgattttaagaatttgaaagaaaaaaatgactctatttttcccagttctaaacattttactagaataataattgtattctttcaacatggaattaatgttgatgagaagcaaacatctaaatttaaaagaaaatatagtttgttgagggaggtaatagacaataaaatgtatttattatagaaaaaattcccaaaactttctcattaaatgtgctttatctttacttcattactaatatttagcttttattcttttaaaaagcatatgccaatgataatatctcattaataataagaatccatctaattttagcttgatcttccccctgactaggtttgattggattaaatcatcataaagagacaaaataatgcaaaaagtgataaatctataagcctcccctaaggtttcccatagaatgatcaacccaaatgtgctctttattttatgccatgaaatgacatactgtgtcaagaactgaatttcatcatacatgagacgtaagactatttttatatctctgtaaattgggtatgaattataaaagtatgctggtaaactgatcacttgagaacataaagtcaactttccctggaagagtttctcattataaaagaaaggcaagcatcttcttcctaatatctagctttatcaggtcaggggctatattctcggaagggataagtaatttctgttgtatctactaatttcatttaaaaagataactagagaatattggaagcattattgtagaactgtgtcaaagaccgaaatatcattcctaccttagactgtacctcaagatcgaagctctggatgctatctggaattaaaatgtttgcattaagtttaaaactcagtaaaataaatgtttgaaatgaaaaccagaccaataatgaataattttacttagacctactctccaaatgtgctaaaagacttgtaaaagttgttgttgttttaataactaagtcaagccagttttatttaattcaatacatggagtattaatgcgctgtatgaatgccgaaggtagtattggacgccacaatctttaggaaccatgcttctgagttttaaaatggtgactagtttagcatagattcaacataagcattaggtgttcttttgacatttgggaatcagccaatcaacaggaggaatagtaaattgaatacgaacttgaaagagaccatgtctttttttcatccaactgtgaaaaactttctttgtacaattgttaaacttaagaaacagatggtagatctgtatcagtcagtgaggggtttctgaagtacttttctggatgaatgccaagaaaatgggtttctgagacttgcatggctctggatttgttctgagctgtttagtgaagtgagggctggcattcagaacccaggggagggggagtagtcattcccattgccttgcatagagatagaatcacaggtgacaggtcattggaaaatcacttcttgagagtgggtatctttattttgagttggtatctttttgagagttggccactcataagccttgcttttgataacatttctttaaattcctccaaggaacaaggggaagtgcaaaaggaatacgataaagtgcagcattgaatgagataagcatattcaacttaaggggcacactaaatactgtaatctgggagcataactcagatttcttttcttctttgctcagtataagttgcatgatcatagaagatttatgtagaagtcagaaatcaaggtcaagagggtaggcatatttagattcttaccctattcataattaacaataaaataagattttgtgtcctgattcagagaatggatggctcagtccttataacctcttaaattagttttatctataactggatttctgaatctcttttgaaaattactaccattgatggtcactgagtgaaaaaagcagaaggatagactggtgttaactgtaatgaacatttatccaacattacccgtgggcctgctatccattttaaattctaaaagcactttacagcttgctaatacatagcctcatctccaaccttgcattcctaagttccactctgcattccacaaatgggattaatcacctactgaaagctctataataattcctgtcacctggggataatgttaaaacttctcagtttgtgagagagggccttcattatcagtgtcacatttattttccagaaagatttctagcacccctctaccttacatcttgcttttcagccaggaagaacaacttttactttctgaaatgtactagattctcaatgttgggccacattgctattttttttttttctaaaagactcatcatcttcctttcctacctaactcaaacatatccctcttaacttagacattacttattttgggggagtcttccatgattaccctaagaatagggtaagcattcttcctccctgcttccatagaaagtaggaaactattgcacttacacattgtaatgtggctatagtatgatcaaaataattaaatctaaacaatactgtgtggattcaaatttttctcagctactcacaagctgctatccattttaccaagcctcctgcatgtattactatgtctaatcctcatatcaactcatatataaactagattttatgattatggctctaaaaacaaggagactaaacctcggaaatatcatttaacctgtacaagaccttacttggctgagctaggattcaaaactaggtcattccgaggagaatataaagtccagcttttttttttccacacagggatgtatatttccaggtacagttttacattttgttctttattgtatgaacataaatatagatacatatgaaaattcgaaagcacatgaaagtgccaagaggaaatgcaataccatcttatgaaatgagaaattacacatatcttacagtgagtttcaaaattatattgctcaaagtatttttactgtggaaccataggcacaaactatagcaagagtaaatccaaaaatgtttattgttcttctataaactaactactgtgtaggatacaagggatgctgatttcaccagtgcctttaagaaggacaaatcaaattaaaaagtcaaaatgactgaaggtgataatccagatggtggtaacaataatgactaccatttatagaactttttgatgttgttcactcaacgtttctatttttattcaattataagcaaacagcagaattaacccaacattcagcaactccagatcagcttttcttacccccatgaagagctatcaatttaacaaccacagttgtaaggattcttaataagctgtcaatgagcactgctgccggtctagatggccatgccccaacaaaagcaaagccactctccctaatgctttttccaggattgctttttaaaggcaccagagcgagatactgacgcctattaaggcatctgagatgcaccgtgttggggtttagcctccatgccagccagcctctggttgtctaggtgagcgacagcaccataaaaacacgctgcgtacaattctggtattaggatcacaaaggcagagaggtgacaaatcctttttctttttctttttttttttgtaacctcccttaaagattctttgatgctttgctctattactgtgggcctggtctttttttcccccccagttttttcttctttaaactctggattgctattttcatattaatttgatgaccccatcacagtaccagaatattcctgaaaatagagttccaatttgatcaaaacataaaccagagtgagtgagtgagtgactagaattataaaggccaggcagcaggaaaagttaccctaaaccatctgactgctcaggtcttgcatgtgcaaaggggagccggaagaggagaaatctattatacatgcaacactgaactggagaacacggcttggggcctctgggacagttcaggtccctgagctgccccctacttcccagacagctgctcctgcagtttgggcacatagtcgtcccactcagcctggtaacgctttctggccactggggccacgagcacgagctcgtacttttttttttttttttttgagacggagtctcgccttgtcgccaggctggagtgcagtggcctgatctcgcctcactgcaacctctgcctcccgggttcaagcaattctcctgcttcagcctcccgagtagctgggactaaagccgtgccaccacgcccagctattttttttttttttttttttgtatttttgtatttttagtagagacggggttttaccatgttggccagcatggtcttgatttcctgacctcgtgatccacccgcccccgtgatccacccgccccagcctcccaaagtgctgggattacaggagtgagccaccttgcccggccaagctcgaacttttgacagaaggatgccattttgaatttgccactgtggcctccagatccattgctgaggatgggctcgtcacacttcagcagcctgtcctgtttgtaaaccagccagacatagcggtggagatctgtgccctccggaggcccgagcccacgtaatggagatgactgggccactgctaacgtcattacccttcatgttgaccaccaggaaatgacgccattcagtgtattggggcttcttcctgccgggagcgtccgggtctgttaggaccaaggtgtagagtttccttgactcaagatcatcccatgaaatgctggtgggtctgttaacctaggtgggcgtcagcactttgcccagctcgtccaccgtcgccctggcgtaggcgacatgcagcgagtgctgcggctgcccgtccacttcctgcaggctcaagggcctggaccgcttgctgaggtccctggcatggctgtgcaagaacgcagcgcgcagctgggagtgccactaggcaaggcgcaggcgcagcggcgactcggcagcctctgaaaactagccagggaagccggggctcatttataggattttaaaaatattattaaaggcttcacaaactgtcttgtttaatagccacaacattgggaggccgaggcaggcggattacctaaggacggagttcgagaccagcctggacaacatggtgaagccccgtctctactgaaaatacaaatattagccgggtgtagtggcgcatgtttgtaatcccatatactcaggaggctgaggcaggagaaccgcgtgaacccggcaggcggaggttgcagtgagctgagatagtgccacggcactccagcctgggccacagagcaaaactctctcagaaaaaaaaaaaaaaatagatacaacaatctccttttaactgaagaggaatgatgtaaagttatataaagttcagaggaattgatgtaaagtgaatcgtaaagactttggaatctcctactaaaatattttaacaggaaagagacacatcagtgcattttacaagcagatcaatgtggcggtatctagcatgcatggggaagggatggaggaagttgtcagtttagaaactgagtataaacattattgaaataggacatgataagtacctggaccagggtaaaggcaatggaaaggaaaaggaagccacagaccacagataggaggaattcaaggactgtgtaccgaaattcaggagaatgatgtgaaatagatgctctgaatcctctattcccaggaggcagcattatggagttaggagaaaatgcaggagctttggattctagtagacctgggattgagtttttacactgttactctatattcgaagcaatatatttaaaccagctgtgtcttccttttgtcctttataaaacaagaataataatgcttatcacatagagatattatgaggattgtataagacaatgtatcaaatagtaggtattcggtaaatgttccttctttactaaagatagagaaaccattttctgatgtacaaagggatgaagagctggcccaatatgaattttcccaaagaagttaaatgaaaaggatctcatgatccttttcaggatttattatttacgaatgttaatatattattttaatattttctatcttatgaaataattatttggtcaaaacataagacaattgataggaatatacagcatggaaaatggttaccaactagagctgcagggtatcagggaatgtgacaaggcagcaaaatgtttctacacatgtctgttttttcaggcattatctttcttgagactatcaagtgtgtatttaaggagccattcaacttacttcagtgcatttgcttgcaaagggtgcaatgtgatgtttcctactggtagggtcgtatttcatatgtggtgatagtgttgctgaacaaataggaaatatccttgcctagactatattttatcatttcattatctagtggtaaaggaatgtgagttctatttacaaataaacattttgtcttacttttttctttgtgatctattttctccaagttgcataatgtaatgaattaataaagcttagttgctggccaaatcaatggtgactttttatgtttttaaatataatattaggtttaacttatttttgtcattaaaatatcatttgtgagtgcttttcaaaatgaagtgcttctgaaataaatcacataataaaactaaccttacttttgaaatacatttttattgaagcaaacacaaatcaatctgaaattcagcattttgtagcagttaaatgtatagtcaggcagcttcaacgtcaactagagaagttgtggttttaaccccgagatagggctgattatgctggtgctatggcaacctattgcaccatttggtagcgcctgtgtgcttaaccgcatgagctgcgcctcttcctttcctataaagactcagaataagaaaaacagaagtacaccgaagagaagaaaccacaagagcagtaaagacactgctgttagcttttagctgtgcaaacagcagtcttatgagaacaacacattgaaaacctcttctatttgaaagtgtagcttttcccattatgcctgggttcctttaatgattttgaaagtaagccaagtgtttctgttcagagttttcattaaagggaaataagaagaaataagcagtgcatttatcagcctttgcttttattgtcctcagctttaggagtgggaggcttttgtgcagcctcagcagacattttattctgtttgtgagatgggagattagtttctattaggtggactccctataatctagcatttattttctgcttttttttattatattgtagttagttcacaaaaaaaagtacaattttaattcatctcctggctcatttagaaagggttgtggttggtgctgtaaacacgtttctacataactagattaaattcacagacactcactgtcctagcactgtttattttctatggggagcttcatttacctattctttccctcaccccacttcttttacaaggtataggttgatcagcaaaggcttttgtatgttttcctttgtttcaaagtacagacataatataatcataacttttttttgcatgttctactatttttccttccttaaagatttgggtaaaaatactgaaggacagacaagttcatgctaccatttttgttaggcataggcctgttcacttttcttcccatttttctgaaaaataagaatctaccccttttgtagtcattgtccagcaatttacactttttaacaataagttttaatgtgtggtactctgaatcccattttgatggttatacataatatttactcatttttgagtccctaatagctctttagcacaaatactggatttagcattaaatattttttccttacagtgcaatgcagttgaacaagcatgggggtttttacagtcagacagatctgcatttaaatctagactcattttgctacaagttctttatttagccttgcatacacgtttttatgattttgagctttcatctgtgaaaagaagagaataccatctactttgtaggatttctataatgattagataaaataatatgtaacagtatttaggacagtgccattcacatagtacccgcttattaaatagtaaacactgttgatagcaccaaatacactaataaaagatttcaccacttatgcaaacatcttttgatgattctttgttctttaatgatgatcgtaacctatcctagaggaagcaaagagctacaaaaacatacacttactaagggattaatataattaaatggtttttgctatctgaagtatattgcataaatcaggtatatatccctggatttaggtaaatgaaaacagacattttcataagaagcaaaaagataattaatatgggaacaaacctattctggaaaatgtttaaaaagagaatatgggtaaggaagcatctttctcagttgttcttaacccttgtttccatcataatcaccatcagagctttaagaaaataccagtgcacagatcacgttaccccacaaacctactaaatcagattttccagcgctggagcccagaaatagtcacctttaatctaattcccagtcaggattaatacaaataaaggattgatattttttcttcctcaggataataatactggttacacacacataaatatacataactgataacaagccagaattttgtaaactatgttctcagaaacattgcagttacattgtacaaatgtcctatagtatgtccatgggaaaaaaatgggtttgtggcaaatacttttaggagatcttgagctaaacgaagtgacataagtttctatgcttttaatatattaacacactttataaatatctcaaaagggcatgtagcatgaattacttctgaaacaaatttgactatgggacatttaaaggcacacaaatctaaatcaaagacttcaatttgaccatcattgcacaggaagcgataaaattttccccctgacttgtagataaatagtttaagacagaaaaaaagcagtgtaactgattgttcttaaatggttatctagtagcctttattaatttttttgtcattaattgtttcgttaatcaacatgcctgaaatatataacatgatgttttaaaccaaatataaaatacctacaaatgcattcctagttttgaggtgtgtgtttgcaaagtcatatgtattcacaagcaaaaaacattattgtaaatattggacaccataagtcattgggagacagctagatatggttgctatctttaaaattttttaattatttgattttattcctctcatggccacaaaaatttgccttctttatcctcaatactgctttacatactgatatttttctttattatttgcattattatttaaaagtgtgtatataatttgaaagtttaaatagtaccataaggcctagagtaagtaagaacagtcttttgctcccacgactctcccctcccttgatattttgtgatttttaaatgttatcttttattgtagtgctgtttctttaaaacaaaaaaaaagatttttgccagtatctattgacttcttctcttgatcttgagatgttgctttttataacctcttgctctttgttcatgggtgcaatgttttctcatttctgaaaatatgaattgtagttggttatcctctcttttgctccttgcattgcctcattctcccaagtgcctcttttgtttatttgagctctatctttctttcttattagaggctttgttctagtgtttcttggatgtccatttgtatttaataaaaggcctcaataaagggatgttgaaattctttggacattggtggagctcataaattcatgtgctttaactagattgaatgaaatcagaaaggcactacactcactgagtcttagtttccttatatatcaaatgaactgcatgtcaataatcactaaaatcctttgcttctgtctgagtagaaatctttggaattattttctgatgataagcagaaagtcctttactcatgagattccaaaaataatattaatatacccaatattttaacataacgtctacataaagaataagaaaattattaaatagacactatttcaaatctagcactttcctcgtgtgtgcctgtgagcaatttactaaactcttttaggtcccagtttcattccctataaaaaaggataaataatgctaactcattggcttactgggatgcttaaaagaaaaaaaatacatatatattatataaagaggtgtgcatagtgtctgctacataacatttcagtaaactgttgccatcattattatatttactgataagctaatggagggtagaaaagactgtttcctgtggttctctgaaatcataatacctggcttgtcgctgcccagagtgcttactccataaatacttaataatttaatatgatttgttagatttattgtctgtggaccatatagcagatttctagcataaaaaaagtgcaattctcttatttttattgtgcactttattattatcatgcattgctaagaaaggaaagccatacatatctgttttagctgacccttattttttgtcttgatttgcttttttccacttttgtacaggctttatgtttatggaggtcaagtatgcattctcaaccttcaaaacatgctatcattcattttagggcagatgctgagaataagtatttatttaatctattctattttacccttctgcccttgtacttttcccagatttgcagaactagacaggtttaaattccctaggaaatagcatcccatttttttttcttttttttttagcggggagggagaacgggtgatatttaaagcccaagtatgtcttttgaaatgccgttttcactcaaattgattcctagtttttgctgaaatctctgatcagggacttaggggtgtgacttcaaggtaactttgatttgtgatcatttaaacattttgagttgtaaaagaaacatattgggaaaggtaaattcagtaacaatacatgtgttagaataacacagctttgaagatcaagtgttctgttatctacattttcatctgtttaatgtatctagtcaattccattggtgattcacaacaggattataatgggaaaaagagctcttagataatttacagttttttagtgctatggtgccacctactgaaatattactaaatactcctttgactaaataatgaaaacacaagacatttaagttttaaaaaatgtagaaaatttcatccctagaagataaaagtcaaagtgtagaatgtagtaactgtaatatgtggaacactagatatattactgtgttttattttatatttatttgatgtgtttatagaatttgagagaaagctcaatgcagttcttactttgagaaatagtgatgccttctctttattgtcacacacctacacatgtgccctcttaatttccattgctatgtcacatattttgctttacctattttccacactttcccagtattgttcataaagaatgtttacatatattgtagtgtaatttgtattaaacaatctccaaatattaaatatttattgtgcactggttataaaatactttatgcaaaaattttgtttgcttttcccagatctatttgactccactaagaatatattgttgcttttaagtaatacaggaaatagggtagagtacaaggctgtctacatacataaaacaacttaggtaactacatcagttcatttgttttgcattggacaagcacagtaatatttaaccatatactccagtctaaatggataggtcatgaagtagttaaatatgttatacaaccaatcttttgttgttgttgttgttgttgttgtttttgagtcagggtctcaccctgtcacccaggctggagtacagtggcaccatcacatctcactacagcctcaacacacactcatgggcgtagcctcccaagtagctgggactataggtgtgcaccaccctacccggataatttttgtattttaagtagagacgaggttttgcatgtttcccagactggattgcttggttcaagcgatccagctgcctctccctcccaaagttctgggattacaggtgtgaaccattgcacctggccacaaccaatctcatcaggtcttttttttctatcagtgaagattcagcacagtggcttctatctatgattttggtaatgtttaataatgtttgcacatatgaagtgcaacagacaattgaagtcattgctcatgtaatttaggaagaattaaaatatgatagagaattaataaattattgcagatatttggttttatagttttctctaaatagttaagtaccttcacctactccctaccttgtttcatatataaaggcattctccaccaaagtatttgttagtgttctgctaacgttgatgtaaaaatcattagatgactgggggggcggggtgtggggaatgtcctttagatgttacgtaggtgttttaactaagctattttatataggtcacatttagcgtgttcctactttaagactggtaaaatgtttaacattaaaaagactgaaaaatagatttatgtaatctagtgcacatggcttattaaaattgatatgttgctttaagttgcatcactctagtgcataccttatttccttaggggcattggcttaaattttaaagtagtttttaatttaaaatttttattttaaatagattctatgtgtttttttcaggcacgaaaacatttttatgtcatttatcatgttgactaaaagtgttaccaaaactaaaaatctgtttatagggattttatgaccatgagaacaagcaagttgagtcttacactaagtctaaacagtgatgctgaagtcttggaattttcttttaaaaagataaaatggtgtgtggggtgtgtgtgtgtgtgtgtgtctgtgtgtgtgtgcacgcacatatttgaaatagtatataaaaatgaaataaaacatagattacaatgttttagtgtcacctaaaaatcactcagtggaggaatttagaatcatatccagtgataaatcagtgtacaagcaaacacatattcaattcaagaggcctttatgggaagtaagcatgaacatagaagaaaggaaaatgttggctctttagatattatactgttttccaggatattaaattttgctgcattaaagatgaaaagattcgaggaaattttgaatatggagcgatgatgagatcagaaaaaaatgtatatgtatgcccattattctgtcctctagctccagaaacctcttaacatctaaacaaaaggtctgtaaattttaataattgtgcttgatattagtgtagtttggttgactttcctgtcaaaatagtattctgtaataaattaacttgacacacctctaaattttctctaatatttgtttgtaccattatagagcattcactcagcacattgtgatttaatctgcatatctatttttagggtcaaggttattttagcatttgtagcactactagtaatttacttgcagccaaattatgattaagatgcatttttacttagctcatgagtttttaataaacaccttctgtaaaagaattctcatgcttaaaatttcatatgaagaggaaaggctgtaaggacaagttgatgggaaaaggggacgcctgatgaatgagagcatggcctgtaaagtcagacaggctcaggttcaagtctggctcacatatactagactggccttgtgaacttggccaagacacttgacttttctaagcttcttagggtttttgtggtgcttaagaaagaaaacataagcaaaagacttagtatagtgcctggcacccagtaaacactcaataaatattaacaattaataacaataaaatattatttctaaattattctttaaaaaagtaaatcattagaaacagtcttctccgttttggtaatttacctcttgtccttcttttcagaagttagattaaaataatatacatcatgtatttcttttaaaaaacgtattgcctttggaccacttggaagtttattaatctctctgagacatggaacatatacgtagtctgatgaatagtgtactggttggaaacagttctagtatatttactcaggcattcacagttcttttgttaaaaaacaaatagcttcacatagtgtcccagcatttttcttctcatttctgtggtaaacagatgatgaattataattttcttttatgaaactctatctatagttggtgctacacattttggtgacaacaaagtagtaaatcagaacaacagaatataggggtctgtggaattagtggtgcaggtaacattaagatttctcttttctctgtcatcaaatttgctttctgatttctcctctgtattaactgatccaatggcttccgtcattctgaggaaaaagttcaagctccttttcaaggcctacagtgcttgctccttggctcttctcctaaagctgttatcatcagatctgtttgatttctcctttgcacttactcatgcttaaaagaatccagcaattacttatcaatcacttcttatacacaagactctttgctacagctatttctctttcttctcctcctcttcctcatcttattatgtgattcatgctgatgttgatgcgagaaattttgattattagtcttaatcaggtgtatccatgactaaaatgtcattgcagatgactagatatatgtgttttatgggttataagcttatccagggcaagggtcatgcttttatcatgtttgaacctagtctccaacagcataccagcaaaacaatgtatgtttcttgaacctaagtgaactaaattaacttgtttcaagttccaaggaatgaggtgcttgcatgagaaggggcatatcaacctaattttagatatgtaagagctcatgtatttctcagataaagaagagatatgtgttgtataaagtatgttcacacactcaaaaacaatttgaatattttaaatttggtgatatgttttgttcttcacaaacaatgaaggacacttttcctttcacttcaaacatgagagctattagttattgctatactaatatttttttcttattacctcttttgcaaatcaacacaattctaagactgtaatttacaaggaaataagaacaaataaggagagcggaatgctgttaatgggaacataaacataacaatagtttacatgaaacagaaagataaaagctaactagataagaaaagggacaaaagtacaaacaatatcaattaaaaacaatatttaagtatgaattattaagaaaaagagaaatgtaatgagaaaacaagaaagtcattatgttaataattatgtatcacccatcaatgatataaaaatatatatatcaaaaatgcattttacttcaaggaataagccagggaatgtcattgaagaatacggggtgatgctccttggatggcaactctgaaggaagaaaatgttttcacatcagtttgttctcagaagataaaatataaaggcagaaagtcaccttaagtaccagctaattcactttcccatctgatctctgattctctttaacaacctgagtttacagtcatttggaaaagaactttacaatcttttaaataggcatttactaagatgagggatgaaaacattgcacttcactgtagactgaatctagttcccatcatgccaagaaagctgctcttttcaacatttccacaaacccagatgataaatccagttgacccatgttaatgcaccatgtttatcctgcatgtgaatccccatattatttgacttcaaccatttccttctcgaaacaccctctactctttattcttgtttgctacagttttcctcttacttggaaaatttgattacctatgctggctctctccttaatattcactgaacttcaggattctatcctggacacttctcttttatgtagttcggtgatctccttcacctctgtagctgcaaaatgtatctatatgctgatctatagcatcagcccagatgtatgtcatgagctacaaacctctatattcaaatgctattatacattttcacatgaaatctcaagcaaattctgattcacctctctactcactgtttattactctcaagttcagtgaaactataactcactagcatgttaaactatcaatctagatattttccttattactctttctcctttattctcacttgaaaggatttacaaagtcttggtgattcttgagtgtttcataggtccttttcccccaacctttcttttggggtatactcttcctacgtaggacatcatctctgtctgttttgctttggttttggtctcctgattttcctgcccccacctttgctctttaataatccattttccatttcctgaaaggttgatctaaaattcaaatgtttctcctttaggcctccctttaaagacatccctttaatggatatctaaagcctgtaagataaatcccagcttcttattcttctgggaccaagctagctatatgcaatcctttaggttgtagcttaaatacatccaagaaaccctctgtatcaactcctttaccagccaaccaccaactctggaaatataaataagatgatcctgttatgttctcctttagcacattctgtatcacctgtcatcacactgtattgattgattgtttttgtttatatctcacactaaattgagctcattgagggcagggaatttttatatgttggtcatattatatccctagcatgtggcataatgtctagcacaaaataggtgctcaattaatcatcattatctaaataaataatgcatttgggaaaaaaaagtttcaaaagtttttcaaaagtcttttgcaggcttgaaattaatcccaatagtgatcctttagtctgttatgtttctgatttagcctggggattcaaaaaataaataacataattttgatatatttgggctttgtaaacatggtactaagagaggaaatatagtttcattagggtaaaagctactgaaaattgccacttggtgaatgttctatcatagacttgaggtacatataaaaatctaatatatgtttacattaatatgaatgaaatttgaaattttctaagagatttttgtttcttctttgcagggcaaagcccaacaccttcccccactggtaagaattaatatttatatttttactaattttattttcttgttgcaaagtttatatatttaactacaattttctattattaacactgaaattatttttaaggataaattttataatcatgagtgattcttgacattcacttgttcttaaactttctgcttatacgttatagagtttaataactacctaaacatgttattaaatttgtatatatattttgtgtataaatagtaacttttcccaaacttgacagtaaatcacacaacaggtttctactctcttttaatattttaagactataaaaaaatgcatttaaattagataacaaaattttatagtctgaaagcaggttaacagctgtctatgtatgttatagatatgtagataacagatttgcatatgtctatatttctttaagagtatgttgcttttttcaatggtatgcaaaacctttgagactattgagatatttttaaataataattttcaaattctactgaacacttcaatagtccttataaatgtcttaatcatgagataaatttaaaacacagagatgctgcaaataaattcatacatagtacatacaaaataagagaaaaaattaaattgcagatggttaaatatcacatcacttaactgatgttactgaaaatgtattttcctgcataatcatatggttgacagtatgcattaagaaggtaagtaaaacaatgaagacaattttgatttaatatggtaatgcacaattccaactaacgtacattcaacagatcatgaaattgggttattaaaatgaatatttttgtcattaaataaaaattccgtccaaatgaagaaaacaaataaccatgaaaatagtaacaaaaacacttctgaatctgcataagaactatatttccttatttttaaagaaggtctaacacaattttacagcgtttagcatggcagtgatgttttataaataaataaaagtcattcttgcatagtagattgtgattggtttatgccagctactcaaatgcaacttagtatctccaacttttacagaagatagattcatctcaaccataccagatggttatttttgcaggaaagggataggtataaggtagaatggggagtgattctttaaaatgacacatgactcatcaccttattgagggagtttctgttatctctgaattgactctattatgacaagcctccaagtgatgaaaccaggtaagttaaaactgttaaccaaaatgcaaaggaaaatggtctctcccaaatattggccacaacaatgtcatcaatggaaaccaggagaatttgcaaagtggaggttcaagaacaatgtggaattggcaattgagtcaggttttctaattttaaattcttatttgtgaaagggaatgtgaactgaacttaagatgtgtgcaaagatatgaaggagagtagttctctgaaaacctttctccctacccctgggactgaatttgcttggctagaagtaatctttaggaatgctactcatcaaaatagcgtggtactatgtattagtctgggttctctagagggacagaactaataggttagatgtgtatatgaggggtagtttatgtgattgacacacaatcacgaggtgaattcccacaataggccatctgcaagctgaggagcaaggaagccaatccaagtcaccaaacctcaaaagtagggaagctgacagttcagccttcagttggtggccaaaggcccgagagcccctcacaaaccactggagtaagtccaagagtccaaaagctgaggaacttggagtctgatgttcaagagcaggaagcagccagcacgagagaaagatgaagaccagaagactcagcaagctcacttctcctaccttcttgtgcctgctttttctagccgtgctggcagttgcttggatgatgcccactcatattgggtgggggtgggggggttggggagggtctgcctcccccagtccactgactcaaatgttaatctcccttggcaatacgctcacaggcacacccaggaacaatactttgcatccttcaatccaatcaagttgacactcaatattaaccatcaaatactattataaggagaatgttgcatgattttccttctagtctgtttgtaattcacatctaatgaaagagtgagagtggacgataaagggaacttgttgaaacatttctctcaaagcaaaagggatcattggaagcaggcagacaccagaattggtttaacctaaaaataacaaattaataattatcaagtctataatgatgacagtgacttaatgtgaatagaaagaattctaaactctctccttccttcctccctcccttctttcctactttctttccactccctttctcccacccccttttcttttcctttcttttctcccaccctctctccctccctttcttttattcaatgcatagtagttgaaaaaatctaaagttagacctgattttacactgaagactagaggtagttactatcctattactgtacttagttggctatgctggcatgtcattatgggtaaaagtttgatggatttatttgtgagttatttggttatgaaaatctagagattgaagtttttcattagaaaataacacacataacaagtctatgatcattttgcatttctgtaatcacagaatagttctgcaatatttcatgtatattggaattgaagttcaattgaattttatctgtatttagtaaaaattaactttagctttgatactaatgaataaagctgggttttttatttatcatactatttccattttcttctctagtaatattgcaattttcattcttaactctttcctgtcctatcatttctactccttttctagtttctctcattctctccctttttccatatttgtgccattgtcttttgcccaatcttgttgaactgatttaattattttttgttgtgtgatatagttcagtttttacctaattaaatatttaaatttttttttttgcttttcaaaaagtaaatatatgttaagcaaaaaaaaaaaaaaaaattaaatacatctttataattccaacctccagagatcacatgagcttttttttttttaacacatttggtatatttttctattcttttattaagaaaatcacttttttcagtaaaagagcattaaaaaaactttaaaggactttaatcaacagtgctgatttgccctgcagaattttttttaccattgtacactcatgtcaactgtgcataaacttatttcactactactttgtcacatattttcctcttcttaaagtaaacttgagctgtggatattatttcagtattttaaattgtatctctttgttatcatgacgtcaaagacatttttgtagactttggttgtttgtaaacctagttgtgagttttgtttttcagtcctttacacacattttcattgctttgtttgcttttaatttattttttaaaaaatccatgaataggccaggcgtggtggctcacgcctgtaatcccagcactttgggaggccgaggcgggtggatcacgaggtcaggagatcgagaccatcctggccaacatggtgaaaccccatctctactaaaagtacaaaaattagctggatgtggtggtgtatgcctgtaatcccagctacttgggtggctgaggcaagagaatcgcttgaaccagggagtcggaggttgcagtgagccaagatcgtgccactgcactccagcctggtgacagagtgagactctgtctcaaaaagaaaatatatatatatatatatagatagatattttttcatggatatatatatatccatgagtaaatggaagttttgtcttttttttcccctggaaccctagccctgctaaaaaccttctaactttacctttctctatccttttctttatctacaactttttaatttttttaatcatctttaccattatgcttcatccttctgaactcaattgctttggataggcgagaagctgctttcaatttcatttccccatttttatctttagctaatgttctgtagcttgttttagatctgtgtctacatattatatgtatctctgtatgcatcaatatttgtatatatgcatgcatatatgtgtatgtatatttatgaatacatatacacaccatatacatacacttatgtatggtgtgtgcatatgtatgtgtagatatatgtacatacacactatagtggactggggagttagtatactgggaggagcatacatttagggtatgattcacatatttattttgtccttctcccattttccattaattaacaggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggttggcacacaaaagttgttaacttaaatatcagggaatgtcatttagaaaattctacagttatcagtacaacttgtctttaaattatttgcacagtttctaagtatgtgattttattcaagtgcagaaattgcaggaaattagtatctgtgaaatatagatcgactgaagtaattaatgcatgttgttagggagtggagagagaaaagaagggaagcaagatctccaaggacaatcaggaggggaaatttgttctagtatcctctgatctatacacactcgccatgattctcccgcttggcttcccgccacctggacagatgagaatttccctagttcagagattatcagttctactctccttggaaggtgtcttaaatgggagtcttcccatttctttgtttcactctagattctctttatccaaaaattgttgaagatagagaatgtattatttttaaatccactctgagaatcgacaacccaattttgttatttgagtttcttttaagagcatttgcatcattgaaaacatttttaattaaggttgtgagttctactggtaaattaaaggcaatgtagccatgttcccgggaaaaatcagattgatgcaagagatatttttgccaaggaggggcactatgctccttagaatactgatatatgtatatgctcatttaatgtttagcaataggtctgccagtgtattcagactcagatttaccatcagtagagtgttcatgcttttctgaaataatgtgttatgttgacttttttgtgggcaaacaggtttatagacatactctgataaaagatactaagctatttgaactgtttaacaatgccatttatcttcgtttgaaaaacaagcatatataataccatcacagaaattttgtttagggtacatcaaagtattttgagtaccttactgatgaagtttattggatatagtaagcagttaaataaatggtcagtgccttcctacagcaagtacaagactgtgtatttaatcttccatttgtttccctgtcaccatagcagagtagtaactaggacctgtctaaacactgtaaaaatttgaacacattgcccaaaatttttacaaaaggaatgcaaggatgaaggtgctgatgactaggtggaacatctcatgctattttattattttgtttattgcctgagtagtgtcacattgagttttccttttgaaggttctgtatttcacgtcacatgcacaaataaaaacatgcaacattcttttcattcccacatttttaaaacctaaaaccacttaagccataaatttacaggtagagcaaagtatgagaaaggtttaaagttgaatagattgaaaataaggatgaataattttaaaatactgatttgttctagcaaaataatactgatgttgaaattaccttgaaaagttcatgctttcaaataaaaacacactttcttttctagaaaataatcttttcatcaggtgatacttcaattatctattggaataaagtctatatgagttatttaatttatgattatgattgatttatactgctgaatgcagtcaatttttttcatttactgatataattgggggaaaatcctttaatctgcatttctaagaatattattacacactattcaaaattgttcatttttgaaaatggctacaatgaccatccatgtgcataacattaaatttaattatgtaattttattttataaagatagtttatgactatttcaaagcattttcaatatagatgggtatgtgtgtatatatatatttgtatatactgttaagtatatataaagtatatgtatgtgttgtgtgtatatattttaatcctatgtatacatacatatacatatatacatataggattaaagtatataaaatgtatactttatatgtacttaaaagacacacaatgaaaataccctttaaattctgttccttaaagatacctttttaaccattgttgtatatcctccaggctctcaacatatgattttgtgagtatgcaagagaccgtgtatgtaagcatggacatgtgagattgtttccacatgttttcaaacactagatattatcaaccttttaaaactctgccagtatgctagttagaaatatttcatgttgatttacatttaaaaaattgttcttaacactgaacactttttcatataccttttggcccttctgtatattaggtagatgtctgtcacatctcttgtccatttttaaatttcttcttttctttgtaatttgtaagagatactagtacattggaagattcctttcttattctccctacaaagaaatgtcccatctgtcagtttgtagagttgatggagaattcagaaagctcatagtgatgtgaaagtcaataaagccacctggaaacacgaattctctatggctgcatccagctcaggaaacctcccaaggctatgtaaatagaggactcaggtgcctgtcactttccagccaagcaaatttaaatactgacagacacattttaacagattcagttacttcacagtttggtaaactataatcgcaatttgctccttataacctcttagtaaattattcatctccagtgggggaagactgatgtaatgatctcactttcctaccttaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcaggtttgcgggtcctttagacttgtgcaaatatgaaaagtacatgacgactacctgtatttaagaatggtgtgaggaaatctaaccacttattcaatgtgcagctattgctagttgatgaatttggaatttcagtcactcttaggaatatgaaaccacagaacaaatgtccttttaacagagatgaaataatagtgagaattgtgagactacagcaaaaatctgctcaggaggaaagagttattcagaatagtctattttttatatatttcaggcaattaccattctacagggaaaactttttgttagaagtaagaaataatatgcataaatctttacttaaagactttgtaccaacaaacaaaagggtgaagagtgattcctattatcagtgaagggcagtgagaaattgtaaccacaatgaaactgttatttaaagaatgagaaaaaaagaaaggaatgggtttatttcccattcaaacattaagaatctttcaggatggcatctctgtgtttataacaacaatgcagaatatttcctcccttttcttttcaaaattagtgtccaaatcacttcttggtgtccttttatatgcaagaaaaacaagtatgtcttttgtcagatcacaaatccacacagtctcgtatataatttcagtgatctgagtgcttgaaagttaaagatataaatggtagacctatgtagctggtaggaacatggtcttgctttaggtaggaatcaaacacatcaaatagaataattattattttgcagtattaaaactgtgcccttggcataaaaatcattccaggcaatccacactctttaaacaagtgggagaagagccgccctcaccttcctcattccatctagtccagctgccatgggaaccacaataaaaatatttggagcttttagcaaacccacagatccagaaatagtggaggggcagaaactgtaaaacaacaaaaggggactgacccctggggctggttgtcacacagactagtctgctctgtcctgatcaaggaattcttcttctcaaagaagtggctaattccactgatgaaaaatctattaggattaatcaacctaattaaaattgtaaatgccgtccataaccaccactgagagtacctacataacaagggaaacgaagttttcaagtgaggaggagggaaggtaggaagtttcgggaggttgagagtggaagcctcaaaacagcttgggagcagggtctgctagagaggggagaacagatcaagtgagtgagaggagtgtggaaaagaaggtggaaaaaagctgatttcaaaactctgcagagggccagttctatgtctgaatgagttttttaaaggatgaataaatgagctttcctcactcttctacatattctgctggagccctcctctggggatccagagtggaaaacctcatgtttatgttgtttattctattctatggtttagttaaatttcgtggtttagtggcttttgaagactgagctgagaacccatgctcaattatttggaagatgcattttcaattctaatggaatgtatgtgtgaaattatagactgtactgcatttgtaattggtagacacctgcaagctcaaatcaaagccatgttcagaacgtgcatgcatgtatcactgcagaaatacagactctgcctgcaaatgtgagactaatctcacatcattgaactgatgaccccagggatcttgacagaaaataacccaacaagctcttgaatagagggcagctcatatttcttttgctttttccatggcaactagcatagtgctagtcatctagtaggaaccaaatgaatatacattgattgcctgtgctgtaattctggatgtgatgttgggcaaaggtgtaaaatacattaggtaatttgaagcctgaaaatggaaagttctaacctagtacaatgtgcagtttctttggctacaacactagattctataccaattagcaactatgtgattgaaaaataagagaatgatgccactgtaatgtggagtttgttggatttcaagccaatttgatttttcctggccagggaagcctgaattgtgaaagtagaattgtaaccttcagctggaaaggaagaaaaagaaaacctttgagctcatgctgtggcccaggcaggatcccattcagctctattttaagaaaattaaaactgagcacctgcacccagggatccctccccagagaggtgtgtgcctgcaaggctctcagcatgtatcaagttgcacttcctcctgtgccaaccttttacactcagagctctacctccatctacatggtctcagcaccactaagacagcaccagtctctactgctttgatgcattttttatattgcctaaggcagcctgcagcccagagtcttaggcttcttgggctgtccaaactatatatttttttaagttgtgctctgattatgaagctgcataggtttccagttgtctgcccctaaatgcatctttcccataagccctggtatttttggtacagttctgtagaatgcatgtgtcgtggtatagcagaagtgcttgaagatttgtttctctgccttatctttagtaattgtgtttatgttggctatctggctattgcccttgcgtgacagacacaagtgacagtgctgatggcccttctgattgcagatgtcccaggagagaggagtacagccagcacctttcctacagacccagtttccccattgacaaccaccctcagccttgcacaccacagctctgctgccttacctgcacgcacctccaacaccaccatcacagcgaacacctcaggtctgactatgctgctctagtagtgtcttcagttatagataatgaaatggaaactcaaaactttaatgtagctcttttattttgtgccagatattatttgtaggtttcccattttacaaatgttcacgtatcaacaccaaattatgcaaaagaaacttgccagtaagctttttctgggcatattttattttactattaatattataaaagtccatggcaaagaagaatcaataataggccttaatgtcatatagctctgggatcaaatccaatttcttcaacttcgtagctgattacagggcaaattactaatactttctgcatatcagatttgctttctgtaaaaatggacataataacactccttttttaattatgtcaaaataattaacgtgatgtctgaatatgtaaaaatctggtatgtaataaatattttaaaagagtaattgtgacgcttattagaatccaagtatggaaagccgtgaatgaaagggaaatgaatagtctgaggaagattgcatatcatcaactaagaattatatcaaggaatgaatagttttccctcaatttatacaatgtttagtttaaataacttgaaataaatctttgattcactttattattttaaaaacaagcgaatgtcaaatcaaacgaggactcctagagcaaagatgccaataggaaattatctttgctaaagagtttttctttcaccttttaatataacgaattaattagcttttattcttctattcattttcttgcagatgcctaccttaatgcctctgaaacaaccactctgagcccttctggaagcgctgtcatttcaaccacaacaataggtgatattaccctcagtcaggcagccacaccatccccatgtgcctggtgatgtgctctcacaagggccttccacccactctacctcgggctcctttctttaagttgcattaagtgtttgaatcctgagggtgatggaacagcaggaagatatttctctgcttagcagtgcaacagctgatgagatcaggatgtaattgttactgtcataattcatcagaaagcatgtgtgagaaacaaccacatctactagaactttttctcacaggggtttaggtcttagtaaggaaaagaacaagcccatcaaaggggctgtccattgcaagtggtgagcatcagacggctgatggcagagttcccgttaagcagtgagagggcgtggagataaaggaaagagaaactgaggaatggctgcagcaatggtggtatctgtgaatcagcaagtaagctgatcagagcttgcaagcccacaattctcctcaaattcttccaacccaaaatcaagatgagcagagatctcttagcttacacaaagcacatgttctcccaattattcaacttaaatgcctacactcacacaagatactgctaaatttgttgacagagcaatttgttaccctggatctagtagatgtgcaaagagcttacaaaagttaatctagagaatgaagcagtctttgcattttctctgacttttttttatgtaaatgaaaagtataaacttcgtactatgggggttataattatataaattaacattgagattaatcaaaatatgaagacctttaaaatatttttggctgtgtgaatcttcagccatgttgccataccgccaattagatgcgtacctaaaagtcttaatattgttaattgtatttattgggtatatttatgaaaaattttatagaattagctcattcctttataatgctttaagttttgaaatgaaaacctgtactaggcaaatccttcatattctgttaaatctaactagatagactttatgaagtagaagtattgtaaatcagctttcccaaaaatgacatggcagatattctaaagcaaaattttaataatttacattttttttctccattacagctactactccatctaagccaacatgtggtaagtttatttacttagaatcagcatacctcactttggaatagcactttaattacatctttctttattccaagctttcaggacccactagtaagctaaactcactggctctaatttctcaccgatgactagtctcaaattagtaaaaaattactagctacacatggacatagagttgggaatgatagacactgggaaatacaagagcgatgatggagggaggaagacaagggttgggaaactacctatattgggaactgtgcctacttgctgggcgtcgaattcaattttactgcaaacctcagcatcctgcaatatacctttgtaacaaacttgcacatataaccctggaatccaaaataaaagttgaaaactaagttttccagttagacaactttggtaaagccacttaatttaatttaggtatttgaaaaaaaaatggaataacagcaagtttgttggtgagggggagggggacaaggattcagtgtgatgataaatataaaatgtggataataccttcaaagcttatcaagaagaaaaatctctctttttctctctctttctgtcttgcttgttaggggctggctcaaagcagatacttgaaaacagtttgtctctctttttttttttctcattttcttccttgattctcagttgaagcaaagcggttcttcatggtcagggcttattcctccattcatttctaagtctaaccactggagtcactgccttcagtagctttccatacatttagtgtaaagagtggccttcatatgtctgtttaattaatatgatcttttgtaatccggttgtcattcatctctcctcccgcctcttgaatcattgcctccttatgttcttcacttaagtaatatggaaccactttcagttttcttttctttctttctttcattcgttagttctttctttcttttttttttttttttctcactctgttgcccgggctggagtgcagtggtacaatctcagcttactgcaacctctgcctcctgggttcaagtgattctcctgcctcagcctcccaagtagctgggactataggcacatgccaccgagcccagctgatttttgtatttttagtagagattgggattcaccatgttgcccacgctggtcttgaactcctgacctcaggtgatcaacctgactcggccttccaaaatgctaggattacaggcatgatccaccacgcctggcccacttacagatttgtaaacacatactgttccttcctgcctctgtggccactcctgctcttcctctacaattggaattctgctccaacctcatcccccaaaccccatgtctatttttctatttcctgctcatattttaaaacacaaactaagtcactttctctggaaatcctgtcctatacctccaaatggaacagatctctctctttctagtgccacattatttcctgcataatcttattttagaggtttgtatgtctcctgcaattcatgcttgtgtctgcctccacactggattatacatttctaaaagctgattatatctaacttgcctttgaattcctagtattggtgaccatgtcttacatatgacaagggcttaataatttttgttgaataaaaacaaatgaataaatttatatttgttgtaaagatatttttatcagtcagcagaaattgttgacactaaacaaaggtgctttggaggtatattatcaatcataattttacccaagttaaggaaagaatgagggcttctgatccctgagtaattaatgccccacatatatcaagaaacaggtggttaataactacgttttagaaaacaagaaaattataaagcaagaataaatttctcaaatgcatcatttatttgtgcatcaagtcaacaagtaactagtgagttcccattaatgatacatattatgcatactcctgaatttacagtgataataaaaatagcctagactttgctctcatggaagttccaagtccagctaggaagacagacacttatctggtaatcatccaaatataaatttacaagctgaggtccttgttagggcagtaaagcacagataattacgaaaaaaatgatatggaggcacctaatgtgttttttctttttcatgttttttggggatatttggttagttgatttgatattttggcatttgcattaatgtagttttatttattctggaaaaataacactcaatgttctattttcttttagatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggtaaatatcaatttatttcttttaataaatttataaaaacagtacacttttgtgtgtggtgttctccagtggtcacaggagctagtctggtgagagaacagggctgagggaaaggaaattccttggaaacaagtgggtgaactttctgctgtcttaaccaagtaaaaatgatagagtcaaataagccttctgtttacatccattaatcaccacttctacttatttaacagggagatgtttatgtgcactaaatatagtttatcctgctaagtgattgtctgcaagctttctttattctcctctacttaaatgaagtattaattatatatgtacatatatttattcttttaagtacaaatttatctgaaatatattagggagaaacataaaggatttgatgtgtatgggaagaaccaaaatacattcataaaaaggaaggttatggtcatgttagtgagatcaagttggttttgtcagctaagctactgcttggaaagaggagggggtgacaggcgtcgggcagactctggggaagcatctcttagccaaatgcattctggaaaagggattccagagccgtgtaatttttttaaaaagtcatatcatttaataattcaagactattaataaatttgttaacatttaaatatgttaacatcaaatgtattttgaaaataaaatccatttaatttattcattttccctaaatattactgagataaattaccaattaaacacagaagatgacaatacttaaaaatgcatttcccaatagggaaactcccaatacactttataataatcattcaattaaaagtaagtaaagagtaaacaaaaaatttaagataaaaacaaaaatacaaaatggaatgagtgttttttaaaatgtgcgaaagctacaattttatcaatatgtttgcttgcatttcattttttaacgtggtataacttataaatgaaacactaccaaaatatatggtgctaaaaataataaagtaaataataaaagaaacaaatccctagagttattagacttttcccatagcaatctcaatccttgccaaattctatgtcattagcataatttcagtggctttaactgacatgttaggaatgaatgagggcttaggatacacattatgaaatactaatcaagtttatttctgtatcttcttgtcaggggttgaaaagtttcagttacatgattgtacacaagttgaaaaagcagatactactatttgtttaaaatggaaaaatattgaaacctttacttgtgatacacagaatattacctacagatttcagtgtggtaagaatataacattgaccagagaatttttttttgtggcacaatgttgttctagatattatttaatcttactctctgccctttctctcttcctccctgcctctcttgttctccctctgtttgtcttttttctttcttgtctttttcttggtctgtggtatatttagagtcaaataattaaattacctatacaattcaaacaaattcacaaaataaatgaatacttttcatgaaaaataaatatctaaaaattgaaagtcaattaatttacaataattttcttggcaattgttatacacaggcattgttgaagagatcatgaaagaagggtgttataaggaaatgataatacacaaactctgttatgaagtaaggaaaaaaaatacaggattgtatggttcaagagtttactttttccatcctgcatcaacaaaattcatacacaagttcaagaacacttaaataagaagaaagcagaaaaagaacagcaagtgcatctagggatatgtttggatttgaattgaggcaactaataattgagatagtatttttaaagtgtatttgaatttaatgaggtgaactctcccaccctttgacttaaagccatctgccaggccatagctggcatgacagacagatgtgctcaggtgtgcatgcgcatgcacgcatatccacagctacacacatagaggatggagcattgcgctgggtgtaatcatcacctaatcaccatagtatagattcatggccatcaggcaagcagacaaggaaaggaagagcaatcatgacagaccaatgataaaatgttctctctagacaatctattagatgaagactaggtgaggtgcaatttcaactttaagttgtatttgctatatacagattgggcatccctaatctgaaaatccagaatccaaaatgttctcagaatccagtactttttgagtgccaacatgatgcggctcaaacaagtgaaaaattttacacgtgacctaaagtgactggtcatagtcaaaatgcagaaacataacacagaatttagtcagcatccccagagaaaaataaatgacctcaagctatgtatatgaggtatatatgaaacataaatgaattttgcatttgaacttgtgtcctcttcccaatatattgtatcatctaaatgcaaatattccaaaatctgaaaaaaaaaactaaatccaaaacacttctggtgccaggaattttgaataagggaaactcagcctgtattttcataaaagttgaatgtaaaaattatttttagggttttttattattttggtaatttccacagatgtttcaatctgataaatattaaatagagaattataaatgtgaaattagaaaataaatgtgtgcgtgaaatattgcatcgatatattcattcgaaatatttctttatttcaggtaatatgatatttgataataaagaaattaaattagaaaaccttgaacccgaacatgagtataagtgtgactcagaaatactctataataaccacaagtttactaacgcaagtaaaattattaaaacagattttgggagtgagtatgttacttgcatttatatgtaaaattgcttctctcttcatgttcttataattatttgagaatcataggaaatgaattgtctttttgctgtttttgatactttttaagcatatgctttttatttcaatgaagcgcaatttatctatttttacttcttttgcttatgtttttggtgtcgtatatgaaagtccattgccaagtcatgcagatttatccatatgttttgttctaaaaattttatagcattggctcttaaatttagctctgttacccactttgagttaatatttgtatatggtgtgaggtaacagtctaatttcattttgttgcatatggccatctaatttttccagcgccatttgctgaaaatactatttattcccccactgaatagtcttgccattcttatcaaaaattagttgaccataatgatgggtttatttctgaactttcagttttattttattgatttatatgtcatacttacactgtcgattactgctgctttgtagtaaattttgaaactggaaactgtaagttcccccaaattgttacttttcctcaagattgtttagaatatctaagggaacttggaattctgtatgaattttaggatcaacttttcaatttttataaagaagccatctgggattctttcagggattgcattgaatctgtggataaatttgggaaatattgccatcttaaccatgttagtcttccagttcatgaacacaagatatctttccattaatttatgtcttctttaatttattttcaaaatgttttgtagttttcagtgcattagtgttataattcttctgttaaatttatttctagtttaagtttattcctggttataatgctgttgttttcttaatcacattttcaggtttgttactaatgtacaaaagtacaattgatttttctgtattgatcttgcagtctgtcacattactgaatttgtttattaatgataatattgagaaatttttgacaaaacttataaatgtaattctaaattttgttttgttttgattttgagacggagtctcgctctgttgcccaggctggagtgcagtggcgtgatctcggctcactgcaacctctgactcctgggttcaagcaattctcctgcctcggcctcccaagtagctgggactacaggtgcgtgccaccacgccctgctaattttctgtatttttagtagagatcaatctcctgacctcatgatccgcccaccttggcctcccaaagtgctggaattacaggcatgagccaccatgcccggcccgtgattctaagttttatgtaaaaaggatagttgaaggctaaagaggctgcctaaatccttgtctcctcatacttctccaaaataatatatagctacaagaacagcaaataaaactatgtaaaaactatatcctcagcataactagaaaattttaatgtatttttattagtaccacaattattacattctttataatcaatgcaacaaaatagaaatcccagaaaactatgttttatatttgaaaacagcacaaaatgttttcagtgggggaaaaatagtcttttcaactaatgatcctggtatctctgtagaaaaaaaatgaacatcagctctcacctctcaacaaacacaaaaattaattcaaaatggattccagacctaaatactaaagctataatttaaaaaattctaatcaaagacataggagaaaatgtgtagctttagcaaagatttcctagggcacaaaagcaagaaacataaaacttttttgatgaattggagtgcataaaaattgaatattcctgctctttggatgaggccactaaggaaataaaaaagcaataaatagtttgtaaaaaatcaaaattaattttttcaacaacagaagtttttccagaatatacagagagctctttcagctgcaaaataaggactaaaacagctcaattgaaaatggacaaacatttttaatatatacttcacaaaagaggatacacaggtggttaataagcacattaaatgatgctcagcatcattagttaactgagaaatacaaattaaaacaacactgagatgataatactatacatccattaaaatggctaaacttaagaatacggatactactaactattggtcaggatgtgcagccatgacccaggaatttcactccaggtatttaccaaagaggaaacatgacaaagcagatgcattcatagtagccaaaacctggaaacagcccaaatgtgtattcactgttgaatcctaggtaaaatgtggtgtatctttacaataactactgataattttttaaaattctaactatgacacatgcaactaagtgaatgaatcttcagaacattacattgagtgcaatatgttaggagtgaaaaagtacttactgtttgtttcattttatttacatgcaatgggtaaaaagacaaacttaatctgtagttaacagaaagttgatcagaaggtacgtgagtctggtcaaaggagctgagttgactgggaagtaccacagaaggacattttgggatcacagaaattttctttatcttgattgtggtgttggttatgtggatgtatacatttgttaaaaatgcattaaactgtatctcaaatgggtacattttaatgtaaattttacttcagacattttatttaaacatttatcagtttttctcagtttcaaatgactagttactggaagcaatgacaagtgctactcaatgactgctaaatttattggtgctatgaatgccagatttttagcacagcaaaatctacaaattccaggatttttaggtagtatctgggcaagaatatatatgaataatgtatatgaaaggaagagggggttcttagatatcttcaagtcagtggaatgcttaggtttcacagtgccaatctggtgtgacatttactttgttaaaggaatttactctaaaacaaattaaatgagcccagatgcatttctttaaattttattttgaattcatcatttgtcaaaatatggttatcaataatgcatgcttataatatgaagaatgctttatccatgtcttatttttcatattacataacattcttattcttttaacaggtccaggagagcctcagattattttttgtagaagtgaagctgcacatcaaggagtaattacctggaatccccctcaaagatcatttcataattttaccctctgttatataaaagagacaggtaatttgtgtagaatttaatttcatcagaaaagagaaatcaagaatttgaaagtactagaaatttttattgagccagtgagtcacaaagctctctgcttagagactgcataggcatagtatactccctgatcttagaattgcttccactcattcaaagctttccagccccagaaatgactaaaatccagaacattctaaatatttgcttgtccttcttggtcttagtttaaatctttgtgctccaaagcctagagacagaaaacctctggatgacaacactcatttctgtcttgcaagtattatgtaagtgatttgactcactttgaactcatcattcagcctcctaaacaaaccaacaaacaagcaaaccccttgtaaaacttgtttcagctaataatacagacaaaatgttgggtgaataaaaatgaacatgggcccatgtagccgctggggccagtttggtgtaatcttgggagcatagttctaagtttagaattagacttctgcagaagtaatgcaattaaaaaaaaaaagaagaagaaagaaatgtgctatgactagttcactcatgaaatgttcaaatgagatgctatttaagagaacaaatatcttctggacaatttaaagtatctaaattgtttgtagaaagtaacatcagtggagtatctcagagcagcctcaatgcctgggatagccctttctctattcttttatccataggttaaaataggaatgaagtgaacctcatagaattctgtcactctgtgctgtggggaaggaaccagacatacacttcaaaacttgaaaagtgaaaggctatttttcttcattatgttattttatattttaatggccttttcttgctagtgtctttaggtcttaataatcagactactaaagcaaagttaaatatgcatgtagttttcaaattaacattcaaaggccaaggaaaataaatatatactatatatttgaggttatgataaatttaaaagttaagtctatgtggaaggaaaaatggaaattccaggaagataaaacagcagaggtactgtctgcctcattggacacctcttttacaaacactttgtgtagcttctatgggaacacattgttcattttttttttctcttctctgaatcttctattcactatccctttctgcattcctcaatgtctacactctctctactagagagtattgtcgatgtcagagtatatggtagacattttatgcatttatggctcttttatatttttacagtttttttaaactgtatttccactgtatttgcataattagggtaaaaaggatgtaatgagttagtagcaactcattacagcaactagcatgggtccttcttattgggcaactaaatagtgttacccaaatttaacagctgtccacatagaacacttaaacgggattgaatggctgagaaggggaggctagctatcaggctgtgtgttttcttttctccaaagctgccgattggtgactgaatgcagctttggaccatgccctgacactgcataaagggctctttggagccagctctactctaaacagcgtgctccgcttttgttttctccttcatctcaaacatatacctgtctcctctcccatgttacctaaggcaaagagagttgataggattatagtatcgttaaggcaacttaacttttctcaccattttaaataaaattactattaaaaatccacaggaagaaagtctatgaaatttgcagtttactttttaatcagatattaaatttcacttcattacttcacaatttaattttttcagtgtctctaaaagagagggattaaaagaggagaaaaaatgcaattgacattaatttagttttattggtttagcaggtttttttaattatgtattatttaaagattttatcaactattttaataactcagtggagatgtgcatacatatcttcatagttcatatgatgaaactgaggttaacagaaaatgtgatagatgttcaagttcagtagcttgatctgtttcctttctgctcttggttttgtttgtttgtttgtttgagagggagtctccctctgtcgcccaggctggagtgcagtcatgcgatctcggctcactgcaagctccgcctcccaggttcacgccattctcccgcctcagcctccctagtagctgggactacaggcgcccgccaccacgcccggctaatttttttgtatttttagtagagacggggtttcactgtgttagccaggatagtctggatctcctgatctcgtgtgatccgatccgcccgcctcggcctcccaaagtgtgtttgtttatttttcctcacatttttagcttaagatattttggagaactgcagttttatctcgttaacttaatgatggcaagtgacagtgaagcttcttggtaattggggaattggggaagagatcttttgtgctttattggatttaaaggattatttttcaaaagttactgaaagcaataggcacctttcaagaccaccatgatgttgctggaaattattttgtgtaatgccttttatttttttaagaaaaaaaaaacagaacaaattgcttaatctctctgtggctcagttttgtcatctgtaaaatcagatgatagtgagtaccaactaatagttgcagtgatggttaaattaattatttcatgtataccccttgaaacagtgcttggcacatacagtgagttattatttttaaaaatcgttattgatattattattactgttgctgctatccagaaacatgttgccactctaatcatcctctttcctgatgtcacttggctactcaaaaatagcagcagctggtgatttttttacttaacaagtgctaagtcttctgcctgagtgtgaaaacacacttagacactgtcctacctctcatatgcctccccagccagagctgttgtcctgatcaggtttgtcactaaactcaaaaacattccttcttccgtttgtaatattttcttttctcccttacatgtattcagttccacttacctttcaatgaacagctgaattccacttccggcatgaaactccctcattctcacagctcccgttaattactgtagtgtccaaattactatgatagaatcaacccaatgactgatgatcaaatggattctgcatctaacattcaaaacagtagctaataccgatgttcaaagtttggaggttacatatcagaaaaggttttctaaaaaagaatcattctgaaacatgcaactcaagacttacagtatacactgggggctgtgttttctcagaaacaaaagagatcgtcttcacaaatgaatctgaacttattaaatattttatgtaccaaattaatgatataaaaccataatttttcaatatttaattttaccaatgataattgagtttgttcaatacactggctgataattgtaggtacttttgagtatcaaggatgtacttatttttcaatcactcaatagtttggagttcacttggaacaatgtgatgtagagaccaaattaattaggtacgtggtagtactgacttttaacgacttactaattttttttcacatttttcctcagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcgtaagttatatgttttaatgcttctttccataaatggtaaaaagcaaggtatgaactttttagcctacaatatttctatctttattctagcaagcacatttacctggcacatttgttaacatctagggcttataaacacgtaaaatctaaaagtttaaaaaccgttatcctggattctctctcttcttcagatatagtcatagaattttaaggacaaagcataaaagcatcttaattggcatcagtttgtgcaatttcatgcagttaagtacttaaccaacttagattaaaacattcactgtttgctgttgtctttactatctggaaatattaattgtaatcagaaacctaacaatgtctcataaagcattagcctactaacctctgttcatctgataaaacatttcataaaatgtaatattttattagcattttcttctcttcgttaccctcaactacttactattctattttatgtcacattatccatttaaggtttcctttcaatggcatttggctcttgccactagtataatctctccatagtttccaggcccaaagttagatctgcttctggggcacatgttaacctccatcgaggacagggaagaagaaatgccgtgttttaaggcagcatctatagctccagagaccctaacgggcactagacttgtgaagaaatattgtgctatttggggctgaatataagacacttttaaggtcatttaggttttggtttgaaaagttctggtcctggagctctatgcttttgttgttttcctgagtttctgtatcacagaaaaagaagacaatttgtttctgttcctgaagaacccatctaggtgtttaccaggataacattagcactccgggaaagaagggtctagattgtgtaataggacttggaggtttcccaatcaacaacatttttcctctcctctccccaaacttccccctcttccccactcccttccctttttctctattctctaattctacacagtctccttcagggattgcaataactctcatggcttcatgtacaacctatatgctaatacttactgaataaatgagtgatttattcttcagggttttgatattgttttttaatttatgtactatcataacttccttatttataacccccaagctaacacttaaaatactttatactatatccaagtattgtcaagtaatttacatatgcatctattaaattattaataacaaatctttcttcattttgatagctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggtaaaagtatgctctctacattactatagtaccaactacattataatgattgattcatagtacttaaataactttaagaccactgctcacatgagattgagaagctctgatgtgtaatggaatcacacttaaagagtctcaaatatttgactctaaaatttttattcctatagctcaagtcagtggtttaaagcaaatgtttcattggaatattttagaacttcaatatgacttaattatagctaaattattgcttctgtgttaagaagcacaacactttatgcacaacagattattactttaccaaatctaccttttctttactttggctttttatctttattaatgtggaatttttcaattgcaaaatttcacaggtaccttgaggttaggaaatatttgaaataaacactagacaatactagtgagcatacagaatttaaaacactcattatctcactgtctactgatcgtattttgtacatgtaacttcataatatacacatttatatgcacttaacacgtattatcaacattctgagtacacagttttcaaaatacagttttaaaactgtatttttaatatatcactatatcacacacacctttctatgttaaatatttaactactatgtagtttttaatgcctgtataatattctatgtatggctttatcacattctattaactataactatgttggtctctaatataaacaacattccgataacacacttattggtaaagcaaaatttttgaatgtctttaataatttatgtttcataaattcctaaaaatgcatttattgggtcaaaatgtattttgaggctttttggatatgtaactttttttttctataaaatttaccaaattgccctggtgtatcagtgtatgaaatgactgcttcttgagaggctcaccaacactgaatacgcctttctttttctttatttggtggttgaaatatggtattgatatctttcttttaatgaagtttctttacttattgttctttgtgttattctttgcctcttttatccagttttctccggagaaatgccttgaatattaatgatattaaactctttgtcacatgcgtaaaaatgttatcagtttataatttgccttttagttttcttcacagcactttgtcttacataattcccctttttatttttaaacaaatgtatctgtcacttttattcctgttaaatagaaatttccatagttaattttttaatatgatgttgacaaacggcctcatattctttttttgttttgttttgttttgttttgtttgtttgttttgttgttgttttttgttttgagagggagtcctgctctgtcacccaggctggagtgtggtggcgtgatctcggctcactgcaacctccgcctcccgggttcaaatgattctcctgcctcagcctcctgagtagctgggattacaggcacctgccaccacacctggcaaatttttgtattttcagtagagataggttttcaccatgttggccaggctggtctggaactcctgacctcaagtaatccgcctgcctcagcctcccaaattgttgggattacaggtgtgagccaccgtgcccggcccatattctttatcacttaaagaagtgttttcatatttataaactttttgattttgtttttgaactggaaatgtcggttggattttatcgatttttagggcattatgatagatgatgccatagttgtgatgccctggtgtgattagtttaaatgatgcaaaaccattgtcacattctaagagaaaaacccctgctctgtcattgtgtgttattctctcagagtattattgaaatcaacagcctattattgtctttattagtagatattcaaaaaggagatcattcagtgagtagagacggtgttggcataggcgttggatgacatcattcttattaaatttggtataaaggttacactgatctgataaaacacattgcttatatgttcctgtttttctgtatcatataactttttaaaaaaattttattattattttttgagaaagagtctcgctttgtcacccaggctggagtgaagtggcgtgatctcggctcctgcaacctccgcctcccaggttcaagcgattctcctgcctcagcctcccaagaagctgggattacaggcatgcaccaccatgcctggctaatttttgtatttttagtagagacgggggttcaccatgttggccaggctggcctagaactcctgatctcaagtgatctgcccaccttacctcccaaagtgctgggattacaggcgtgagctactgtgccaggcctatattatataactttaaatagtataggagtgatttgttcctgaaaaatttgtcttcattcctttcatgcagagaaattctttaagactcatttatatcttctttcaataggattagtcttttcagatattttactctttttgagtgagtgtgctatatatattttttcaaagaatagtcaacctaaaagaaatattttcttattgtcacatcattgtgtattatacttcattccccactgcttctccagtgcccattaagctccaggtgcactggtttctctataatttctcagaggcacctaggtgttactctttttagccacctccctccacgctcttcccacttcctagaatatgcctctcccactcttcaaatcgtataagttactatggaaaaatataggtgtacatcatattaaaatacaaccttaacgttcaaagtaggagataattattcagtttcgaattctcttcccccaatcttcaaaagatggtttttgttttctttattatacttgccataccttcttattatgcttatttctgtctccactatcatgttttgtgttcactccttcatgagagagcagtcatttcagctttttcaccattgtgatctctggttaataaattaatgaagttgatttattagtattacttttccatagatttattttgatgctcttcaggtggctttcggattaaaagtgttttcttccttgtaattttttttcatttttataaactaaagggaaaaaaaaggctatggattgtactttggtaaaattttgactgtaacccatgtctatatcgtttgtcactaatttctgaaggccttcacatgaaatgtaatcaatgattcttaaagtaaaacattttgattattgatgatttctaatgagtctgtagttataatttggaagagtttttaatatatccattatttaagagagtttttctacatttctggtgctttaatttcttattgctactaattattagctgataaaagttaattggcttttacaatttctgccttttaggatttgtagaataatttttacagctctatgtgtgatatttatgaatattctgtgaatattgggtaaattatatattctccataggataaaagcttagatatatatttgtcagatttattatatttattattattctcttttaatgatattattcaaatatattttacttaaatttttttggtcaaggattcttactgctcttttgctcttttcattttccctgtatatgtaaattgttttcacttcatttgtattacattttatgagacacaggtgtttatgcattatgcctatatagtaaattttactatatatccatttgcccttaaaaaaatgtatgtgcattttatgcataattctagtaaacagcttatggttgaatttccttttttaattaaatattagcctattaatagggaattttaactttatgaatattttgatgtattggattttatttcttcatccagtttcattattttaaataattatttaataattgtttaataactataaatatttttattgctaagtgagataagatatctttttgattgtcttttcaaatatatttgacaacatactgacataaccttgaagtttaaagcaaatcagcatacttttattgtatgcatggtatgaaagataatataaatgttttacattgtgatatataatatatatatatatataaattcacattagcaaactaattattttattttttgttactgaaattcaggcctattttcacaatggagactatcctggagaaccctttattttacatcattcaacatcttgtaagttatcactgggctatttattatatatattaagatatatattaatgcttataaagctatattattttacacttataatcacatttgattgttaaatgcttaaataatatctcttccgtaaatgtaatatttttaattgtcagtaaaaccatacatatatatgtaaatatatttaaatacaatatcttaaattcaagttaggagattcaattattaaaggtttgttgaattcataagaggatttatatacccaaactattaaattatgtttatgtttatgaaatatcgtcatgttagtaacatttttcgtgtactattttagattatctattttattctgtctcttcagcatatgtttagcagaagtgggccttagatacaagtctgtcttgatttacttaatggaagctaatataagcactccctaataacaatatacttatgtaaatatttatcactgatatttaaaatattttcatcaaagtaaaggtgtacatgaaaaattacttagaattaaatttcattataataatgaaaataacagctgcatgttacattccccacccacaattctgtttgccaggcaaccacttttaaccatttctatttttgggtctccttatagtttccttcatatatatatatatatatataaacaatattgtatactgctctttctagagttactaacattaccaattgatctgagcctatggaggaaggagacctagtactctactttgggctttctctactggttaacattgtaaatagaattatttaagcctgtatgtactttgttgtcagcaacttctaggtctttctatctttgccacttctagttcttcctctcttacatatgttacatatgcacatatgcatgtgcacaatcactggtatgaatgcaaagtcaaaagagaaaatataaaaacagcttattttccaaactgctttactaagccctctgcaaagttttagttctttctgctcagatttatgaaataaaaactccctgtgttaaatgtcaaaaaagtccagcaagatagctttgattttatttccacattacctttttcttttataatatctttataataaaaatgacttcattgactctttcctattaaattgtaaataatttatagcagtcatagactcagctgaacattcacactcacatcttaataggccagatctgaaacatttcacctggaaagacacagaacaaaaagcacagcatgctagcaagggagcctggcagtgggaatccttgcagcgggaatccttgcagcagtgcacacagcaatccagctacttttcttatgacactctcaaagacaactgagatatgagagaatgagaccacatgtgtaggtgtaggagctgcattccaaaaggaatcagtatctcttatactatttccatgggcatagcttccagacatgccaacaggggtgtgctcagttatgagcgggcactgcactcagggaaacccaaagctggtacttcccatgaggacaatagagttcacatatagcactccctgttcaggtgtagtttagcaatcaagggtcattttgccattagcaatgttgtctggtaaccagctaatattccacttttatcaggtttccaggtcaacggagccaaaaaattagccctcatctttttccacaaaggagacaacattgtattcactctctgctcacaatatcattatcctaagagataaataatatagtttcttttaaaatagtgatatctgttccaggaaaggacttgggctgtgaattgctagggtacagctactagggatgtgttgttgggtttccccggcataatattccaccacctgtactttgacatcattgtcaattgaactcctggggaccctttcttcttgctctgatctggactctcacatgccatcttgaaatattcccccatcagttttctggtttagatttgctgtatcacacatagttatttttttttctgtctgagttcactgatatatgttctctagtgtaagaaaaataattctaattctcccatacaaaaaaaatttttattctgctctggcacttgttcagtgtatcgacttggtataaaattctaagttaaaaattttagaatttaaaaattatttctgtcttattttcctgaatccaattttactttctaattccatcctgattctctctctctctctctctctctctctttttttggtctgttcccaagttttcctcccctggaaatgctaggtttctgtctttattcttggtcttacctgaattttttgtttgttttgttttgtttgtttttgtttttgtttttagagggagtttcgctcttgttgcccaggctggagtgcagtggcataatctcggctcactgcaacttctgcctcctgggttcaagtgattctcctgcttcagcttcctgagtagctgggattacaggcaggcaccaccacacctggctaatttttgtatttttagtagagaagggatttcaccatgttggttaggctagtcttgaactcttgatctcaaatgatccacctgccttggcctcccaaagtgctgggattacaggtgtgatccactgtgcctggccctgaatctttttcattcattttttctggatgctattgacctttgtaacctgaagatttatatatctgagaattctttgctccattttcttcccatagtctttggttgagtctattagtcataaaactcataagttgacttattattttggcattcccctttggtgttgatgttttccttaaaagcttggttcttattggtagtctagtcatagtcacagtgagacaacaggaaaggttgattagatgttctgtggtccttagaagatcttggtgactgaggagatttcctatgatattgctgatttatttttttctgatatcattcattatcaccaaaaactaattaatccccagaaattaatctccagaattaccctactccttgttgtgtggtaaagtgtgaaaaagtggttcttctcacagtaggacaggaagataggtgtccaactattgcatatgtggacaattacattgtcctcctaattttagtcctgtgcctcatcccttccctgtactgagcctgactttattctcagtctctcactgctttcatttaattttccttttgtcttctcctccctggtagtattttttcaagaagatattttttgttattgttgttgttgttgttattgtttttgtaaatagacatttgacttccatgttctgacccatgattcacatttactgcatatgtcactttcaaacctgagactcaggcattctgagtaaatggaatctattcctttgatttaggctgtggcctcctttcttttgttttctaccttctacaacttgttgaaattgctctacttctaatttcccttctctcattttcactgtcattataaatctatggcattttcagttttttaatattagcagggttcctggaaagaagggggaaacacatgtgtgcttagaatgcaagctttatctgaagacttggctattttattaagtttgttgagaaaagtctgatgctgcttaatatttttgtagaacttaatctaattattatggattggaatgctaacttacagtcatttgcagtttcttgcaaaatcttacttcagagtattctagaagttagatgttgcctctgatgaggtttttattcacaaaatctggaaacaatcatgctgattgatatatgtatactagtaatcactggtatggattgacaatttcagtgaaaggaatttcagatagagataagacaaggaacactttgggtcattttaggagcctattgcaataagaacttcttccctaaaaatgttcactgcaatccacctatatattcacattcatgtatcccatccatttttatatatgccggcagtataaatacccctttaaaggagataaaattatttctattttatatatgaggaaactcaagtttggataatttaatctatttgccctatgagtcaaagaaatgacagagcctgaattcaagctcaggtcttacagtctgtatctgaaattactttcaatattcctgtttgtatgagtttccagttacagaaattttgatcatgagatgaactgtttctggcagctgtttgcttgatagagtcatttccttctttccagttgtagaaaaactgtctcatgctcaaggcctccacttgccatacagaaaatacatcccctctacttccttatcaccctacttatttttttcagagtatatgaaaaaatgcataattatttcatttgttcacttacctttcttttttcttttcttttctttcctttttttttttttcttgacagagtcttgctctgtcgtccaggttggagtacagtggtgcaatcttggctcactgcaacctctgcctcctcggttcaagtgattctcatcccttagcctcccaagtagttggcattacagacacacaccatgcctggctaattttttgtatatttagtagagatgaggtttcaccatgttggccaggctgctctcaaactcctggcctcaagtgatccacacgcctcggcctcccaaagtgctggggttacaggggtaagccactgcgcctgtctgttcagttacctttctagtgtctgtttcccccaaagagaatgcaaatttcctgaaaactaatattatctctgccttatattctatagcatttccacggactgtcttcctttttatcttcacagcccttatatcttctcacctacatgaccatttacttatttcttctgttcattattaattatctatttttcttcactagagagtaagttccatgaggacaggacccttgtttttctttatgtagatatcctaagtacctagagctgagtttggcagatgaccaaaagccaaaaatattttttttgtgaatagtgaataattagtacttactacttcccagccaccgtgctacgtgtttactgtgaatcaacacctttagccacattttaggattttgggaaaggagggacaaagataataaggaatctggccaagttcccaactaagaagtggtagagctaggattggaagctaagcagtcgggctctggagctgaggctcttaagtcaccgcattattttgctgcattttcactacataagaaaaggtgaatatactggagatatttccaacacaccctctcttctatgccctttccctaggaaagggcaggatttcacattaaacttagtgaatatttaagtcagggtaagtcttatcctaactatagaatgaaaccatttttgtctcttagtgaatggattttacacctcagtgaacaggtaagagggtttatctttgtgaagtagaagtctttctcatccccttaagaggctacccacttctgcatataaagttaaactatatgagtttgtctccaaaatttataataactggattacctccttgatcccttcaaaatgaagtgtctgataaaaaaagagaattaaatttaaatgtgtcttatgaaagaacattatttaatcaaaagaaagataattattcttctattcttactctccttaaatataaaatgttttcattggttcagaacaatatagccaaaatcacagaattagaaatttattgtatttgaccttattctaaaatgtttattttttaaaacctcacaataaatttaaaaatattaaaatataaatactttggaggtgattattcaaccagtctagcaagttatttgacaatcgttctctgaatgtattatttttcatttctagataattctaaggcactgatagcatttctggcatttctgattattgtgacatcaatagccctgcttgttgttctctacaaaatctatgatctacataagaaaagatcctggtaagagttgattttaaatttttaaataataatggtattagtaatggtgcaaacgcatatccatatggcagtgatggaaccagttaaatgaaatatgtgaactagagagaagacagcatacagcccacttcatgacacaacttttaatcaaaaacttttagtatggttttattggtttgaattaaacattaatattattttctaaatttactaataatgttgtggacttgtttaataataaccagtgaaaagaatgtgtgtggtttttagtacaaagtgggtcagagggatctaggagtgtcaaaagaaaaagaaaggagggagatgtctggggaagttaatgtgtttctttggtcagaaacaaccacatcttatgaaaaacagaagatttaaaataaaatcatttagctacttatgtgagtttagcagacaattcttggttgttttctttcctccctcaccctcctctctcctctctgactctgctttctcccatccttctgtcctccctctgctcaaggctcttcctcccttccctcctttcctcttctcctctcctctcttccccttttcttatccctgacttccttcctttgttccttcaatatattcattaaatataagtaaaataccaattgaattttgtgcttcttgagaatatagaaacttatttttcctattttcacagcaatttagatgaacagcaggagcttgttgaaaggggtaagtatgtatatttttgctgatgactattccttcccctgcatttgaatccattcattttatttatttatttatttatatttattttaagacagagtctcattctgtctcccaggctgaagtgtggtggtgcaatctctgcttattgcagcctccgcctccctgttgaagcaattctcatgtgcctcagcttcccaagtatctgggattacagacacacatcaccaggcccagctaatttttgtatttttagtagagatgggatatcaccatgctgcccaagctggtcttgaactgctggtctcaagtaatccacccaccttggcctcccaaagtgctgggattataggcatgaaccattgcgcccgtccccattcattttaaataagaattgggcatttttagtttaacttggacttttgttgatacagtgataaaacttaaattcctttactcactcagcacctgtgaagttcccagtgtacgccaagcattgtgccaggtactgagagtactacagtgacaggcacagactctgcccttaaagggtttagaatctaatagaggaaagcagatatctcaacaaatatgacggtaatttgatacatgccctagtagttgaatgtgtatagttctatagatatatggaagatagaaaactgtgtgcaagggcagaaatctggtctgttaagattgtggggaaccaatggacaaatgagggagtggtggagggacgagtggatggaagtcacagagatggggagatgggatgtctcctcaagtccctgccagggtggaatggtggctgctcccactaaagacacatttatggattggacaaagaacagcaatttgacttgggagaagaaaacacatttgtttatcttttttttcaacatttatattctttaattttttaaaaatgtgatttctgatccagtaaaaggggacaaagtttcagaaattgaacctttgtttacaataaagaaatgtacttgctttctcatgcttaagacaggaataatttcagaactcctttgtctgtgttaatctgtgttggaagtgtttccctctggtaatagcaggtaccaggtctctatgcagaaactttagggctgaatctttggagctccttaaaaggctttatttttctttgcagaatgtaacactatctgatcccttattacatatttattcatttggtcattgactatcctctcctaactagaatgtaagctttgtgaaagcgtggaggcttttttcttattcactgctttatgcccagtaccaaagtgagtacctaggatttgataaatattagtgaataaataacactgacatagggtatcgtgaggattcattttgataggctgagggaggaatgaagagtacaatcagtaataaacacctgagcagaacaggaaaatccatctcaaggagttaaggtggacttggaaagtgtcaatgaaatattttatctcaaaattggtaccgattgcaccttggaacgcagtagaatttactcactcagaccccatgaaaccctgaatgtggccctcagttcagaatgaatgaataccaggcattcccaacaacctaaagaaacaattgcacatagccagtttgagagctgtgattgtatagaaagtttccatgggcaataagataaatgggtcaccctcatggataacttctttctttatctgataaactggtaaaattaatatgattactgaaagaaacactatcagtagtacatggaagagtaggagaaacataattttacatatgcgacagcttaaattctcttacctttctaaagctgttggttttcaagttccatatgcaattgtagctttttatggttagtatactttttaatcttcagtaagttatttcacaaacatggtatataatgtgtttcatatacttgaagcataacaaattaatacaacttgtttcaccatttagtgtaaacagatgatcaaattaagctgagtcatgggtataagggtattaatcatattgtcttatttcatttgcatgtttacagtatttcacaagttgaaaatgaaaatacaaagaaaaataatattgtattataaataaataattatagtaattgctataaaatgcatatagtcaaacgtgaatgtccttataatggtgatgtttggtctgggatcccttctcttaagcatagaaaatggggaagaacattctagtagagagaacaatataaagcccagaagagatctgaagtacaagattgaaaagtcattgatttataggtaaatgtttgtatgtgagtgagatttctcagatgaaatgtgtacgaggaggaaagaagctaaaggattgagtacacggtgtaaatttaatgaaatgtgtatgcccacctgaaagacacatgtaactagtattgaatctttaatatgtttccagatgatgaaaaacaactgatgaatgtggagccaatccatgcagatattttgttggaaacttataagaggaagattgctgatgaaggaagactttttctggctgaatttcaggtgtgtgttgcttttgttatatgatgataaattcgacatcaagacagttccactttaagtgtatttatattgccatttgcctttataatttatcccacttgatattgcaacataagcaaagtagatattattagcagatctctatgaaccagaagagagactcatagaggttgacgggattatagtgtagagctagtaaatattttaatgtagtgctttattgtattatgaagttgtgtcacaaaatgtatttggctgattttgtagttgtactctagatactcatccaagtatctgtttttaaatgaatttgatagtgacacaacaactaatcctaaatttgtccccactcaagagatttgttctgaaagttgtcaatcattaatttgtaagaaaaaagttttttttttaacataattcctgatcttaattttgattactctaagcaaatttttttatcaatatgaagaaaatattttacaggatatctcatttactcaaaacggtcattggtaagggggaaattatttttcctgaatctgctgtgatccaagaaatcgttgtttctttcagagcatcccgcgggtgttcagcaagtttcctataaaggaagctcgaaagccctttaaccagaataaaaaccgttatgttgacattcttccttgtgagtatttattgagtgctgaattcccatatattaggctacttgattattcactatttcacttgtttatttttcttttccttaaacagatgattataaccgtgttgaactctctgagataaacggagatgcagggtcaaactacataaatgccagctatattgatgtgagtaaaaatttgcatttttcttatacctacatatttcattcagctccttgtttgtcttggtaaaattttagaaatattattaaaaatattttgaagtgagcccatatgtcactgatataaacaaaaaattatcaatattagcaaggatagttatttattatgtgactattggtattaggtataacatagaattttcctctacaaacaaaattatattaagaattaatttaatatactctggtgtctattatgtgctagatattagactaaatattctatgcatatatttctcacaagaagtccacatttgcctcagccatgtgccgtataggtgaggactgggaggctcagtttagttaattaccttgttgttgttcacacaattggtaaatatttgagttgaaattcaaccagagtctgactgactccaaaatgttatgctttaatttcatcacactaaatttcagcagacattcctcatcaacatgatcatctatccattggatttatgcagaaatgtaaatgtccgtacgtggttaatttatttaaaatattttaaaatttaatttattatacaaatgttaattaatgtattacataggttaaataattttaaacagtataaaaatatatacagactgaaaaaattctttttgtctccccaaatctgccattttcccagtgtcctcacctaccagaaataactatattttctattcaaatatatatggtaattatggtatcaggttacttatgtttccccaatggaacttagagctccctgaaagcatgtgtcttctgcttttagataggtgattgacatattgtagctattcaataaatacttattaaataaatgaatgtatgcgcaataatgtgtcatgagatagaagtttcaggaagttacttaaattaatgttgaattcttgtgacccatgtttcaaatttaatccaatggcaaaggtcatccctctctgaagagctcctttagttactgaggtgaatttaggagtctgagataattctggaagaagccagtataatattttatctgcctctgtactcctttatcttggtaacaggagcagagaaagcagacatagtaggtaatgaaatgaaagttattatatctcttatctgaaatggcaaagaagtctagggaatcatattccagcagaagttaagaggtgaaaatgcgggtaaaatctaagaatgatttgtttaaagaaattgagtaaaaatcccaaaagtaactacatggctggtgagcttgtttaaatagtggtagatgatcctataagagttggcaggatataaaatgttgaaatgtctagagcactcttgtaaattaccacagcatcgcagatgaagatgaaacctagtattaaaattgtttgaagtttacagcaaagatacatgaaagtcatgaatattctttgcaaatgctaacatgtttagcacaattaaatgcctgaccaccaattaataagattcccttaatactttgaaactgcccagagaaattcacaatcacaaaatgatggatctgaagcaattcctctaactcacaatttttcctgttaatgagtaattgaatgttcagcaaatgacatatctctgcatgtgttttcaatagggtttcaaagaacccaggaaatacattgctgcacaaggtaatttctttgataatccaatattctttttgaaaaatttttatagcacttttaagaaaatttttcttatcagcttttatttgtttacctcctaggtcccagggatgaaactgttgatgatttctggaggatgatttgggaacagaaagccacagttattgtcatggtcactcgatgtgaagaaggaaacagggtaagaaccaagaagattcatagtgtgggtcttggggttaggaaaacaaggtgttgaatggcattttgaaaagccacatgtatctgcctgatgactaaaacagagagttctctattttaatcagtgttaacatttaatttaaaattttcatacatgtagaaaactaaaacttttaacatacaaatatatgtctatatgcataaaatttcaatgcttctgattaattgctagactcttaacttgattcctgtttctttgcagtattgttataagttcagtatatttcactgttttaacttcacaagaccttaatactcgaaacaaaactgaccttgggcagataggtggtgagtcatgtaatgtgactttaggaataaaagcctctctgtccccctacctaaaattaaccacaagcaatcatatcctttttgctgacaactgattatgtcctctcttaacatgcatctaagcctggaaagatcatcctgctaaaaagtatgaaggaaattcttcaggacacattagtgggaaatagaatatatttcaagcatcacagcttaaggtttatatgtgcttaaactatacaactgttttgagaatttcaaatgagtataggttttgttttcactgtttaaagaaagtttgataaaaaattggcttaaattaaaaattaaaatacttaataattttttaaaatgtagaacaagtgtgcagaatactggccgtcaatggaagagggcactcgggcttttggagatgttgttgtaaagatcaaccagcacaaaagatgtccagattacatcattcagaaattgaacattgtaaatgtgagtttgctttttacataatttttgttttgatacttttttataaaaatataattatggaatattaaaagtgagaaaataaaatatatcaggaaaaattatttttgataacctttaggatgaaagctgtggttagaacaatgacaaaaatcaatagggtcaaatttaagtcactggtcaagacgtttttgtccaactcaaatcgaaagaattatactgtattaattaattatctgttttaattattaaaaaaagagggaaggtccattaaatgtgttgaaaatataatcaaattattaaaagaataagcaatttgtcttcattgtcagtgagttcctacttttatgaaaaaaaattatattatttccataagagaaatgacagcattagagaacactgtaagaagtataaagttctaactatgcagcagagatagaatgtttagttcagaaaataaggaggtcattgtggccttagataatagttaaaatagagatcgtcatgcatgttatataattccattatatgaaaaatccacaataggcaagtcaataaagacagaaagtagatcagtggttgcctggagctgaggaggtcaaacagaaatggggagtggctgcaaataagaacaggctttcattttgtgatggtgaaaatgttctataattagatattggtgatggttgtactatttagtgaatgtaatatgaataccaaattgtacattttaaactggtgaactttatggtatgtaaaatgtgtatctcttatttccaacaaatgaattttatttttaattttttggggtacatggtaggtgtgtatattcatggggtaaatgagatgttttgattgaggcatacaatgcataacaatcacatcagggtaaatggggcatccatcatcccaagcatttatcttttctttgtgttacaaacaacccagttatactcttttggttattttgaaatgtataataaattattgttgaatagtcaccctgttgtgctatcaaatacaaggtcttattcattttatctaattatatttttgtacacattaaccatcaccatttccacccctgccatacccttccaatcctttggtaaccatcattctactctgtatatccaagagttcagttattttaaattttggctcccacaaataagtaacaacatatgaagtttgtatttctgtgtctggcttatttcacttaacgtaagtcctccaggtccatccatgttgttgcaaatgactagatcttacccctttttatggctgaataatacttcattgtatatatgtactacattttgtttatccattcatcagtcaactgatgcttaggttgtttccaaaagttgactactatgaatagtgctccaataaacgtgggagtgcagattatctcttcaatctactgtttcctttctttgcggtatatacctagcagtgggattgctggatcatatggtagtgctatttttagtttttttgagaaacctccaaacagttctacatagttgttgtactaatttactttctcaccaacattgtctgagggttttctttccttcacatccttgcaagcattcattcttggctatcttttatatataagttgttataactggagcatagtgataacttaatgtagttttgatttgcatttctctgatagtaaataatgttgaccacctttttatttatctgtttaccatttgtatgtcttcttttgagaaatgtctattcagatcttttgcctatttaaaaatcagattattagatttttcattataaagttctgtaagcttcttatgtattctggatattaatgctttgtcagatggatagttggcaaatattttccctcattctgtggcttgtctcttcactttgttgattgttttctttgctatacagaagctttctaacttgatgtaattctacttgttcatttttgctatggttgcctgtgcttgtggggtattgttgaataaaactttgcacaaaccaatgccctggagagtttccccaacattttcttttagtagtttcatagattaaggtcttagatctaagtctaatccattttttttatttaatgtttgtatacagcaagagatagggctttagtttcattcttccacatatgaatatccagttttcacagtacaatctattgtggagactgtcctttccccaatgcatattctgggtacctgtatcaaaaatgagtccactgtagagttgtttcattgctctatgtatgtttttatgccagtaccatgctgttctggttactatagctctgaagtataatttcaaattaggtattgtgattcctctagttttgttcttttcactcaggatggctttggctattctgggtcttttgtggtttcatataaatattaggattattttttctatttgtaaagaacattattggtattttgatagatattgcattgaatctgtagatagttttgagtagtatggacattttaataatactgagtctttcaattcatgaacatggaatagctttccattttttatgtcctcttcaatttcttgcatcaatgtttcatagttttcattgtagagatctttcacttctttggttaagtttattcctaggtatttatgttgtttttatctattgcaaacgagattactttcttgatttctttttcagattgttcaatgttagcatataaaaacactgcttgttttaatgttgattttatatctcatgaccttactgaatttgttaatcagttctaatagttttttggtggagtatttaggtttttccaaatataagataatggaatgtgcaaacaagtataattggacttcttcctttccaatttggatgccttgtgtttctttctcttgtctgatggctctagctgggacttccagttgaacaacagtggtgaaagtgggcatccttgtctttatccagatcttagaagaaaggctttcagttttttctcatttaatatgatgctagctgtgggtgtgtcatatatgactttcattctgttgaggtatattccttcgttaccctgttttttgaggtttcttattatgaagagatgttgaattttatggcataatttttcagcatcaattgaaatgatcatgtcttttgtccttcattctgttgatataatgtatcacaataattgatttgtgtatgttgaaccatccttgcatcccttggataaatgccacttgatcaggatgaatgatctttttaaagtgttgttgaattcagtttgctagtattttgttgaggatttttgcatcagtattcatcagggatattgaccggtagttttcttttttttgatgtgtctttgtctggttttggtatcagagtaatactggccttgcagaatgagtttggaagaattcctttctcttccattttttggaatagttagagtagaattggtactagttcttctttaaatgtttggtaaaatgtggtagtgaagccattaggtcccgggcttttctttgctgggaaacttttcatgacaacctccgtttcattacttgttgtctgttcaggttttgggtaccaaaaataatggcaacaacaacttttcaagacatggagagcaaaataacacatgaattgaaacaagaaaatggcaaaatgtggaggaatgaagttaaaatatagcattttcattatattacactttgcttgttagtttgtttacacaatgtctgttgtcttcagtgtaaaataatgcattataagatatgataaccccaaatccaaaagcattcaacagatacataaaaataaaaagcaagaaattaaaacagaccaccagagaaaatcaccttcacttaaaggaagacaggaagaaaagaaagaaggaagaggaggccacaaaacaaccataaaagacataacaaaatggcaggagtaagtctttatttatcagtaataacattgaatatcagtagactaaactctctaaacaaaatacatagagtggctgaatagatattaataaaacaagacccaacaatctgttgcttacaagaaacattcttcacctgtaaagacacaaatagacttaaaataagagatggaaaattatattctttgtaaatggaaacctaaaaagagaaggagtacctatacttatataacacaggtatatttcaacacaaaaactaataaaagagacaccgattgtctctacataatgataaaggagtcaattcagcaagaggatataacaattgtaaatatatatgcaactaatactggagcacacagatatataaagcaaatattgttagagctaaagagagagatagactccaatacaataatagttggagacttcaacactctactttcagcattaggcagatcacccaggaagaaaatcaacaaagaaacattggtcttaatgtgcattgtagaccaaatgaacctaatagacatttatagaacacttcaaccaatggctgaagaatacacattcttctcctcagcccatggatcattctcagggacataccttatgttatgctacaaaacaagtcttacaaaattaaaaaaaaattatataaacttttctttgactacagtagaactagaaatcaataacaagaataagtttggaaactatacaaactcatggagagtgaacaatatattcctcaatgaccactgattcaatgaggaaatcactaaggaaattttaaaatttttcaaaacaaatgaaaatggaaacacaacaaaccaaatcctgtgtgatacagtgaaagcagtactaagagaaaagtttgtaagagtaagcacctacattaaaaaagaaaaatttcaaataaacaacataatgatacatttcaaagaactagaaaagcaagagcaaactgaactgtaaattagaagaaaaaataataaagatcaaagtagaaataaatgaaactgaaataaaaaaatacaaagcatcaatgaaataaaatgttgtttttaaaaagagaaaattgacaggccaggtgcagtggctcatgcctgtaatcccagtactttaagaggacaagtcgggtgtatcatttgaggtcaggagtttgagaccagcctggccaatatggtgaaaccccgtctctactaaaaatacaaaaaaatattagccaggtgtggtggcatgcacctgtaatcccagttacttgggagactgaggcagtagaatcacttgaacctgggaagccgaggttgcagtgagccaagattgcatcattacactcaagcctgggctttgcagtgagactttatctcaaaaaaaaagataaaattgacaaacctttagtcagactaaggaaaaaagagtggagactcaaatgcgtacagtcagagatgaaaaaagagacattgccactgatacttcagaaatttaaaagattatgagatgctactatgagcagttatatgctaatgaattggaaaacttagaagaaatggataaattcctagatacatgcaacctatcaagattgtaaaatgtctcttgatagagctgtttaaaaaactacaagtctttacatgggggttaagattttctcttaatttcatttattgtagggcttttagtaatctaaattttatttttgtatagtctagctatattttctacaggagaaacagacttagtctatatatctccgtaggtcttcttaggtttccatggtattactaattgttatgtctatagagtgctgtgaaacaatcctatcaatagtttctggccaaacacttgtttgactaagccacaaaggcacctgctccatagatatgaggatatatttctagattgatgcctatctggctacattctgtagtctgggtttactggtgttaattaactcagtttgtgtgtttcttttgttatctaaatgtagatggttctttatacctggccatagaattatgacttatgcatcttatggtggttaccttgaaattagaacaaacctgagctctaatctggggctgactttcctcagtcgtctctctacattctgtgttgacaatgctaccatgtgaaggcctaaggaatacaatgttcatcaaataattaatcagactttgctcacatatgaattagttctgtttgctggcctatcaagcagaagtattttaaacagttgtgagaatgacctttaccaaatcattttaaacacaaatccaaaaagcttccacccatgcaccccacttttatggtgtatgtttattttgggttttttttgcttgacagcatgcaagttcctagaaattttggttatacttttaaagaaagtattaccttacttaccttactgttaagttattgcttacagggtagtacatgcaagtcctgcacaatatcttaactactagttattgattagaaaggaaaacacaaccatggttgagaaaatatataagacacctgaggaaactatgaactcttttgagtagtttatgtttacacgaggagactttgtactggtactcccttccacttatttatgtttcatagtttgctttaaaaaaatcatctcaaagaaaatattatctcttgactagaaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcaggtaggaaaaacgaacaaaaaaaaaaaacaacaacaaaaaaactccaacagaatccacctgcctagggctgttagagacatctttccctttggcaattgctattttgggaaacaacctatgggagaagcttagattcttatattggcttcacacctgacagcttttccatgatcatgcctctgcttttttttgcttggtttgccagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggtatgttctaacctttagtgattattctcactttggttttttggacttaaatcttttccaagtgataataatgatattttttaaaaatccaaattcttcacaacctcaaacagtagatgatttcctgaaaactaaaacgtggtaatcaccagaaatacttagaagcatttttcattagtgcctaaaagtactgtggaagaaagatgaccacaaaatatataatttttaaaataatgaactactgttaacatatatcagattggcaaaaaaagtaaaaatgctgaaaatagatttggcatcatctcataaaattaaactgaagagacagaatagtatagtaatcaacagctggttttagaaactacacttacaggtttcaaatcttgcttttaattattaatacgagggtgagtggtattgtttattaagtaattttagtctgactgcacctcagttaagtcatctgtaaaatggagacaatgataatacctcacagacttataaccacaaaagtaatacaaataaagcacttaaacaagtccctggcccatgctatgcatttggtgattgtaagtgatggtaattactgaaaatgtctgtatttgacccagcaaaatcacatatatgcatatacccaagagaagcatcaactagaaacatttgcaagaatgtgcattgcattcagcattgtcaaaatagcaaaaaaaaaaaaaaaaaaaaagtgaaatacatatcaatgaaagaatggaaacaccgtaaatatgtatcaataggggaataggaagacaaaatgtggacatgtgaactctctgtacaacaaatgctatgttgtggtagaaagcaatgatctaggtttgtgtctgtctgtttggagagatgctcagatgaaaacaatgagtgagtaaagctgccatacgaaacattcaagatataatttatgtgatttaaaaaaaacatgaaaatgtacaatgcttgtgattacagatacatagatagcagtgtagaaacataaaaacaaattgttaaccaggtaaaaagaaattatttacagtggaaaataaagtacagtggaaagacagtgccaaactcagggaactaaaggtggcggttaaagaggattatcagaagtataccatttccttgaaaatactggattcaaacaaaataagcagtaaagagtagttaaatctgggtttggcccattggattacaaaaaaataattttcttattaaaagaatacttttcttattttaagttctaaaaactataaaaaaaggttttctaaggaataacaacttgcttttttatctcttgaatatactgtgaaatttattatagttttacattcagtaatttggcttactgacccaataatcactaaaggaagtaacatacaatgttctttagtttttaggaataaaagttgtgcaatacagagtacatggataatctatttgcaaagtaattcttttctgaaaaaataatctgaaaatagaatttgctcatattccagaaaactctgagagtgaacttccagaatatttaaatattatagatatcaatttactttgccatgaattgttccaatatgagcaaatttatggggaatgtatattttatttaaatatgacttggaggactctagattatcagttaactatctgtatttgttcttgaaattgtaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccaggtaatgatagtgacaacaataataataattacagataacttttattcagtgtcatctactttctaggtgtttgctatgcacttgacatagtgcttgcatttagtcttcaccagaaccaaaggagcacagatgagaaaactaggacacagtgagttaagagaaatgcctgaatctacacaactattacataggagatttctttagacccagaaatctgattctattgctaatacttttagccattcctcattaagctggtataaaatgaagtgtcaaaataatagtatatagccacaaaactggtctgccaaaggcaatacagcatatcacctttaaaaatcgtatctggttttggtttgtaaaggaaatcattagaagagtttatgactgcttaggaagttgaactggctggagctggtagacacacagtaaaggataagtacatgtgtcttaacctatttattaggcaattattctcacagctaacctagcatgtagttcactataatttcagagagtttgcatagctgtcctcaaattgctcagttgtcaaaaaaatgttttgtgttttttttgttccacctatgatttccaggttactgagtcattccataatctaccaaactggtaaattcagagtttctaaagaccaggagtgtgcttttaatcacatgcagaaccatttaatgtttaggatcaaagtggggttaaggtgggggtggaggtggagcatgcaataatgaccaagtgactcaatcccccagaagacctgtacttataatggaagaactagcagacacagggtagtctcaaacagagtagtgttttattgttgttttcttgcttttctagctgataaattaaccttattcaatatacctgccctactaatccacataaacacataagctgttagagacagttatacatttaagttaaacattcttatgaatgtttatttactatagaaaagacagacaatttttttcactaaataaatgtgcttgagtttctgctatgtgccaagtacaattctaggcacaagagtcaaaatgatctgcaagtggacatgggaagaaggatgagaggatgtgatccagatcacagatggaagctgtgaaattattccatttaagcagacagtaagacagaagatgagagtagaaatgcaagtcggttggtaaatttggtattgggaagttgaggcagctcttgcctgatgatctttcatttttcaagaaaatgtgaggctaggtcatcagttgagagttgagagatacaagggcgagtagggcaaagaagagctcaatgcttgaagggtataaactagttacctcaaagtataaaaacaatctccctaggcagaggcagtaagattgccagaagttatcatttgatcacctgaaatttatgattataagtttaaagaggaattagtcagttggttgtattgttttctatggcagcattgagctctttgggggtagaggctgtgtatgcagatagttgagttaaacctatctaggttttgaaaagtgactatttgaaaatagtgaggcaaacgagttgagggtgtttacaaatgaatgatgactgaggtggaaaataaaaagcaaattggccacatgagggaggtgagagaaagtagtaaggataataagttggagactttgatagaattacagattgctaggttgaacatatcagaataaatgactaggaataataggggtaattttcaatagcacagatagttgaacttatgattttagaggtgatgtaatatttggaatgaaacctacaaaggtggaatgatgaaagtggatgactgggaagtggagggaaagtcatgggaggtgaagaagctaagaaatgaagagactagagtcttggatagattattcttgtcaatgttgaattaaccaaaaatgatgacagaccttggaaagaagagaatatacttagccaagcctaaaactaaatgaggtggagtgattcagaaatcaatacctgacacttcccagtgaagccggtggatagaagctagtatagtatgatggcaggaatatcaaagtgcttggttgatttgaaagcaaatgagtagaaatggtttgcaagtagaatcagggatcaaggagaacacgtatcttttcttgaagctgtgaggtaaatggggtgtgaggaggaaagtcaactttttcttaaaagggctgctgagttattggtggtgtccttagctgacatccaggttttaattggtggaaagaaaaaaaaaagggtgaagtgactgttgggagaagatgattaagataaatgggagttcacagatgacagacgatgggcatcagagggcagggaggaaggcactgatgggttagatgtaagagactgggttgtatctgaggatacaaataaccattcaggaataaaaatctggggaatgtggatgcactgggaagcttagacttgtgatggcaagtgaaacaggtagagatttaagagtgacagatcctttgtgtcttagatgaaggtgagccattaattccacctataatcctgagtattgctacagggcataggctgcctcggtgactacactcacaagagcacaaggtgttgtaacagtttccaaaacatctggtccttcatgcagctcatggtggtgttcaagtggcctaaaattcagtgatgatattttctttcactcaattacgtagcaaagaatgaggtttgaaacagggtgccataattagtttgaatgagggtactatgctgaaaaaatatatgtctatatacacacacgtatctacatgcgtgtgtgtgtatataaaatcttaccgaattgtacatgaggagccttctcagtttcagttatttgtaacattatctattatcattaaatattattcacttgacaaatacttatttaaggactagtggaaagactgtaggcaggggtgtcttccagaagaaattggtatttaaactgatacctagagggtaagaaaagttattagagcaaccaaaaggggaaagggtagttcaagcaagaaaaaaaaaaaaaagtgtttatgtgccaagagttgaagaacagcttggcccttccaagaattgaggaagctggtttggtagaagtattgagggacccagtaaggtgtaaggctggagaaacagtcaggggcgtatcaataaagactttttatgctattttgaggaggtttgttgtcctcttatagtgatggaaagctgttcatcttcagaagagcatcttctgttttgtgttttagaaggattagagcaggcgagattgaagacaaagaggccagttaggaaattgttgatgttttacaagcgagaaatgaaggcagactggattaagtaggaagaaagaaaactaaaaggatttgtgtatagaaatgatggatcttttctgactaattaggaactgtgggtgagaggaaagcaatctggaaggtgtaaacaaattaagaatgaactttcaaaacatgtgccaagtctcctaagaatgtgttgtctccaaagtttatttctgatcatttaaaataacttaccattgcttttgcaatatagatcaacatcggtctagtggtttcaatttatataagaacaaactatattatttttctatcaagcagctctgaagaaggagacatagtctgttacatatatatctttagtgcatactagccctgtcaaaaggactaaatgcctgagcaatttaaagaaaaaaaatcagaggcaaaccgaaaaattatggcctatagggagcatatgcaaatttcacaaaaattaatgaaatgcttttccttagggagcatcttatgatgcaataagccaatatttacattttaaaggagtttttctgttttttttttttttttcagagacttccttcatataggagctggaggacacagcacattggaaatcaagaagaaaataaaagtaaaaacaggaattctaatgtcatcccatgtatgtagtttatttttttattttttgtatcagataaagttaagctcttttggatttgtttaatgtgggacacacagtcatataaattatcttgaagcaagttttcaacatttggttgttaatagggaagaagttactaggtattaaaatactagttattgcaagaacttataatcctgaacatttacaatgggctttggagggtagactgtattcagtgttttctttttaccaattatttcagaaatgggttgtcataaaagagaaatatataaagctgggagaaaaaagagcaagtctcttttacccattttctttcatttttagtttatttcagttatttactccagggtaattgacaaatagtaaaaattacatccatttgttctctatatgtttcctttttatcccttataactgggaggttgaaagtaaggggaaaatactctataaattctaaatcttcaaatttaacagatcaaaatatgcacagtttcaatacttgaattctactatttaagcatattaaaatgatcacatatggtaattttattcagctgcataaactaaaattagcatggataaaatataacacaagttgataaattagatgaccaaataaatcagatcagtgcatggttgacctagttaattttcataggagtccttatgaatgtagtttaaaatatggaattgatggtgatatggttaatcaaatcatttgaccaagttattataaattatagaaattaagaaacagtgagaaattataggtcaaataattttctgggctaaataattaatcaaagctacccatataagattgttaatttaatattactggagtataattgagggaaaaaatctacgctatgtattttgtaaacttatatcaagcagaattataatagtccatgggaaattaaagtatatgtatcaaagattaaataatcatatataatgatatgatatctctttgttgtttgacatggaattatgttccatgttttttcctggaatcctttttcttagacttttgttgtataatttgtttatcgacaagtactgaattttatataggatcttatttcatgtagatcagtaagttttcataatacaatctgtccctttttaaatactttcaaatttccacatgacaatgaagaagaaatttaattttttcaaggaagacttactactgatttatttcacatagatgactataacagagtgccacttaaacatgagctggaaatgagtaaagagagtgagcatgattcagatgaatcctctgatgatgacagtgattcagaggaaccaagcaaatacatcaatgcatcttttataatggtaggtacttaaattgccaaaacccaagatccaaacattttaaaataatatctatgttattagggccattcattaagcgattttataaaagaataatgagcttggtcataactacatatagattgacatgagagtttcaatttcaatgctacaatttaacttaatgaaagatttaaaaatactataacctaataacctgagacaaaataagataatgctattggttatattttatgacaaatatagctataatcacatcaattttaaaaatagtaaaatttgagcaaatacaagtatttgaaaatgtttatacatactcagatacccaaattgtaggcaatgacaaatttgtatatttgtatggttagaaacttttcattcagataaactgaattattaggtgagtctgtgtcatatccccccacttttttaattaactgagaattcaaacaatgaaactttagtcatttattaaatatttattatttatacactgttggatttacttattttccaaagtttcctaaagcacacattcatagaatattagtttaattaggaaatataataagaatgtaaagacactaattaaaattagtatagacacgatgaaggtaatttgaaatgcttaagtaattcctttttacaatcacattaacctttatagagaaacaaaaatgtgtgtcttttgtggaaaggaaaatttgtttcgcaagatatgttgtaatcttgatttcacattattagctaagaattactattatctgtataattattttacatatagctattacattgtttcttgtaagaaacataagaatattactatttgtatgtaacagcattgatatcaaactgactatatttccaaatggttactttaagaatctactgagctctcttctgtagtaacgaagtcccaccctttttttgtctaaaaagagctactggaaacctgaagtgatgattgctgctcagggaccactgaaggagaccattggtgacttttggcagatgatcttccaaagaaaagtcaaagttattgttatgctgacagaactgaaacatggagaccaggtttgtacttttgaggattttcttttaagcctttctgtcataaaacgtcattctctagtcttggattgcttgcttcatcgccatacccacgtctttttttatccctccatcacataattctgtctgctcagtcttacccctttcaccctggtgttggcctccatcagctgtgtctggattctgacagtctctcctgtttgtcccctccagtcttgcatgctgctcacagattagccaggatgcagcaatgtcagcgtcacagcaaataacagctacattttcacgctgttttcctcattttctcaagataaaagccaagatctttttgtgatatccagcaccctggacaatcaccccctcatgtgtctttcatcttcctcccatttttatgttttccatcctctccactctggacaagcaggtttcatgcccaagcctaaacacgccatttgcattgtcatcactgagtctaaacttattgatattccatgtaactaaatgtgtgctgtcttccagttttgaccctattcttttaacaagaccaaactcctgaaaaatgtatctatatcatcctttctttattcccatataatatttattgccataaaagtctatagttgaaggtgaatctaagctataatttgatttttttacttaatgcttgtgacagatattttatccttttcttaatgtcttcagttattattaaaatttccctggtggtagatctcactcagctttagcaccaaccacattatctgacatatgttcaagcctattcagtgaataaccttataagtatgcaaaagatttatgcttttttatgcccctctctctcccctaaatctcactctttctcaccctcacctggtccccttcccctgtacatggaaagttgctttttatgttttttgttttaaaggaatataagtccagatttctagcatggaattcccacaatcctttccttcatataaattgtgaaagctgggaaacaggatggaagtaccggcaggactccctgtctttgtcagaaattgtggggttgtagttggtagacaacagtttgtagtaagaagaaacacttttgtggttcatctactcttcaatctggccctttccttagctatgtagacaaaatatataaagctgcttatggtgttggtcaacaagatgacagagacaaagctccaaaagatgcagcctccttcctcaagaaccactgaagggacagtgggacctgagttattgaaagggtcatgaataacattgactcatgccagccataaatattgaagaggtcatgataagcatgtggaaaagaggagcaaacctcaaagacctacactaaggaaaacagctgttccgggggtgtcccagtcacctcgattgtgctcagcttcccttttcttacacaaggaaacaccacatatttattaaatgggtcgccagcacttaaatagattctggatttttataagtaggtttcaattttagaacacaataattttcatttaatagaaaagaggcacagacagagaaagaaagggagaaagagggagactgatcctttgcatatttcaaataggaaacaaattgttgaattgtcttcttttatctaggaaatctgtgctcagtactggggagaaggaaagcaaacatatggagatattgaagttgacctgaaagacacagacaaatcttcaacttatacccttcgtgtctttgaactgagacattccaaggtatggaaacaatttggggagtatatttctttgatataatggatctggtagcaaaatgaatataaattactctatgcaggcaaggccatcatataaataatgtttcagaataacattttaaaattatttaaatagaagtaactgtgaagaaaatatgactatcaaattagaaaataagctgaacttcactccagttaatgctctcttcaattctgattttagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcaggtgcgtgggatttggtagaatgtgctctcaaaatcataatgcttgacttctcggttcacatgttgtcttatctagttatcctcatatatgaaacacataaccacagtaaaaacttcttatggagtcggtcactctcttggttgtttccacaacacaactattgtagaaatataatagaagtgattatattatagtgcaataattttaagttgtgttttttaatacttggtgtcatgtcatctttgattccttggtagctaacattgagccaggaatgtcatttgtgtgaatgaattaatgaatggaagggtgtgtgaacagataggtagatgggtatcaccttacacatatacccatatacattgatctactctattaggtgtcacaaagacacctaatatgtttaatgaacacaaagtttattaaacatattttaagttaaatattaactgaaatcacaaagcttagcaattttgatttgaaactcattatttaattttctaaactgaaccaaaggcaaagattgtggtaatatcaataatactactagattttattagtttcttcatctgtgataggtgcttacatattcaccttaaataagcaatataattgaaagaaagatatataatataaaagtttacatgaaaaagaatattgaagtaaatgagaaacgaaaaatagtaaagtaaaatgagaaatgtttatctagtgaaaaacttttggaatttttgaaaaagtctaattgttattattggaattgcatatactagaatcaagccttaagaaatatatgaattttcagcatttatgtggaaagaaagctgaggaagggaagtttacactgtaaaactatatatgtttcttagaatatgatttatgtacaataactaaagtgtcctgctgataacatattgtttaaattgaatctttatgataatgctttatacttctcattgtttggtaaactatttgattgccctctttttagtgaataattctactaggtattacttttctactgatgcagaagtgaaaacatttgtgaaacgtggtagagaggcagaagagtgaagaagagcatgtgttctagtaatttacaaaatattaggtctaatatttctgattacatcagctttctcttctccaaatcttggtttccttatctatcatactggcattctgatattggtttcaacaacttcagatgtaaataaaaatgcattaaaatccataaaatactaaataaaagaaaatatatttgtaaagtcgaagacaaataagttttcaattccaggattatcacactcttaaattgaaaaatttgcctaaaaatgcatttagcgtaaataatttggttcttgaaagaggttggaataagataattatgataaacatgaagcaaaaaatatattctctctcttcctgtttttattctaatatcaccctttttggtgagaagtaggattattttctatcttttctttcttttatagggatggatctcagcaaacgggaatattttgtgctttgttaaatctcttagaaagtgcggaaacagaagaggtagtggatatttttcaagtggtaaaagctctacgcaaagctaggccaggcatggtttccacattcgtaagtatccttcaccattgcttttaacatgctcggaattttttttttctttttgacggtttccttttttcttttctcctctcctttcctctcgtttgttcttttttcccctttccttttctcttctctattttctttcctattcttttagcttttctacttttacatgataattcacattaaattattataagtctaaataagagcctaaagtttactagcactttgttgtgacagttcatgaagagcctttccctaaatgctcatgaatttcttaattttctttccttcactcctgtatcgatttgtgttgtgtaacaaaccacccccaaatttgggagcctaaacaaataacatttattatggttcagtagtctaatgatatgctggaatgttctgctggtgccctcaggctcaggcaatagagaccaggctgactcatgtgtctgccttcagctgatgtgtgccctacagtttggctggtctaaagtgacctacactgccagtaggctggcatgtggctgccatttagctatggcaacaacagtgagtgggccacatgtccctcctcatccagaagactagcccaggcctattcacattaaagcagcaagttccacaagggaaagaagacttgtgtgagaccacttgaggcccaggcttaaaagtgacacacatgtcttcttctgtatgttattagccaaataaataagtcataaagcctgcccagattcaaggggtagggaaatagactccacttcttgagagggcctgcaaattcacattgcaaagaaatgtggatacaggaaggaaaataagttttatattcttgtaatcgatctatcgtgtataccctctatgtggtagtaactgtagatggtcatctgggaattaatccttattcacagtgtaaacttaattactcactaaaatatataaagcttttaatcatgtatgatattgagatttcatatcttggtacttaaaaatgtatcaaatgcttgctatgtgctcttgctataaagagctaattggtatgagggaaagccaggtatttactaatcaatgtagtgagtaaaatgacagaaaaattataagaagaacatgaatgagggcatttaatttaaactttaggaatcaagaaacgcttctcgaagcagtgattcctgccctgattcttaaataatgtgtaggcattagacaggaggataagtacaaaacgtggcatcatgagcaaaggcatggaaatggcccatgagcggagtgaacactggtttggggttgctccaaggtaaagttcaaaaagtatcctgcagtcaaccctttagcaccataaagaaactaaattatttagatgtttttatgagaacatatcaaaaagtacttttctgtcatccaatacttccacaaataaatcattagttcttgctaatcttcatctggcataaaaataatgacatcaactttcttcatgtaatttcccacttaattcctttactaggagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaa

SEQ ID NO: 2570 - DNA, 118509 bp, Homo sapiens; identical to SEQ ID NO: 2569

SEQ ID NO: 2571 - DNA, 107145 bp, Homo sapiens
ccacaatgacatgcagacctgcatattggagctggacggagaaactgggctaatgtgacagacagcaacaagagtaaggcagttgcttcgctattgagagaaagaaccatatgagtaagacaaaaactgttgctcttgaggaactggcactaggaagcatcctcagaacaagagaaggagtccttaaataatcagaatctaagagcagcctcagtgaatgagaggagcgatgggggagagcctgactggctgcttctcagtggctgaggggagagccctggagctcatctttttttttttttttttttttttttgagacagggtctggctctgtcccccaggccggagggcagtggcgtgatctccgctcaccacaacctccgccttccaggctcaagtgatcctcccacctcagtcccggtatctgggactacaggcgcgcaccaccatgtcgggctaatttttgtatattttatagagatggggcttcgccatgttgcccaggctggtctcaaactcctggactcaaacgattagcccgtcttcacctcccagagtgctgggattacaggcatgagccaccatgcccagcccaggagcacatctaaaaatgctctgtgctctggctcaggaaggaatgcatgtagccaagtgggggccaaagggtgggggcaaagctgcccattaagtaccttggaggtgaaggccaggtcagcagtggggatgtgggtaccctaattgtggacattagccacagatgctcctgtcatctgtgcagtggctaagatcttacgcagagtgcaccctaggagctgtgctggggatgccatcacccccctgcactgacagcagcctgattgccggctcctgggagctgggcaaggtgcaagagcctgggaggtcctctgaggacagtgtgctaggtgaggaagggcagcagattgtggtgactttctaaccttcctgtgttgtctcacagagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggtacatactgccctttcctgttgtggccccatgcaaacccctgccctccctgctgcacttggagccactcctttcaggatgggctttccttacagtgctcagctgggtttgcttagcctttggtgcctgtcaagactgcagcagatgaactggcaaaagtgagccccctaggtcaaacgtcttgaatttttctgattttgatgaaacgctattgcctgtataattacacaagaaatgtttctgtcacttgtttgtgtgaagactgataataataccttcctttttgagtccccctgtgccagggatgatgcagagtacttttacaagcactcttgcctttatcaacccaaggagaaaggccgagttagcccatttatgaagtgaaaaaatgggggctctgtgaggttgggtagcttgtgtatgtgcctgtggttcatgaggccaagacagctgaggcgtgcctggccgtgtggctgtttctcatgatgccgcagccgttcttcagcagataccttatgctcagtaaccacacagaatttgaggtggccataatttttattcttccttatagtttgatgtaactttttttttttttttttttgagatggagtcttgctctgtcagccaggctgtagtccaatggcgtgatcttggctcactgcaacccctgcctcccgcattcaagctgttcttatgtctcagcctccagagtagctgggattacaggtgcccaccactgtgcccggctaatttttgtatttttaatagagatggggtttcaccatgttggtcaggttggtctctaacataatccacctgccttgacctcccaaagtgctgggattacaggcgtgagccactgcgtccggcaacataacatatttttatgttttttgaaatgtttcaaatgaaagcaacttatttgagatggccatttcatgggttgattctcatttgggtttctttctcacattttgaatgcagcacatttgggaggcttttttttttttttttttttcagatggagtctcactctgtcgcccaggctgatgtgcagtggtgtaatctcagctcactgcaacctctgctgcctgagttcaagtgattctcctgcctcagcctcctgagtagctgggattacaggcgcctgccactgtgcccagctaattttttttttttttttgagacgatgtctcgctctgtcgcccaggctggagtgcagtggcgcaatctgggctcactgcaagctctgcctcctgggttcacgccgttctcctgcctcagcctgccgagtagctgggactacaggcacccactaccacgcccagctaattttttgtatttttagtagagatggggtttcaccatgttagccaggatggtcttgatctcctgacgttgtgatctgcccgcctcggcctcccaaagtgctgagattacaggtgtgagccaccacacccggctgcgcccagctaatttttgtatttttagtagagacagggttcatcatcttggccaggctggccttgaactcctgaccttgtgatccacctgcctcagcctcccaaagtgttgggattacaggcgtgagccaccgcgccccgccgggagttttataaactgatgtttgctgtgcagtagattctttcctggaggcagggatagtgattagccatagattaggttaactcattgaattcagccaagtattttcagggtttgacctgtgagccactggtattgcatgaggtccctctctgtggtatgtgcttttattagaagttaggtttccagccaagcgtggtggctcacacctgtaatcccagcacttcgggaggattgcttgggcccaagagttcaagactagcctgggcaacatagtgacttgtctctacacaaaataaaaaaaattagccaggtgtgatgaagcacacttgtggtcccggttgcttgggaggctgaggcaggaggagctcttaagcccaggagttcggtgctgcactgagctaggatcgctccactgcacaccagcctgggcaacagagtaaaatccaaagaaaaacacaaaaaaacaacaaagttaggtttcctagtgagtattaggaaaaaatgtataaccttcacgtcaaacccatgacttcacagcttattaacattgcaacttcagtactttagagtagcagccagtgtgtagttgatgtgcccgcatctgttgaatgtgtgtgtgagttagcgaatgagcttcctagcttcttcagcatattgctgtctctctctttttttttttttttttgagacggagtctcgctctgtcacccagggtggagtgcagtggcgcagtcttggctcactgcaagctccgcctggcgggttcatgccattctcctgcctcagcctcgcgagtagctgggactacaggcgcctgacaccatgcccggctaattttttgtatttttagtagagacagggtttcaccgtgttagccaggatggtctcaatctcgcctcccaaagtgctgggattataggcgtgagccactgcaccctgccccgctgccttctttttatataacttaaaaaaaaatctgtttgcaaaagtatcacatggttatttccttaaatttataaaatacagaaatagacaaaaaaaaaaaagagatctaagtccgacatgctaagagaacagtgacgtgggtgtccagtctgcttctaagtttggttgtctctgtcaaaatttgaccttctgtggctttattttaatagatgaaatgcattctgtttcagaggacagttttttatactagtagttgaaatgacagttgtcatgctcaaaaaattaatgtctgtctgaaatatactaaccataataggaatcccatccatctacactatttttttaatccacattttccataaggcttcacatgttccattgcaagattttacttggcacttgtcttttatagcctaggtaatatggcaatttaaaaatagaacaggtgacaactttcttttcttttgacataatatggtatgtaggtgaaaggatttactatgtaaaatccaggagctgtagtttaatacattttacaactcatttctgttagagtgatgaactcaaactggtttctcctggtgatgggttatggacgaatttttattattacatcagtggttttaggtttccatctagaggctcctggattaaaatacaattaaatttaaccatagcaatgccagtactgtagaatacgttttaaaatgtgcattatcggccgggtgcggtggctcacgcctgtaagtcccagtactttgagaggccaaggcgggcggatcacaaggtcaggagatcgggaccatcctggctaacatggtgaaaccccgtctctactaaaaatacaaaaaattagccgggcgtggtggcgggcacctgtagtcccagctattcgggaggctgaggcaggagaactgtgtgaacccaggaggtggagcttgcagtgagccgagatcacaccattgcactccagcctgggcgacagagtgagactccatctcaaaaaaaaaaaaaaaatgtggattatcatacacatttgtgtcaaaaataatggattatcccaaagtttggcctgaaattcatgaaaatgctcattgcatttgtggcttagtcatgttgcatgtattttttttttcctactcttcagcctacaaattttattttacacacctttattgcttttttggtgggataattgttaaaaaaaaaagataaactgtgtctaaagtttcctcttttgataagcctaatacaaacccatttggattgtacactgaacttctagaaagaaggaaagagcaggctgccgcagatctgcagccaggtggcacctctcctgggatcagtgctttttacttgttaacatataagcctttaaaagagttgtccccagcctcgtgtctgagcatgttgtctggggccagctgctgagaagtggtagcgtgctcttccagctgtgtgagtttacgcaagtcacccaacctgtgtgggccaaaatgtcccctctgtaaagcaggcactgaacccacacacagcgaactgaattagtgcacgtgcacggacagtgctgtacagagaaagctcaataaatgtcacttgctgttccctagtgacactctgtgccccggattccccatccattaggtggggtgattgtgcttctcacaggtggttatgaggaaggtgactgtgtggtcatctagaggtggccacctgtggaagggcttcagaaaagatgctcactgacatcagagcacccatgggccctggtgggcaggccctggtgaccctcttctctgtgcaggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggtaagagagaaaacgtgtttttctttctgtttggatgagctgaagagaagcatgtggcaagaggaagcttctcacgcatgtgtgccgacctcgctgtcacacccccacacactgtgataggcccctcttctctacgggagaggacctgtttcctctcctctttgtctttcctctggactttgccactggataaaagcattgggtggattgataagcaggtgacacctcatggtagtactgtttggaggaccttgaggcccagggaacgaggcatgggggcagtgtgaggggagcactgatgtgtgcctttataaggagacagagaaatctccggtgtcttacttaggttgttcattctttcgttgctgtagacagagctggtattaggtgaaatgcccatgaagagcatgaaggctgtagagaacagcttgtttaccgcccagtggcgttcattcattcatgcaggcatgcatgcactcagcaagccagcactgagttaaggatctgcttgcagtctcaagacaggccctatcaccatccttgccaatggggatctgacagtcctaacaaaagagacacacagatgggtccggttgcctcaaaagaggaatcactacattgggtggaaggagcatggtatagaaatatggttacaagtaggctgcggtcaatcctcaacagcctcagtgcccccacgctttggaaggagaccagagacaagccctcaaagcttccttgactgttactaatagtctatggagtttttcatcacttaaactttattattaaataatacttaactgtatttgggtgctagttttgggtgctttctttcttttaataaagaaaaggaatttatttctcatggttaggaaggctgagaagtctaagtttgaggggccacatctggtgagagctttcttgcaggtggggacttggactctgaacagagtccaaaggtggtacagggcatcacatggcgagagggctgagcatcagttttgggtgctttcttagtggtaaacctacattttgaaacaaatacagtaagcattggccttggtctttatctgattctcaagttgatggaccctcttagaaaaatttacatacagcccgggtgtggtggctcatacctgtaatcctcgcactttgggaagccaaagtgggaggatcacttgagcccaggagcttgagactagcctaggcaacatggggagaccccacctataccaaaaaaatttaaaattaaattaaccaggcgtgatgacgcatgctactcaagaggctgtgaggcaagaggatcatttgagctcagggttgaggctgtggtgagccagtgtactccagcttgggaatagagtgagatcctatctcaaaaagaaaagaaaaaattacatacatgtaattgtaagtcatttcagggggttcacagacttcctcaagcttcactgcgccaagccatggggaggtatctattctgagaagaggtagcgaggtgaatgggtagggtgaggggtgggggtggggcaggggggcagttatcctgtttcaaggtctgagtccactgggtagtgccaccaggcttccttctggtacctcgtccttcctctggcatctctcgcagcacagcctccccgtctctacctgagagtctgcctgcccttcagaggttcaaatccagagcccctcctctgtcttctacaagaacactggctcaggttaagaaggatgctctccagcccacctaaacctggtgcccagagagactctggtagtgaagacagcagctgttgctgctctccagaaaatgctggcgaggtctgcacctcctcagatagttactgtaggatactgttttatgaagctgacaaaaattaatttgaaccatatttattagagcaaattcctagcagttgacatagaaataatttcttgtggcttgaggccgggtgcggtggctcacgcctgtaattccagcactttgggaggccgaggcaggcagatcacctgaggtcaggagttcaagaccagcctggccaatatgatgaaaccccgtctctactaaaaataacaaaaattagccgggcatggtggcgggcgcctgtagtcccagctactcgggaggctgaggcaggagaatcacttgaacccgggaggcagaggttgcattgagccaagattgtgccagtgcactccagtctgggcaacagagcgagactctgtctcacacacaaaacaaaacaaaataaaaaagaaataatttcttgtggcttgaaaaaaatgcatacacccagaagctgtttgattagtgtcttttttcacttcctttacacatagaaatacccacattgatttctaggggtccagcagactagatacccttaactattccttcctccaagggaaacaactgaatttactagataataaaaaaataagccaggcgtggtggcttacggctataatcccagcactttgggaggccgaggtggttggatcacctgaggtcaggagttagagaccagcctggccaacgtgatgaaaccccgtctctactaaaaatgcaaaaaattagcctggcgtggtggcacgcgcctataatcccagctacttgggaggctgaggcaggagaattgcttgaacctgggaggtggaggttgcagtgagccgagatggggccgctgcactccagcctgggcaacaagagcaaaactccgtctcaaaaaaaagatgaaatcttttaaagtgtatggctgagatggcatgaaagggagtaagtcgtagtggtgaaaaaccaattgaaagctggaatcctgagaaatacatgggcttgaaagtcagcatttgctgtgggtatttcttctgatcctgggagacaagagacaacctagcccaggatggggtctgcacataatgctgggactgtaagtgacgacactagtaaggttgaagtggaaactccgagcaccgaaagggacagcagggatctgcagctctcgtggccttggggtggagatgcagggagtacagcttcccagagacttggtagctgtcagccagctgccacatgagctggagtgtgaataaatgttggtgtggtatgaacagcccaagcctggaagttactttacagtggtccaggattgctggtaaagtcaggcagcatgcagatcacctctggaaaccttcaatctgacctcagagaattcgaatagataaaatccccccaaatgagcagctcacagtaaaaaaagtcataaaacacaaggttcatgacagcacagttaaaagccagcagaagcagtagacagaatcacataacaaagatatttaaattttcaaaaaagaatatagagtaactttgttaactgtgcttaaagaagctttgtaaaagtttgaaattgggagttaaggattaatactctaaagaatgataattcagatttgaaaaaatatcaaaactagaaacaaaaactttttttagagatgatagctgagaaattctcagaattactgaaaaatactagtgttcagcaaggaaacgtatcagatttcccaagtaagatgttgaaaaatccttctctggttatagtataatgacagctacagaacatcaaagaaaaagtgatctcaaacacaaaacacaggactttgttgaaaatggtctgtgagatgttataatgtgtaattctggattctgggtagagactacaatgaatctatgtactccttacccagatgcgcagttaatcagcattttgccactctgacttcattatgccttctttttcttccactttctcttccctctttttgatgcagtattttagtatgggtcccagacaatgtgctttttgtcttagaatattccaataagtgtctctaaaaatagtcatccattatcttctgtagccacagttccattgtcacatccatgaagactgacggtaatagtaatttcttaccgactaatgccagccaatctctttttatggttgggttattccaatcaggacccaaaaatcttcacaaattcatagccacattattacactgccatccagtgatctatgcagcaccagcttaagataaactcggtgtctcagggcagtaattctcaacagttttggacttaggcccctttatacttaaaaatttaggaccccgaagtgtgcttttttatgcagacttacatcagtacttgctgtattgaaattcaaactgagaaaattttttaaatgcttattgtcattttaaaaatgtaaactctcattagattacataaattgcatattttaacatatattagagaatgtaacaaataatacacttttacattagataatgtaacataaattacatatgtaaaaataactattttccaaaataaaacattgttgcccaggctggagtgcagtggtgagatcttggctcactgaaacctctgcctccccagttcaagcgattctcctgccccagcctcccaaataactgggattacaggtgcctgccaccacatctggctaatttttttgtatttcttttagtagagatggggtttcaccatgttggccaggctggtctcgaactcctgacctcaggtgatctgcccgcctcggcctcccaaagttttgggattatgggcgtgagccagcgcacccggccaacatatttcttaagaagagtgggtcactcacacctctccagatctctctgtaaaagcagtgggagtctcatctgcattcagtctgttgtcataggttgtctggttgaagttattgaagaaaattcaactttttacagataatgtagttggaaaaaggacgaatttttttttttttgagacggagtcttagttggaaaaaggaataatttgtctttttgtgttttttttgagacagagtctcactctgtctcaaaaaaaaatctcgctctgtctcgctgtgtccctcatgatctcggctcactgcaacctctgcttcctgggttcaagtgattctcctgcctcagcctcccgagtagctggaactacaggtgggtgccaccacgccaggctaattttttgtatttttagtagagtcggggtttcactgtgttagccaggatggtctcgatctcctgacctcgtgattcgcctgccttagcctcccaaagtgctggaattacagccgtgagccaccgtgccctgccaggaagaatattttaatagcctcttcaaatcctgatagatcttctctgagagtacaccaacgcgggagagtttcttaatggttagttgcgatgtagagtctgaaactgtatcactgaacttaccctactctgttccgttaaaatccacaggctccagctcaccccatgaatggattctctacttatacatggtttgctagtgtcattcataggtcattttgcaaatattgattcactgagtatcttctggatgttgacagttttattaatataaaaaatgatatttgtttatatcagcactgatctcatcagaaagctctttaaatgtgtaggatctttcaagccaacagcagcaaatgcaaattttctaaagttttcttttttgcttgaaagcttagattttatgattagccacagattgtgtcacttgttttctttgaagcaacatgttaatttgctgtgcaaactctgccagctagttagctcttctgaacagcacccccattctacttgtttttgctgaactcactggatactcttggacatagaaaggtattctcagaaatgcaactttactggagaatgccctcacgtgaggtttattccacactgcctgggggatcaaacaggataatgagtcatattttttgtatttactttaaatattaaagtaaaattgggggagtgggcatggtggcccacacctgtaatcccagcactttgggaggccaaggtgggtggattacttgagcccaggagttcaagaccagcctgggcaacatggtgagatcccgtctctacagaagatacaaaaattagctgagcgtgatagtgtacacctgtagtcccagccactccggaggctgaggcaagaggattgcttgagcctgggaggcggaggttgcagtgagccaagattacaccactgcactccagcctgggcgacagagtgagaccctgtctcagtcaattgaccaatcactcaatatttttttaaaagaaatctaaaaaataaaataaaattgtcactaggcttaagttatgcttctagtcatctaggaaacacctcaccaggctataatagtgaagtctaaattttcatcgacaaagacagaaagatctcaaatgtcccgttatttcagtctattgtaggaactacattctaaacatcttctcttccttctttcaaacccccaaaccttttttgtagtgggaagtgagaacagtttgcagagcctgcccttaggtcactgacaagcctttctgcctctagctcagcagttcttccataggcctcacctctcgtaggagctgtgaggacacatcctgcagagcccacccctgcatgccccggtccagttatttgagcccctctatgctggttccacgcctgtcgatggggcatgggcagggcactaccaggttcacagggaacttactggaggcattgaattcagcgctaaggacagtgcctggccatgctaggcactcaggtgttaacatgtgttccttaagtaaactccaagttgatttccggttgtgaagtgagtctgatatctgtttgtcttgcatgcctcacctagaggtgtaattttaggttttattaaaaatgccaaatatcttcataaattagccttcacccagtgaccattagcaactggcccagaaagccagacttgtgattccactcatagacaggcaggtggaaatggctatcccagaggtttccaagggaggccaggcaaagcctcagctcttccaggaggcccctccctcagctagttgccaacctggtctgatccaggtgctgcattcactctcatgtactctttgtcttgtagctgaatcgtaagtcaggtcactgcctactcttctgttccccgggaactcctggagagcagcggactattgtagcaggaggtagtcttcgtgtcctcgtacctggcacagggcctgggcagcatgggcttggcatttcacctgcttattattacaagcacatttgtgggttccagcctggggctgggtatcagttacctggccctggtctcctgccacgtgcatttttcctgtaccgagtgtgcttgctctgagataatgcttggtgtgaaacaggagtgatgatgtttcaatctgggaggcactggtgaaaacacgatgaggaaaagtactggaaatgttaacaaaacggaaggttttagattttctgcagatggcatagattcattgctgaatctctcaattcttgtgtttccaggtatgaaaacagagctgtatccagcaaggctggcacacagtggtctagcagtatcactggtgtgctctctccaaatgtgtttataggtgtttactttcaatcattataatcattataatttgttctctcagcccccataccaactagggttattaggtgacataacagtgaaatctttgtgtcgttcatttgctaaggtctccatcaactcagcttggctatattgtaaacaggagcagacctctaaacccagtccctgtgagtgacccgactcaggagacgtggagtagccaagcatgatgaagtgcagcttccagagctggcggttgttgaagtcaggaacattcacccaaagatgtaacgtgatctgaacacaagtagtgtccgtgtagttgacagagggaagcatggattcacacacgcatggttgtagcaagacttattaaatgtgaacattacatttaggaaaggtaataatggcatcaacctcagtgatcttgtgttgggggcttgctgtacatctctgctgacatcactctctatgatgactgggacacttctaggttttcgtggtattatctaaagtaattgacaagtttgcctacatttattaggaagacaaaaaaccttaactctgatagggtcttgcaagtggagaaattgtgtgtattaattagaatggaaggtttctccaaataggtaagaaaattgttatcctttagcatcgagggacttgatgtatctaaactgtttgaactgtaagggctttcattacattttaaaagtataattgtgagaaatgactctcaaacgtgcagttactgctttgtctctgtgcacacctgtcaccctgtctttgcagcccttctaaacttgccattttagaggggagatgtgctgaaatccatgtccgtgtagtcagagttctgatgcactgtgtgccttgagacatacagggagcagcacttctcataagctgaacactctgggcctgtgaagagggatgtgtgcgtggtggggggaaatggggaggggggagggaatccctctgggaattttctagtctttagcaattcactacatcttctgtttatcttttactttttcttaaccaggaaaatgaacacttgaaaaagttccaagtgacgtgggaactgcataataaacacctgtttgaaaatctggtcttttcggagccacttcttcagagcaacttgcccgcactggtgtcacagatcaggtattttgccttaacccgtatgtgtctttgtggtgtgacagcacagtcttttctcctgactggtgtgcgtgtacccgagtaccactgagtatgaaagttcttgcaggaaaaataacagggcttaaagaaaaagatagtttgggccaaaagctcaaaacctgagaagcaatacaattaaacttttaaatgataagtcaatataaatgctactaagatttaacaccacaaattcctcatacagaaaagctacagtaaatatagcacttttccttgacaagacctatccttggccgggcagctgtggtgtggttcatgctatggctcttggacatgtaggggaaatggaggagggaagaggcccaggtctgagggtgcccaaggccctccggatacagcttggtgtttcccacacattccgttgctacccgaggctctgttgctctgtctcctggtgtagcgcatccatgtggcttcttcacgcttgggaagctggctgggttctatgctttcactgagaaaaaggggtgcagagtgcagcagtcactcactgagtatttgctcggggtcagagtgagaagatttaggctgggcatgtgtttgccctgtggtaccatgttcagttagaaggcatgttcctcctgatgtgacgttactcagcagaacgctgttccctgcactgagtcatgcatgagctaccacaggtctgcagtttggtgattttgttctttggtgttttattctatttaccacatgtgagcacattcccataatacagacccatcgtgacagcagccatctacatttgaccacgttaacctatacttaggggtgtggtggctcacgcctgtaattccaacactttgggaggccttaagcaggcggatcacctgaggtcaggagtttgagaccagccttgccaacatggtaaaaccccgtctctactaaaaatataaaaattagccgggcttggtggcacatacctgtgatcctggctacttgggagtctgaggcaagagaattgcttgaaccccagaggcagaggttgcagtgagccaagagtgcaccactgcactctagcctgggtgatagagcgagatgctgtctcgggggaaaaaaagtcgttagcttcacaaagcaagggaataaattgttgttctgttgactacaccagttattgctattttatttattttatttttgagacagtgtcttgctctgtcacccaggctggagtgcagtggcacaatctcagctcactgcaacctccacctcccaggttcaagcgattctcctgcctcagccttctgagtagctgggattgggattacaggcttgcaccaccacgcctggctaatttttgtatttttagtagagacggggtttcaccatgttggccagggtggtcttgaactcctgacgtcaagtgatccacctgcctcagcctcccaaagtgctaggattacaggcatgacccaccatgcccaatctgctttttttctcttaaaatccgtatattaggactggtacggtggctcacacctgtaatcccagcactttgggaggccgaggcgggcagatcacgaggtcagatcaagaccatcctggctaacacggtgaaacctcgtctctactaaaaatacaaaaaattagccgggcgtagtggcgcatgcctgtagtcccagctacttgggaggctgaggcagaagaatggcgtgaacccaggaggcggagtttgcagtgagctgaaatcgtgccactgcactccatcctggaccacagagcgagactccatctgaaaacaaaatacaaaaacaaacaaacaaaaagaatacgtgtattgacccagtctttgtttcctgtattcccaaattttatttgaggggtcctgaccatctccacttcataaccttacctctagagaaagcaattaggtaaaagagaattgaggacaaaaagatcagaagctacacgtgctggctcatgcctctagccccggctacttgggaggctgaggcaggaggattgcttaagcctaggagctggagaccagactgggtaacagcgagaccccatctcttaaaaaagaaaaaaaaagggccaggtgcggtggctcatgcctgtaatgccagcactttgggaggtcgaggcgggccaggtgcagtggctcatgcctgtaatgccagcactttgggaggtcgaggcgggcagatcatgaggtcaggagatcgaaaccatcctggctaacatggtgaaaccccgtctctactaaaaatacaaaaaaaaaaaaaaaaaaaattagctgggcatggtggcgggcacctgaagtcccagctacccgggaggctgaggcaggagaatggcgtgaacctgggagcggaggttgcagtgagccgagatcacgccactacactccagcctgggggacagagcgagactccatctcaaaaaaacacacaaaaaaatcagaacaaggtgttacggggcgtgtggccagctggcaggtgggctgcagacccttccagtgttccctgtgccctggcctgctccttagccattccttcccttctgtggccactgtgtatcaagattggaaagtccttactctgacccttgcagaagaaaaggcatcggaagagaattcacagtggtgaatctggaatgtggagtaggctttgtccctggttatgacgttcagattcatcaaaagcacttttcatgagaagatatgcatcttgggagaggggctctgaaaacaagattccagggaatctaccttaaaaaaaaatattttactggtaagccagtgagttccgtcagcctgtcagactgtgggtgggtgactgaaaccggaagtgcatcataaaactcccatctttttttttttttttttggagacagagtcttgttctgtcgcccaggctggagtgcagtggtgagatcttggctcactgcaagctctgcctctcaggttcatgccattctcctgcctcagcctcccgagtagctgggactacaggcgcccgccaccacacccggctaatttttttttgtatttttagtagagacggggtttcaccgtgaaaactcccatctttttctgtgccctagttctggattttccgtttgctcattgggtatgatggtcagactccaaccatgagccacgtctctagtgtggatgctggatctcaagctgcagtctcacttctcacttttgggacccacaggcagttgagggagaaggataaacacagacagggacagaatgaggccaaccagcacgttccctgagcagcactgacgacgccaggacacgccatgcctttgtgctctgcagctgactcccttgtcagcctgagactaattcaagataattcagatttgcattgctaatgtacagatacgcatttaacaattcataaaaattttgctactgattacatacaaacaccccttaaagcttctgcatcctatgaaatacatatggtacaattcacccacttaaaatgtacaattcaatgacttttgatatatttcattttttaaaaattatggtaaagtatatataacataaagcttaccattttaactagtgtatatttcaataacattaattatattcatagtgtttataaccattaccaccatgtactttaaaattttttcctcacccgaaacagtaactctaccattaaacagtaactctccattgtccccttcttttttccccatagcctttgaaagtctgtaatgggcagtttccttcccttgactccccaccattttttgtcttaaaatgtatctatgaaagaactaggccatctgtcctgggggtgctttggtctggatcctgcgtgggcgtgttcacagagcagtttggccacctccatcctctgtcctgcctgagaattggtggtaggatctgaaggttctggacggctctgctcagatcccctggcaggccaaggcgtaggcggggggtgtttctatcagggggtgcatccctcaggcctgcttctctttgttgtgggtatcagtagcccaatgtgggcttcactttaaatatgtattaattaggctaataaaacttacccaaaccaatgttatttcattctctttatcaataataatgtttcacatacacattggtaacattacagtaagcatattttcatgctgctgtcttgtatttgcaagctcaatatttagatggaaacctgtttgctgagccattgatttaattcaaccctgtggatagtccctgtgactcttttgatcctagcacagctttgcttgcagggaagccctgtgcctgcagattgcttttcaattataccaacaaagatatccacaaaccccctcccccacccactttgctctcccttggctcaaaataatctgaattctataacttggaagagataaattcttacttccaggaggagcgggacaaggaacacatgacagggtataatgccgcatcccaacgttccaggtggagcaagtaggggcaggatggaattgggtagaagctggattctgtgtgaagaatggaaaccagtcacggaagagcaaggctggcagagaagaagtgggagaaaaactacttcacgggctgcagtgtggcagatccctggcgccactggagtccatgtcttaaggagttttgtctcctgaggggcagaaacagccttaggagaacagctttgatgttttgaagtagcctcaatccatgtgcgtcagtattgtttctttcctttgggcttccctaaatgactgcccagttacacctaacctctgctgccttccctggagagactgcaataggtgagtgcacagatggcttcagtagctgcaaggttcccaggtgcgatttacctgagggtggagataggtcagaggagaagagggagtcattcctgcccatttcacccatgaaaagatcctaatttccacatagcttgtttattataaaatcattagattgtcattacaaataaaattatgaaaatatagaaaatcgtaaacaaagttaggttttataaataatttagtatttcttatacattttttccctatgtccactatacgtatttttaaacatgctgtagtcatatctttagttaccatgagcatatttccatttcaaaatatatatgtgtatatatacatgaatgtgtgtgtgtgtgtgtgtgtgtgtgtgaatgggtagacataattataaaattggtaacaagtatctggttaccaagtactgattctcctagatgtgccatgatgcatttggtagcttctagtgtttttatgtaaatagtgctgatccttaaccttgcgcagaatctttgtgctcttgatatattataaacatggtatttgattctaagccatccttgtcaagatgtctttattccacttattttggctcacactgatagacttaggtattaggaacatgaattttttctggtaataatctacatgtgtctccacaccactccccgtcctcctcctgaccccagcccccagccttctgtctcccaatcgccatcttgctcagtcttttcagaaatcgaggtgttttttctcactgtccacctgcatgtgtgtcttttgtttcccatttattttctcattttccatcttgccatctttctttttttttctttctttttttctttttttattgaggcatagtttcaccctgtctcccaggctggagtgcagtggcgcgatctcggctcaccccaacctctgcctcccaggttcaagcgattcttctgtctcagcctcctgagtagctgggattacaggcatgtgccaccacacccagctaatttttgtattttttgtagagacagggtttctccatgttggccaggctggtcttgaactcccgacctcaggtgatcccctcgcctaggcctcccaaagtgctgggattacaggcgtgagccactgcacctgaccgccgtctttcttaatacaatataatatagtagacagaaaactgtaactatatttcttcaagtaaatcagattttgttttgctttatttgaaaaccagatctaaattttatgtctcattaagtgttttgttttctctgagccagttgtattttcaagagtaaaataactttgtattcccatatttatttttttatcatttttatttttatctattttaattttttctttgcaattccatatttggtaaactgaattgttaagtcatagtctttagagacatgttgttcagtgctcatttttttcttagaagctgttgtttctttgagcatctccttttttttttttttttttttttttttttgagacagattctcgctctgttgcccaggctggagtgcaatggtgtgatttcggctcactgcaacctccgcctcccgggttcaagcgattctcctgtctcagcctcctgagtagctggggctatgagtgcctgccaccacacccggctaatttttttgtatttttagtagagatggggtttcaccatattggtcatgctggtctcgatctcccgacctcaggtgatccacccacctcagtctcccaaagtgctaggattacaggtgtgagccactgtgcccagctgagcatctcctttttacaagtctgtcctgggtgccttgcatggggatctgttgatccctcacagctccctgctgtggtgcagagtggcaccctgttttccacgttgggaggcgagatgacaaagcaggatagtatcagcaggaagcacatttctgatctctgcttcagagcctttgggttctttcctttgttacaaggccttctctctcctaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcaggtgagtgccacccgggaccaccgcaccccgcgcacatcctcagacggccctgttgaaggcagcaccaagtcactagctttgtcctgagctgcaagccaggaattcccgactgaggcccagaggcgcatgtgggtagcccctgtgtgttagctgctggttttccggaagggatgggaaacctgttggcatcacagatggcttgggcctcctgggcctgaggtgtggtggcagcagttggtcaagttttccttggcctgggcacacctgctgtcactcacacgggctgtcaccaggctctgcaccccaggtaggaggtttttctttttttttgagatggagttttgctcttgttgcccaggctggagtgcaatggtgagatctgggctcaccccaacctccgcctcccgggttcaagtgattctcctgcctcagcctcccgagtagctgggattacaggcatgcaccaaccatgcctggctagttttgtatttttagtagagacagggtttctccatgttggtcaggctggtctcgaactcccgacctcaggtggtttccctgcctcagcctcccaaagtgttgggattacaggagtgagccaccacgcctggtccaggtaggaggttttttaagtccaggagctgtttactgagcactctgctgttgagagctcattgtccatctgtcctagtctagaagggagtgcagacacatgcacaggtggcaggtggctcaccaggtggaagacagaagagggagggcacctgctggaggtggatctgaagggagggcactcaggcagcccaagcctgtcagacagagcagggctttgagacggcgccccctccccccgcttcccacccctggcctgcctgctctcctaaagcagggttgggccaggaaggaattgagagcggccctggtttaaagatgacactagtgtgagcaagggtaaagaaggaatgactgagtttctcttttgcacttcggagactctctgtaggaaaatggaacctgggctctagcctaagacatgtgctggttccatgtctgccctggcatggtgagtgccatgtggatgccacctgtggctccttgtcagtgttccttgtcagtgctgtgagggactgggaagaaggaagggactagcatgtgcttgctccctccgagaattgtgtcattgatttcacagctacaggccgtgttttctgttgctgttctctactgcagccacagggactagagctacaaatggtctgttgtttggattttcgcgggttttctcttactccattcttctgcattctcagcctcccaaagtactgggattacatttgtgagccactgcgcctggcctgctggctttttttgaacctgcatcagcttcagtggagtaagttccaacttcgtcacatgcggaattctgtgctgttgagcttgtcttagggcaggtggccctgagactctcccatgactctgcgcctcttccttggctgctgtacgcacagcacgtcagggtgaggaggggcctcagagatcactttggtcctgggagactccctctgtgtcctgtgcctcatggtggggcctgagagagcagttgctgttttgtgttttcttcaaagtgggtgtattcctaattcatgtttttgtctgtttttgcaaccagagactttcctgctgtggcttgtcactgaccagcgacttcttagcctggactactgtgagagcagggtctggatgccaggtggggagggcagagtctcctgctgcagcagcacctcagcagccttcatctcgtgaggcctggagcatcccaggggctgcagctgtgccatgtgggggcagcacagcagagagggcgctgaaagctgcattcccctctgccatctgtgggtgcaccagcccattttcacaagtttgctgttctggtagagggagcaggagttgggggaagctaggacagtgggcattaaccttctccaggaagtgggcatcttcggcagaggctcttcagggctgtggccgtgcaggagggccagtagtgtgtccaggtcaccactccctgggatgttcttgacttgggtcccagggagaaccctgcacggcagtcaacaccagaatgtcccggatctgccccatgagtcttttccctccctacctgcaaaatgagataattatgttaggtgatgttttagtgttgtgtgagcttttaattccaaataagttttttctgtgttatttttaaaaagtaaaactggccaggtgcagtggctcacacctataatttcagcactttgggaggctaaggtgggaggatcacttgagcccaggagtttgagaccagcctgggcaacatagtgagaccttgtctctacaaaaaattaaaaaattagccaggctgggtgccgtgtgtttgtggttccggccactccagagagtgagtgggggaggatcacttaagaccaagagttagaggctgcagtgatctatgatggtgccactgcactgcagcctgggtgacagagtgagaccctgtctgaaaaaaaaaaaaaaaaagccaggcttagtggctcacacctgtattcctagcactttgggaggctgaggcaggtggattacttgagcccagaagtttgagatcagcctgggtgacatagatagaccttgtctctacaaaaatacaaaaattagcctgccatggtagtgtgcacttgtggtttcagctactcgggaggctgagatgggaggatcacttgagcctaggaggttgaggctgtggtgagctatgatcatgccaccacactccatcctgggcaacagtgagaccctatctcaaaaaatgaaaaaaatatataggcatagggacagtaaatagtccctgtgttggtattgcactgtgggctgctggttactgggtgccccacagagcaggggtccctaacccttgggtcacagaccagtactagtccatggcctgttaggaaccaggctgcacagcaggaggtgagtggccggtgagccagtgaagcctgtcagtgtttatagccactccctattgcttgcattaccgcctgaacttctcatgtccgatcagcagagacattagatcctcacagaagcatgaaccctattgtgaactgcgtgtgcaagggatctagattgtacgctcctcatgagaatctaatgcctgatgatctgtcactgtctcccatcacccctagatgggaccatctagttgaaggaaaacaagctcagggctcccactaattgtgcattgtggtgagttgtataattatttcattctatatgacagtgtaataataatagaaacaaagtgcacaataaatgtgatgagcttgaatcatcccagaaccatccccttgcctcacctggtctgtggaaaagttgtcttccatgaaatcggtccctggtcctaaaaaggttggggaccactgctctagagcacatcccatggcacccacgcagggtggtttattgagagcacagaaggagggaggagcatgagatctcaggccatcagtagacactgtgaaggaaagaccttgagaaggaaaacagaaggcgaggggccggctttcctgcccggctcactctcgtcaccggggctcaagggaacgaagcgcacctgctctggcctcacgggtgcggtaggggaagccaagaccaccctggctgggggcagagatgggagctcagggctctgaagcccagggagaggctgctgtgcagggcggggtttcaagactcccagagaggctgcttgtgggaagcacgtgaaaggctccttaatccaagagtgtctctgttgacgacatagtgccacctgctaagtctctgtcttgccaacatgagctgcagtcaagttgtattgcattaggtcattgaaacctcccaagtgcataggaccctgcctacctttaccaaggaccgcataaaaaaagaggagccccaagcaccttctgggtaggcatggatagccgcccacggtacactctaatggcagcaacggtatttgcctttggcccagagaacgctgtctcagggccctcctccacagtcttgttagtgtttgtagcagtaacagacgtgcagatggagaagctgagtgttggtgaatccactggagggtggcatcagacctggaggggtgtgtgtatcagtccattttcacactgctataaagaactacctgagaccgggcttgatactcacccctgtaatcccagcacttagggaggccaaggtgggcggatcacctgaggtcgggagttcaagaccagcctggccagcatggagaaaccccgtctctactaaaaatacaaaattagccgagcgtggtggcacatgcctgtaatctcacctactcaggaggctgaggcaggagagtcacttgaacctgggaggcagaggttggggtgagctgagatcatgccattgcactccagcctaggcaacaagagtgaaactctgtctcaaaaaaaaaccaataaaacaaaaaacctacctgattctgggtaatttataaagaacagagatttcattgattcacagttccgcatggctggggaggccttaggaaacttataatcatggcggaaggagaagaagaggcaaggcacgtcttacacagtggcaggagagagagagcaagaggggaaatgccacacttctgagccatcacatcttgtgagaactcgctatcatgagaacagcatgggggaaatccgcccccatgatcccatcacctcccaccaggttcctcccctgacatgtggggattacagtttgacatgagatttgggtggggacaaaggtgaaccatatcaatgtgacaggttgacatgacgtcacggcagacgtggaaggtcctgtaatcagggtgtggtagcagcctcgctgcctgtcctcaggacagctctgaccagactggatccccctggcagggaagcataagaggttgctggcctgagtcgtcaagaagtgaccattgtgaagcagacattcagctcgtcccagacagcccccaggaggagagtccagaccccgtgtagatgtgtgtgatcagaaagagtcccttgcaagggtcgttcgaaggcagagtgggctgtagtgtggagatgagttccccatgatagggaatgtggagaatagttggagaggtatttggactaggtgaccatgaggtctcatctcagatttcatttcagggacacatctgtccctgactggggctggtggcctctgtgcctggtattcattgtttaccagggatttgcagagtacccttcatgggaggcacttgtctgcaagtctaagtgcaaatcagccttgcctgtcaacaaagatgacttgggtgtgtcggtgcttcctgtcctggtgttgaacaggagacgctggcctattgcagagaagctttgagtctggaagcttttctgaatggaactcccacctccctttctcctgcatttggtgtttttcttctgtaggattgatgctgttcacttgatttatccctggtgtattagtccattcttgcattgctataaagaaatacctgagactggataatttataaagaaaagcagtttaattggctcacggttctgtggctgtgtaggaagcatggctgggaggcctcgggaaacttacaatcatggtggaaggtgaaggggaagccagcacatcttacgtggctggagtaggaggaaggggggtggggaggtgctacacacttttaaacaaccagatcttctgagcactcgctatcacgagaacagcaccttcggggaaatctgcccccatgatctgatcacctcccaccaggccccatctccaacaatggggattacagtttgacatgagatttgggcggggacacaaatctaagccatatcacctggctttcccttcatgtatcgatataagtttctgaggttgtgaataacttgtaaccttcaggtgacttcagaaaaatagtatagttagtgataacatagggaaaaagatgaaagagaaggaagatgaaccgttaccgagtgctgtgccaaaccccgtgtggctagagcctcactactgcttcctggtgttaccacatctgcagatgacaggaggctcccgagggtctcagccaggcaggcctgttggggtttaggtcagcggtgtcctacgtagcataacatcctgcccctaagagcctggggtgctgtccttagttccacatgtgatggaaatggcagataaagttctagtttcagagattcatttctccaattgaactgtaactaaacacaaaaatgcccttagggaaattcttttactaagactgaaaaatcctttgggaatagtaatttcttcaggtatctgtttcttgaaggtaaacatttattttgaaatattatatatggtattattgctgttgttctagggaaaatggtatatatgtaaaaataacacatacatgttctctctagggagaaaataacagtgtcacttaaaaagtaaagtgtatttctttaaaattgcatgttacattgcttttacaaagagaaaaccagtctcttcactaaagcaaccagaagatgctttttatttttatttatttttttttagacagagtctctctctgtcaccaggctggagtgcagtggtgtgatcttggctcactgcaacctctgcctcctgggttcaagcaattctcctgcctcagcctcccgagtagtagggactacaggcgcccgccaccacgcccggctaatttttgtatttgtagtagagacaaggtttcaccctgttggccaggatggtctagatctcttgacctcatcatccacccacctcagcctcccaaagtgctgggattacaggcgtgagccaccatgcccagccaggagatgcatttttattttcactgtcttgtgaagaaaccatgagaaacaatctgccactaatacaattgagggaaattgagccactttagtaacatccagagaataatagtcattctggaaccatgtatgcatgggtgggaggttgtggggagctgaaaacaacagaaatttatgctcacagttcttgaggccagaagttcagaatcagtatgtcagcagggctatgttcccctgaaggctttgggggcaactgcagtgacccctggagttcttggtttgtggccactccactctccactggagctgttttaatgcactatttaatttaaaacctttgaatgaacattggttgcttctaatcaataacattttagaaattttatactgattcaaaggctttaaaatgttgaatacgtgtaaaataattgagtctctgttcacaaataagtatgtatgtatgtggcaagagagttggtaggttttgtttgtttgtttgagatggagtcttactctctcaactaggcggtggtgtcatctcagctcactgcaacctctgcctgctgggctcaagcagccctcccacctcagcctccagagtagctgggatcacagcgcacaccaccatgcctggctaatttttttttttttttttttttttgtatttttggtagagacggggtttcaccgtgttgcccaggctggaagtttgaaatcaattatttttatgtttgctgtctgaaattcattctttctctgttgtttgacacatacataagcctgcaggtacccaaatttgttccaaaaaaaaaaaaatttccctgaggctgtgaggagagagtcaaggaagaggtttttattgatgttatttatcaaacaactcttacactgtacactaagattttataataactgcagacatatacaatgaaaagggagaattggcaccaatattgaatcttcccatccaagaatatggtatgtcactcttttttaaggtttttaaaaatatattgtattatggttttatagtttgtaaatcttgacccattttgtgcctccatagtctgtagtttgaggggctgctatgaccggcatcttgagtggggaatgtgtgtttaaagcattcatgctggaaactgggaaaatggagatgccctgtgaccagtcatctcgccagatgccggcattaactcttgtagtttttgagttgagtcttgaatctgggagtctaggaaatcacggtatcttctacaaataatgataggtttatctcatcttttccagcatttgtcccctttttttggcttccactaggaccttcagaccagtgtgaataagagcattgatactggcacccttgtccagtcctggcttcgaggggctgctgtgagtgtttcaccatgaagtttgatgcttgccatacagacttttgatactttctagcaaattaaagaagtttacctttatttctagttgatttaggctatcatttaaaaaataaaacaggaagatgtcaaaattgatggtatgatttttcttatatcaatttctgtatgagttaagagtttaggttacctaattttgagacattcttgcgttcctgggatgaaaccctagtagatcatgatatgtcattctttattccattattaaatttattagctgatatttgatttaggacgtgtgtgtgtgtgcgtgtgcgcctgtgtgtgtgtgtgtgtgtattcggacagctatataaaattatttttagagacagggtttcacactgctggccaggctggagtgcaatgacaagatattagttctctgcagcctcgaactcctgggctcaagctctcctcccacttcagcctcctgagtagctaggaccataggcacatgccagtgtgccagctaagttttggcttggtgcagtggctcacagctgtaatcccagcactttgggaggccaaagcagaaggatcgcttgagcccaggagtttgaggccaacctgggcaacatagggagaaccccatctctacaaggaaaaaaaaattagccaggtgtggtggtgtgtgcctgtggtcctagctacttgggaggctgaggtgggaggatcataggcccaggaggttgaggctacagtaagttgtgatcataccactgtagtccagccttggtgacagagcaagagaccttgtctcaaagataattttatttacaaacaaatgaaattttttgtagcggtgggggtcttgccttgttacctagactgttctcaaattcctggcctcaagtgatcctcctgctttggcctaccaaagtgctgggattacaggtgtgagccactgcatccagccaggacttttatatctatattctgaggtataattgagttgtcttggtctttgaggtcttacttgttttgtataaaggttgtgctagcttcatagaatgaattgagaaactctgtgtttttgcaattttcaggaatagtttaaattttctgtcccatgaagggtttgatagaacctaccgtaaaactttggggcctaattcatttttacagggaagaagaacaagaactatagatcttgtctgcctttttcatttatatgacatttattagtgtatttcaggtttccttctccctcgagtcagttttacaaatagaatttggctcaagaagttatccatatcgtttagtaaagggttgtaaactcacacctgcagggctagggaaagtcacggaaatggatgatacagggtagagcggccccagcgttcctgtggtgctcatggccgtcaccaccctcaccttgaaagtgccctcagttgggataggccctagtggagcctggggcatgggtagcgaaggccacacctgtgtgtgcgtgcgtgtgtcctcctgttctctgttaggggcagtccccacttgggtccaacagtcttcacagggccaccagagctgccaggttgtcaagagaagccagaaatctggattattaggtgaaatctcgaacacttttaaaaagaggtgaagtgcaagtcggacaaaatagcccatgagccccttgtttgtaactcttctttagatgttacaaagtatcaacttataaagagactttgtctcacagtttaaaaacaatcttctggccaggcgggcacagtggctcacgcttataatcccagcactttgggaggccgaggcaggtggatcacttgaggccaggagttccagaccagcctggccaacatggtgaaacaccgtctctagtaaaaatagaaaaatgagctgggcgtggtggcgggcacctataatcccagctaactcaggaggctgaagcacaagaatcgcttgaacccaggaggcagaggttgcattgagccgagattgtgccactgcactccagcttgggtgatatagcgagactcagtctcaaaaacaaaacaaaacaatcttcatatgtacccatatcctttctcaatcctgatttttttttaatgttacctttttccccctttttcagccttgacagaagcttacagaaccgactttcggttttattaatcacatatgcttctctgtttcctcagtaatttctctttttgcctttaactcctaacttctttgttagttttgttttgctttgctttttaagtctcatatgcctgttaatagctcttcctttcctgtagtctgagctcttcgtgtggcaggaccgagttgccatcatcttgcttatttctaacacattcagggcacataatgggcattcagtaaatagtgaatgttcatccactgtattgacagatttagtcagaatatcttgatttctctttttactgtttattcatctctgtctttcatgtgagaaaagtacttgtgatgagtttgagtaaaataaagaaatacctgttaacatatttgtagtattgtatctttattctgtttgcagatgatgtttctctcatatatatcattttaagaaagtctcctcttgaaaatgtcttgtataattgtcgcaggtattaaagtttttcttttttttctgttttttacatccccttactagatgacaatgaaaaccaagcagcgcatgttaacagaagactgggagctttttaaacaaagaagattcattgaagaacaggtaagcttgtcaataagagaggcaattaaaggaagtagaaatctgtcctgacagcaaatgacttctctgcatgttgatgtgctttgttagaacagcattggaggaccacattggcatgttttgccagcgttaaaaactgttcaagatggtgtttttaatctcaagataaactaattttcacctatttccttatcttccatatacgcctcaagaaaaacccatgtgtattgagtggcctctctatcccacagcagctctgggtattttgcaaaggatattacctgagtccccacagtcccctatgaggcagatggtgccatctgcagtttacatatgaaggagggtgttagggtgaggttaaggatgttgcctgatgtcccagagctggaatgggggcccagcatccccagacagagcgctcagatctccagacattgccaggtgccatgccttcaacatggcagctggcagatctggactctcccttcctcatcttcctggcggtgcctcctccaggcaggcttgtgctccacctttgctggagctgttgggcagagcttgctagtgatgtcctgtatctggtctgggggcccttggcttcatctggaaacttggcttcccctgatctcccatccacgtgccacatcgactctcttcctgttctctgacacttctctccatctcctttacgaactccaacttcattggtctttctgcaaatattggtggttccctggccttgaccccatgcctgtctccacatttgcatgcccgtggtctcctctgggcaccacaggtatacagatggcaccagtgttgtggcatgcttacctcttccctttccccattctgcatgtgtccctgtgcttttgttgttgttgttgttttgagacaaagtctcactctgtcgtccaggctgaagtgcagtggcgtgaactcggctcactgcaacctctgcctcccgggttcaagcggtactcgtgtctcagcctcctgagtagctgggattacaggtgccagccaccacgcctggctaatttttgtatttttagtagagatggggtttcaccatgttggccaggctggtctcaaactcctgacctcaggtgatccgcctgcctctgcctcccaaggtgctgggattacaggcgtgagccacctttcccggccatcccgtccttttgagtggcccttccagctgccacctgtcccattgccagagtgggtccagagttccttctcctttgaaatgcagatgctcaccttgtctgttagaagttgaggtgccatttcctcaatagctccgaggccgaccccttgccctccacgtgccacttttcattcctacagctctgttctcagtaccttgcaagtaccaagcacatggcagacagggtaaaggccgggtttctgcatcaggtgtgtgctgtgagggcgcactgcagcatgtttgctgaagacaaaagcgattagggtctcctggtacccgagccctttgcagctcagcccccagcttgctgccgactccaggtctgctgcccctgtattcctggtcctgtcccgctgaggaagcagtgcccgtgaacatgatacatgtcagcagaattactgaaaaataatgagccatgtctcggggaagggtcttgcaagattaaagcattttaaaatttcctctagttaaccaataagaaagcagttactggcgagaacaacttcacagacaccatgaggcacatgttatcgtcccggctgagcatgcccgactgccccaactgcaactacaggagaaggtaaggctgggttgtggtgtcagcacgactggcccattggaccttcactgggctgagtggaggcctagaaccgacccttagagagcatggtctagtcttgtgcattggttggcttggtaactgtccttaattcctgatcagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttgtaagttgtgactttgtaataaagtttccgaaatttaagtcgccccagtaatgagaaatacatacagtaatgtccacagaagtatgaacatcattattgtgcttttcatgacaagggaccctgaggtttttaatgcagcttttaaaacatgaaatcagtaaacccaaacttttaacactgtttatctgggaaaaaaaaaacatggtaaattaataaaggccagtaaagaaaaaacatgttggtatgcagagaagaagtgtctctaattccggcctcacatctcctcattctcctaaagggtgaccagtccgccgtctgtcctgtctccctgtcagcccagcactcatgcttgtttcatgtcttgctaagaactcaggtgatcgctttagcaagcagttgaaggtttctgtttttcatgttcccgcatgattagaagtacattgttgtgcagctgtcaccaattcacattgtagttggctgttcccagatttcttcagagttgtgaccctgtcatttggggaggcttcacatgctaatttccaaaagggttgcacttgatcatatgtagttgccaaagtcagcttaggtttagtttacgtgtatcgtagagcacacaggcatcatgttccatgtggaagtgtgcagtgggagagattgttgttcctgaccttggctatgcagcgtttctgggatttctctgaccaactgacttgtgttcattccttctgtctggatttctcatggtgactgacgttttccttcagtctttccattttcaatttgggcttgttctcagacaaaataattctgaaaggactggtttaaactcactgactctcttcatacaaagattgcaggctgctgtttattgccttagagacactgtgtactctccagggcacaagaaagagtgttgacatttttgcagctggctgttatccaacttcttactgaaacataaaaattaaacatatatagcctaatgaaaatttaagatggaaaatttcatccctgttcatttgtcacagctgctgatgtcagttatggtctcttgtgtcacgtgtggtagtggaagaaattggctgtgggagcctttctccttgggccggaactgcccatcaccagttacggggagcctaggttctcgggacatctgggccttcagcagcttgtgatcaatgtcttccaaatgtaaactatgatttgaaaatctccagtgttatcttttcatttgtattgtctctttcttggtgccttttctaagttggttaaaaagaacaatgtgattgtagtcagtgtaccacacagtacttcctggatcttatgggttggatctttacggagctagggctggtgaagcctcctgctgtcacatggagcaaatggctgagttacttcactagaacctcagttttctcatctgtaaattgtgcctatggtcatcctcaggagtgtgtatgagcattggcccaggcagcgtcccaggtgcagtgggcctgcaggaagccctaggactctgcaccttgtgggtgctgtttgtacttacctctggtgagctccagactctagcacgttacttgtaatgtgttgaaaagacaccggaatttggtagtcctggacactcttcactcattctaggaagtgagatcacgacgagttcctagggttttgccttctggaggttgctgtgtgcccaggctgaagatggactcagtgcatgtttttgtggaccttggagcatcttattgcactgagcttaaatgtgccagctcttttaatgcaccagagctgcatcttaagtggtctctgtaggctaaagccttgaaatctgtttaaaattaatttcaggccgggtgcagtggctgatgcctgtaatcccagcactttgggaggccgaggcgggcggatcacgaggtcaggggattgagactatcctggctaacacagtgaaaccccatctctactaaaaatacaaaaaatcagccgggcgtggtggcgggtgcttgtagtcccagctactcgggaggctgaggcaggggaatggcgtgaacctggggggtggagcttgcagtgagccgagattgtgccactgtactccagcctgggagacagagcaagacactgcctcaaaaaaataataaaataaaataaaattaatttcagtaaatttttcatttgcctgttgcttagatgtcttgctaaagctgatatttaattacgatcatgagtgaccaggccatgactggccttaaagcaaaaaaaattagtcttctgttacataagtgcctttaaagttttgttcaactgactatttctgaaaatttcagccctaagttgaaaaagcaaacactaaacagctaaggtttaaaaagcaaacactaaacacctaaggttgccatcggtacccctttaattttaatcacaaattgtgttgtcttgggagtagcagagagactagttttataccagcgctcttcaggtcaaatggaaacgttaatcagtctggttaaatttttgtagtttccttaatatttctacttttggaggtttttctgtttgttttttgttttttactcttccaaatggcacaaatgttaatcttccaagcatttttctcatgttgaggttactaagaaatgttagtggtaggaatgatacttaactaatactctttgtaaatgaaagccgtgatctgtccaggaaatatctgtgcttagtggctggtttactcattgtctttcacaattgaatgacctcacagtgaccatctctgcttgtgtcagttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgaggtatggacatggcttcttcgtagcaacaataaatgacataaaatgatggtctgacattttaatattttatattactctgttttgaaaagtgcaaattacaaaagattgtctttaaagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggtaggactttgcttgctgttttgccaaggatctctttttctgtgtgtattttctctaaacatgagcattactgaatacaaaattattttgtttcccataatttctgaaggttagaactgaagagagtcaaggcatacttacaatctccatttgaatcttgtttttcttgctcgaatatcaatcttgatttcgcaacaccccatagcagctctgtggaggccttttttgtctgtatagaagcaaagagaggagttaaaaaaaaatagtggaatattaaaatttcaggaaaggtttgtttttcctgttcattatctgttcttctgttagccaaaggtgagggtaccttattagctttttttctcagaatttcataaatagatgcttaaacaagtttttggccgggcgcagtggctcacgcctgtaatcccagcactttgggaggccaaggtgggtggatcagttgaggccaggaatccaagaccaggctggccaacatggcaaaaccccgtctctactaaaaatacaaaaattagctgggcatggtggtgggcacctataatcccagctacttgggaggctgaggcacaagaattgcttgaacctgggaggcagaggttgcagtgagccaagattgcgccactgcacttcagcctgggcgacaaagcaagactctgtttaaaaaataataataacaacaataataataagcagtctttaaatgaaagaacaaatgaaggtcaaagtgcttggctgatttattttattaggtaatataaatgtaacactcagatggtaaaggtgatgttgaaaggtctatctgggaagtctgaccacatctccttaccagttttttcttctacgtataatgtttttgatgtcttatccaagaaaactttgcctaacacaaaactgttttcttttagaagatttataattttagttcttagattctgtttgactcagcatttagttattgtgaggtgaggatataaattcaccttttctgcatatatagatatccaattgtttcagtacggtttgtcagaagtaccctattgaattgccttggccatttattgaaaatttattgaaaatcaatggactgtaaatgtaagagtttatatttggacattccattctgttcatttgatctctgtgtctgtccttacacccatagtgcatttgacaattgctttatggtaagtttaggaaaatgggatagggtcttccctccagcttggtacacctttctctctctctattttctttcttttttttttttttttttttttttttgagatggagtctccctctgtcacccaggctggagtgcagtggcgcgatctcgcctcactgcaacctctccctttcgggttcaagcaattctgcctcagcctcccaagtatctgggactacaggtgcacgccaccacgcccggctaattttttgtatttttagtagagacggggtttcactatattggccaggctggtctcgaactcctgaccttgtgatccgcccgtgttggcctcccaaagtcctgggattacaagcgtgagccactgcacccggctggtacacccttttcaaaatcgtttatgctgctcaaagttctttgcattcccatataaattttaggatctacttgtcaactacaaaacgcctccttggatcttgagggattgcatcgaattcttgaatatatatttagaattctccagtgaaatcctctggatgtggttgtggtcttttatttgtgggatgatatagatcaatttagggagaatgcaatcctaacaaaattgagtcttctaatctgtgaatatgctttatctttccatttatttaagtcatctttaatttttctcagtagttctaaaaaaattccagtctttgtgtctggaatatataagtattatgtgttttcattcacagtaaaaggtattttctaattttgatttccaattgatcattggtaatacatagaaatacaattgatttttttatattggtcttgtgttctgcagctttactaaacttgtttattctagtagggttggttctagtaggtccttttgctgttgttttggtagattactttggattttctatatacaagatcatgttgtctgcaaataaagttttagttcttcctttccaatctggatgcaatgcttttaatcttcccttccctttcccttctcttttctttttctttccttcctttcttctttttaagaaacagaatctcactctgtcacccaggctggagtgcactgctgcagtcatggctcactgcagcctcaaacagctgggctcaagcagtcttgctgcctcagcctcccaggtagctaggactacaggtgtattacaactacaggcatgcgccaccacgcccagctttaaaaaaaaactttctgtagagagagggtctcactatgttgcccaggctggtcttgaacttctggcctcaagccatcctcccatttcagcctcccaaagttttaggagtataggtgtgaggcaccatacccagtctggatgcttttaatttcagtttctttttctttttttttgagacggagtctcgctctgttgcccaggctggtgtgcagtggtgctatctcggctcacggcaagctctgcctcccaggttcatgccattctcctgactcagcctcccgagtgcttttaattccttactcttgccttattgagctagctggaaactcagtacagaatagaattgttgcaagcagatatctttgccttgttcccaatcttagggggaaagcatttaatctttgaccactctttaaatgtgatatcaagtataggtttttcatagatgccctttattgggttaaggaaattctattctactcctaatttcttgagttttttcatgatttgaatattgaattgtattgaatattgaattgttcagtttttcaaatgtcttttctgcatgtgttgcgatcttgtggttttcgttttttattttgttaccgtggtgtgtcacatcagttgatttaaggatattaaatcaacctgtgttcctgggataactcccacttggcggtggtatataatccttttcatgtgttcctgagttggtttgctaatattttgttaggatttttgcatctgtgttaatactaataaaatatattggtctgtagtttcctatctttgtgatgtctttgtctgactttggtatcagagtaatactggcttcataggatgagttaggaaatgtttttttcacttatgttttctgaaggagtttgtttaagattgagatttattaaatatttgatagaattcaccagcaaaatcctgtaggcctggtctctttttgtgggaagatctgtaattactaattcaagtttcatttgcttgtaataggtcttttcaaatttcctatttcttactgagtgaatttcaataatttttgtctttgtaggaatttactcatttaaattgtctaatgtgttggcataaagttattctatactgttataatcctttttaattctgcagtgcctgcagtgatgctaattcttgatttgggtaattttatcttccttttaacggcttcagtcacttgggctaaagatttgtcaatttctctgttttcgtttctgtgtcattggtttccattctgaaattgattatttctttctatgttctttgggttttgcttgctcttccttttctagtttgttgaaacaaaagcttagatgactgattttagagcttccaaatttattgagacttgttgatggcctaacatatagtttacctagatcctgttctatgtgtacttgaaaataatttgaactttgttcttgttgtgtggagtgttcaagaaatgaaagtttgatcaaattggttgatggcattcttcaagtcttctgtattgtcttggtctatccaggctaccatgtaaggacagtaaccccattcctgagagtagagccttccaaagtccttatcgcctaataccatcactttggaggttaggctatcaacatatgaattttggaggggcacagatactcagatcatagtatatattcttactgattatctgtctggtggttttatcggttactgagagaggcatattgaagccttcaagtttaactgttggattatttccttctcctttcaattcttccttgttttggttcatgcatttgggggtgatgttattgaattattgttatagctcccctgatatattgccccttttatcattatgaaatgtttgactactggtgtttcttaacgtccgttttatttgttagtatagccactccaccttcttgggttactgtgtacatgtattttttcatccttttactttcagtttctttgtgtctttgaatctaaaatttgtctaacatcttttagttgggccttgcatttttatcctgtatatgtcagtatctgcctttttaaatattaaacaaaaattttagtgtactattttaattcttctgttgattctttttttaattttcttagtggctgctgtagggttacagtatgcatctcttgtgaatgtcgttataaaaaataaaaagaaacaaaaattaaaatacaatatgtatctctttttttcttagagacagggtcttgctctgttacacaagctggagtggggtggcatcatcatgcctcactgcaacctcaagctcctgggctcaagcagtcttcctgcctcagcctccttagtaagctgggactataggcatgtgccgccatgaccggctaagttttttaattttagtagagacaaggtctccctgtgttgcccaagtttgtctcaaactcctggccttcagtgattctcccgccaggaaatcccaaagtgctaagattacacttaaccagtgtacccagccacaatatgcatcttttttttttttttttttgatacagagtctcgctctgtcacccaggctggagtgcagtggcgcaatcttggctcactgcaacctctgcttcccaggttcaagtgattctcctgcctcagcctcccaagtagctgggattacagatgcgcaccaccacgcccatctaatttttgtatttttagtagagacaatgttttgccactttggccaggctggtctctaactggcctcaagtgatccacctacctcagcctcccaaagtgctgagattacaggtgtgagccaccacgcccgcccacaatatgcatcttaatttatcacaatctactccagattactactgacttaattccagtaaaatatacaaactttgctccgcaggagctccatttccttctttctcctttgtactattattgtcctatatataattacatttgtatatgttacaaaccaataatatgttttaattactgctttatacagctttataatttctagagcaaataaaagagaaaaatgtatttatacagtgcctgcctgcctgccttcttttctttcttttccttttcctctctctctctttctctctctctctctttctcttttccttttccttttcttttcctttttcttttcctttttttgagacagagtcacactctgttgtccaggctagagtgcagtggcacaattttggctcacttcaacctccacctcccaggttcaagcagttctcctgcctcagccacctgagtagctgggatcacaggcaagcaccatggcacccggctaatttttgtatttttggtggagatgacatttcgccatgttggccaggctggtctcaaactcctgacttcaggtgacctacccgccttggcctcccaaagtgctgggattacaggcatgagctaccacgcctggcctgtatttatacagtgttttctatttgctagctggctagtcatttctggcattcttcattttaaattctgccgaatttaagttaccgtcttgtttttaccttcctttaatatgtcttacaggaccagtttgctagcagttaattctgtttttgtgtaaatgtctttattttgccttcattttaaaaaatagaccaggcatgggggtgtctcacgcccagcactttgggaggcagaggcgggcagatcacctgaggtcaggagttcgagaccagcctagccaacgtggtgaaaccccatctcttctaaaaatacaaaaattagccaggcgtgctatcatgtgcttgtcatcccagctacttgggaggctgaggcatgagaattgcttgaacccgggaggcagaggttgcagtgagacaagatcgcgccattgcgctccagcctaggcgagaagtgagactccgtctcaacaataaataaataaataataaatagagtggttgtttttaggaatagctttagactcacagcaaagttgagtgagagctacagagacaccctatacccagggtccccacacacagccttcccactatcaaattccacaccagagtgttactcttgttacagtcatcagctgtcagactgttagaacaagcagtcagttctcctggcagcctggctttctcaagaaggtgttttagtagggtctggggtcatcctagggacttggcctttggctgcaggaagccttaggtggtcattgtgtgccagagttctgcagctctcagtatctctttgtttttatccatcttaaggttcactgagcttcttggatctgtagaccaatgtttctcatcacatttgggaagtggagtgtccaggtgttatttggatgctcttccccctttcctctgggacttggttctgcacatgctggagtgctggctgctctcccacaggcctctgagcgtctgcatactttcccctcatctcttctctctcttcctagatcagttccattgctcttcttcaagttcacagatgatttttctgccattttaagtttgcttttgagcccctttagtgaaattttggtttagctattgtactcttcacctatagaatttatattttactgtttttttgtttctctttttttgtagtaattccctatatgttgaatctttattttcatattttcctttaattctctgaacatgttataacagctgctttgacatctttgtgtgctaatttagtatctgaactcactcctgttaaccgtttgactatttatttcctgcatgtgggtcacacttttttttttccagacaaggtcttgctctgccacccaggctgaagtgcagtggcatgattacagctcactggagcctcgagcctggacctcctgggctcaaacaatcctcccacctcagccccccaagtacttgggactacaggcacacaccaccatgcctggatagtttttgtactttttgtagagacagggttttgccatgttgcccagactaggcttgaactcttgggctcaagtgatcttcccacctctgcctcccaaagtgttgggattacaggtgtgagccactgcgcccagcctaggtcatacttctctttaatctttgcttgtctcataattttttgttgaaaattggacattttaaataatgtgataattttgcattatcattttttcccttgagggtcctttgttgtcttttgtttgtttccttgtttttgttatttcctgggcttcagttgcaggacctgtatctcccacattatgtggctgtgggtgtctcagcttacttcttctcttctcctttttagtttggcttctagaggtctgccctttgtccacctggctgattggccagctgatgatttgggcagaggttgcccatgcaccttgaatccacaggggctccattgttggctgtggggtgaatgcgctcagcactcagccagttctcaagtcagctgtgttggccccttcctccagcccgtgaggtgtcctcagtgcatgcactgtgctctcctggtcagccagcgagttgtggacagcttaagaagcccttccgtggcgctctcatttccagggttctctctgttagatttctgtctcctttgccactcaccccagttgggacctcagtctcaagggaacagagctgcaggcttccctattcattcccttctaagttcactgcttttactgcttcaccctctgcctgaccaggctgctgtttttggtagcagggttggtttgcgctgacatccctgcagtcacagaactcctgtgcccactgccgaccgagtcaggggtggagtacaggtgcaggaaatggaaagagtcccagacaagaaagccagacttgctgttcttccttgaagttctagctgatttgcatgaataaatgtgtcgcggtattttccttgggctgatttccagagcctcagaatggttgcctttgacaattgtgttcagttttacatttgccctgagggaaaggagccactgacctcttcactccaccgtaaccggaagtcgcgtctctgctttgttttggagaatccatgtgtgactacttagaagcagtgtgagcccagtggagcacagccatcccctctctactctgtcgtcttcactagttcccttgtccctgctcacatgtgggaagagagattttctgcataggcataggattcagaaccagtggctctacctgagtctgtctgtggaatgaggtacacctttcttctctgtgcgtcttcttcagtctcagtctcttggggtccctcgttttccttgcatggaaggccctggtcaactcagggtgtcaggaaaagcccacttacctttgtatttgctttgtaactacttggcagaatgtgactgactttaattcataccatttattgtttcactaaataggtatgttttttttctttcctcttaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggtaagtcagggcaaaaagggtctgaaagctcactcttcactgagatcctacaggagtacatagtcaaacaaagaaatctgtgaattagcaacttgcataggatagcatctgctctggataggaaggtctccaagtgtttcctttcaccataatctcttaagcactgtaattgtgaacctttacagttgtaacaatcattaaaaacaactgtgaaggtcatagttcttttattcagaattaaatagaacagaaggatttttcaggtgctatttctaacaggttaaacctagggaatatttccacaggagaccagtaatctacttgtgatcttccagggcttgctcttcttcttaatttgataggtaaaataatgtgaatacaacatgagtcctctaacactggctggactctacagggtctaaaatgtctatgctgctttagcatttagaaatacacgagcctaaataaaggaagagccctaagtgtgatgccacagaaaactataacgccctgcaggtgatggagcactggggaggggagggtacagaaaggagaagctgccagaaacccagtgtgaagagcccattcaggaagtggagtgaggatgtagaaataagttgatttttatgcatttcttcccagagaacctcatgtgtatacttagtatcttagactttacagtgaaattcttaggctggtttctttctttggaccttagatagctttgcctctctagttattttgagcttaactttaccagaatgactcaccgtaattctgattgttttcttttttttctttgtaccagttattcttgtccaaaggtagctctaatcagtcaaaaatataatttatttcaaaccctaatttattatttaaaacattgcttttgagctggaacagaaagggaggaggacatgacatggaatgattttttccagaccacagtttttccaaacacatgtgtgttttctcccctctaggggtcactgtgaagtggggtacatgtagcccataagtgaggtttgttgtctctttgctagggagaggcgtaggtggaagattaacagacacaggtttagaatagagtgtaataagtttgccacatctattgtaattacttggcacaaccatccaaattcatgcttaaattttgttagattgaatattgctcagtttgaacttttaatgatgtcttaataatagaatgctttttaataacatttttcaggtatgtagtcagaaccaggctatcttcatggtccgcctggtttgtagcctgattttctctgggtgtaaagtgaggaaggtttccactccctgctgtagcctgaagagagctctattacctagttccaagaaaagataatattctgttagatgtttttgctgctggaagctattcaagaattagttccgaaaaataagtaagatagtaaaattgattattactaaagactgtggggcccctttggttaaaaattgattattttcccgggcttttggccttttcttaggaaattagagatctatatatgggtaaaagaagaaaaacatgttttaggagcatcatttgtatctaatatctgttctcttgatacctgttaaactttaatcatatagaaagatttgaatagaaaagcaaatatggagtcaagccatatacggtagaggtatagaaacttagaaatttataactaaacgttatttctaccacttcagcaaactgaagactattcactgattcatttaaaatatgtggtggccattattatgtggaaacataagatacaattatcaaaatacttcatttgcatctggtatgaaaatgttcgtttctgtaaacaaacttgaattgtcacttaccaggtcttacaagattagtttgtgttatttgacttagtttggcttagttggatgctgttgaccacatctgtgcctaaatgcataatgcgttagcagccctgaaggggtctcctggtccaccagtgagttgtggacagcttaagaagcaaatgagctatatcagaattgcacaaatttcagtgacattggaggaagtttcttagagataatcaacagcaggattgttgggcaagaagttctgaatgtagggagcagaaggtgggtgctgaacgtggagggggccttgtgtactgtgtctgccatcacttttgcattgttggggccttggggagtttctgctgtgctggggtcacagtttttgccttttggcacattatgtcattgtagttgtaattcttataattcatattttaggctttgtgggtaaatatttagtacctaaaaagtttagcatgggtactatgaaaaatttattttctggctggttgtggtagctcacgcctgtaatcccagtgctttgggaggctgacgtgagaggattgattgagcctgggagctcaagaccagagcaacatagtaaaaccctgtctctaccaaaaaaaaaaaaaaaaaaattcttgaaattaaaaagacttgaagactaatttctgttttcaagtgtctccataccagtgacataccgaatttatatatggagtataagttatttgaaagttcaaagtattgctgagaaaaatacagtaatgaaatactacataaaataaaaactgtaagtgccagagaatttaatttccaaatatttggggatctcccaactatctttttgttactgatttctactttaattccattgtgatctaaaagcatgcagtgtataatctctggttttttgagtttattaaggtatgttttatggcccagaatttggtctgtcttggtgaatgttccgtgtgagcttcagaggaatatgtgttctgccgttgttcagtgaagtggtcttcagatgctcattatgtccaattgattgatggtgctcttgagttctgtcagtcagcaactatgttttgactgattctctgcctgctggatctgttcatttctgattgcgtgcccttgaagacttccattgattcatcggtttctccttgcacagttctatcagcttttgccctacaaagtttgatactctgttattagcggcacacacattgagaattgttacgtcgtcttggagaattgaccctttttcattatgtaatgctccttactaccactggtaacttcccttgctctaaagtctgctctgcctgaaattaatatagctcctctagctttcttttggttagtgctagcatggtatatcttccttcattgcttactttttgaaaagatttattatagtaaaatatgcactaacataaaatttacaatcttaaccatttttaagtgtagaattcagtggtattaaatacgttgataatgttgtgcagccatcatccgtctccataactcttttcatcttgtaaagctggaggtttttacctgttaaacaataactccacttctcccagccctgggcatccattattctactttgtctctgtgattgtgactactctaagtacctcatgtacatggaattgtacagtatttctctttttgtgactggcttatttcacttagcataatgtcctcagcgtttattcatgttgtcgcatattgcagaatctccttcctttttaaggctaaataatactcatcatatggctgtaccctattttgtgtctccatcagtgaacacgtgttgtttccatacattagctactatgaacagtgctgctgtaaacatgagtgtacaaatatttcaggaccctgctttcagttgtttggggtgtgtacccggaagtggaattgctagatcatatggtaattgtatttttaatttttggaggaactgccaccgtttcctacagtggctgcaccattttacattcccaccaacagtgcacaagggtttcagtttctccacatcctcattaacacttgttattttctgttttgcttttttaatagtaaccatcctcaaggatgtaaggtggtatcccattgtagggctttttgtcttgtgtaaatgaccacagatacattgtagttttgatttgcatttccttagtgtttagtgatgttgggcatcttttcattgttcattgactattcgtatatcttctttggagaaacatctattcaagtcctttgctcgtttttgaatcaggtttgttgttgttgcattttagttctctttctattctggatattagtcctttatcagatatatgatttgcaagtattttctcccattctgtgggttgcctttttactctgtcgatagtgtctgttgacgcacaacatttaaaaatttttcagccaggcacggtggctcacgcctgtaattccagcactttggaaggccgaggcaggcggatcacgaggtcaggaggtcgagaccatcctggctaacacagtgaaaccccgtctctactaaaaataaaaaaattagccgggtgtggtggcgggcacctgtagtctcagctactcgggaggctgaggcaggaaaatggcgtgaacccggaaggtggagcttgcagtgagccgagatcacgtcactgcactccagcttgggcgacagagcaagattccgtctcaaaaaaaaaaaaattttcatgcagtccaatttgtctattctttgttgcctgtgcctttggcgttacatccaataaatcattgccagatccagtgttgtgaagcttttgctctctgttctctcctaagagttttgttctttccttacatttaggttggtaatccattttttagttcatttttatatatggtgttaggtaagggtccaacttcattcttttgcatgtggatattcagttgtaccagtaccatttgttaaaaagactgcccttttcctgttgaaggatcttgccatccttgtcaaaaatcatttgaccatatatctgaagttccagttttgggctttctgttctgttccattggtctgtatgtcatgctgataccacacagttttgattgctatatctttgcagtaagttttgaaatcaggaagtgtgagtccaccaggtttggtgggtttttttgttgttttgttttgttttgttttgtttttgttttttttgtagagattgtttgggttggccgggcacggtggcttacacttgtaatcccagcactttgggaggctgaggcgggcggatcacgaggtcaggagatcgagaccatccttggctaatacagtgaaaccctgtctctactaaaaatacaaaaaattagccgggcgtggtggcacgtgcctgtagtcccagttactcgggaggctgaggcaggagaatcacttgaacccgggaggcggagattgcagtgagccaagatcgcgccattgcactccagcctgggcaacaagagggaaacactgtctcaaaaaaaaaaaaaaaaagattgtttgggttattcaggatcccgtgagattctatatgaatttagggtggatttttctatttcttcaaaatacatcattggcattttgatggggactgcataactgcattgaatctgtagatcactttgggcagtatgtacattctaacagtattgtcttctaatcaacaaatatggtatgtgttttcatttatttatgtttttttaatttcttagagcagtgttttgtagtgtgtgtttgtttgtttgtttgtttgagacagagtctccctctgttacccaggctggaatgcagtggcatgatcccgctcactgcaacctccacctcctggtttcaaacgattctcctgcctcagcctcccgtacaggcacgtgccaccacgctcagctaattttttgtattttaatagagatggggtttcactgtgttagccaggatggtcccaatctcctgaactcatgatctgcctgccttggcctcccaaagtggtgggattacaggcgtgagccaccgcgcctggcctgttttgtagtttttatgatacaactcttccacttctttggttaattcccgttggtgttttgttttggttttggtggttttttttttttttttttttgagacagaatctcactttgtcgcctacgctggagtgcagtggcatgatcttggctcactgcaccctccaccacccaggttcaagcgatactcctgcctcagcctcctgagtagctgggattacaggcatgcgcctccatgcctggctaattgttgtatttttagtagagacggggtttcaccatgttggccaggctggtctcgaactcctgacctcaagtgatccgcccgcctcggcttcccaaagtgctgggattacaggcatgagccactgtgcccagccctaaattattatttttgatgctgtcgtgaatggaattgttttcataatttccttttccaactgaccattgttagtgtatagacatgcagctgatttttgagtgttgattttgtatcttcctactttgctgaattcatctattctaacagactgtttttgtggaatctttggagttctctacattgtaaaatcatatcatctacaaacagagataattttacttcttcctttccagtttagatgccttttatttctttttcttgcctgtttgctccggctgaaatttctaatactgtgttgaagagaagtgatgaaagcaggcatccttgccttgttcctgttatttaaggaaaagctttcattcgttcaccattgtttgctgtgggtttttcatatatggcttttattatgttttggtagttttccttctattcctagtttgttgggtgtttttgtaatgaatgggtgttgaatttgtcacatgctttttctgcaccagttgtgatgatctttggctttttccagtctgttaatgtggcatattaacattgattactttttatacatagaattatccttgcattctgggaatgagtcccacttggtcatggtgtatgaatcttttaatatgctgctgaattcaggttgctagtattttgttgaggatgtttgcatgaatgttcacaagcgatactcgtttgtagttttctttcttttttttttttttttttttttttgagacagagttttgctcattacccaggctgagtgcagtggtgtgatcttggctcactgcaacctctgcctcccgggttcatgtgattctcctgcctcagcctccagagtagctgggattacaggcatgcaccacgaggcccggctaattttgtatttttagtagagacagggtttctacatgttggtcagctggtctcgaactcccgacctcaggtgatccacccgcctcggtctcccaaagtgttgggattacaggtgtgagccaccgcgcccgaccctgtagtttttcttacagtgtctttggctttggtatggggatatgctcaggacatgagttagaaagtgttccctcctcttcagttttttggaaactttgagaaagattggtattaattctttaaatatttggtagaattgactagtgaagccatcaggtttggggcttttctttattgggtgatttttttttttttctttgagacggagtcttgctctgtcacccaggctggaatgcagtggcacaatctccactcactgcaacctccgcctctcagattctaagcgattccctggcctcagcctccaaagtaactggaactacaggcacatgccaccacacccagctaatttttgtatttttagtagagacggggttttgccatgttggccaggctggtctcaaactcctgacctcaggttatccacccatcttggcctcccagagtgctgggattacaggcgtgagccactgcgcccagcctattgggtggtttttgattaccagttcaatctccttactagttacaggtctgttcagacttttctatttctttatgatttcgtcttgataggttttgtgtttctaaaaattttttcatttcatctgttttatccagtgtgttggtgtacagttgttcgtaatactttcttttttctttgaaacggcatctcactctgtcacccaggcaggagtacaatgacatgatcatagctcattgcagcctcaaactcctgggctcaagcattcctcctcccttggccccccaatagctgggattacaggcatgtgccaccactcccagctaattttttttttattgttttggactcttccagagagaagacagggtctcactatgttacccagtctggactgaaactcctgggctaaagcagtcctactacctcagcctcccaaagtgctgggattataggcatgagttaccaagcccagccaatacttacttacttttttttttgagacggagtcttgctttgtcacctaggctgaagtgcaatggcaccatcttggctcactgcaacctctgcctcccaggttcaagagattctcctgcctcagcctcccatatagttgggattacaggcgcccaccaccatgcccggctaatttttgtatttttggtagagatggggtttcaccatgttggtcaggctggtctcgaacccctgacctcaggtgatccacccacctggacctcccaaagtgctgggattacaggcgtgagctacagcgccgagcccagccagtactttcttataataccttttatgtttttttcttaattttaatttaattttctgctttttagagatatgcttgctctgttgcccaggctggagtgcagtagcacgatcatagctcactggagcctcgaacgcttgagctcaaatgattctcctgtgttagcctcccaagtagctatgattacaggtgtgcgccaccactcccagccccttttatttctgtgtaatcaataataatgtccccactttcatttctgattatagtaatttgagtcttttttttttcttactccatctcactaaagttttgtcagttttgtttctcttttcaaagaactatattttggtttcattgattttttttttcccctattgtttttctattctctatttcattgatcattaatctctgctctaaattacctttcttctgctagctttgggtttagattgttctttttctaattcattaagatgtgaagttagggagggttttttgtttcattttatttgttgttgttattgagacaaagcttactcagttgcccagcctggagtgtagtggtgcgatcttgggtcactgcaacctcgacctcctgggctcaagcaatcctcctgacccatagtctcgtagcttggactacaggtgtgtgccaccatgcccagctatctatctgtctgtctatgtatttatttacgtagggacggaggtctcaccatgttgcccaggttggtctcaaactcctgggctcaagcagtcctcctgcctcagcctcccaaggtgctggaattacaggcatgagccaccacgcctatcctagttaggttgctgatagagatctttcttgttttttgatgtgtttgtagctatacattttgctcttagtgcttgctttcactgcgtcccgtaagtttcagtatgttatgtttttgttttcatttgtctctaagtattttctgcttttctttgtaatttctttattgatccattggttgtttccatccctttacttttaacttctcagggtttttttttttttggtttttttttttttttgagacagagtcttcctcggtcgcccaggctggagtgcagtgatgcgatctcggctcactgcaagctccacctcctgagttcacaccattctcctgcctcagcctcccaagtagctgggactacaggtgcccaccaccatgcccggctaattttttgtatatttagtaaagacagggtttcaccatgttagccaggatggtctcgatctcctgaccttgtgatccgcccacctcagcctcgcaaagtgctgggattacaggcgcgagccaccttctcagggtttcatatgtaaagcaggtttcttgtagacatgtatagttgtgtttgtttgtttttttatttttagagatggactcttgctatgttacccaagctgaacttgaactcctagcctcaagcagtcctcccaccttggcctcctgagtagctgggactataggcacatgccaccatgcttgttgttttttgatgtactctgataatctttgtcttttcattggtgtatttgactattcacatttaaagtgattttttgatgtatttagattaatatcagccatgtttgtaattgtttcctattcattatgagtctttttctgccttctctacttttaattaagcgttttatggttttatctcctctgttagtatatcaattttatttatcttttttaaaatttctgcagttgccctggagtttacaatatacattttgaactaatctgagtcctttttcaactaactaatgtaaaaaaggtaacatttaacagattactcccgacccttccctattccctgtgacattgctgtcattattttcacttatccacatgtttatcacccagtacagtgatgatgattactttcaacagttatcttttagatgaataataataagaagaagatattttactttgtctttattccttctctagtattcttcctttctttatgtagatccacgtttctgaccttctatctgaaggaaatcttttgacatttcttgcagggcaggtctgctggtgatgagctccctcagtttttgtttgtctgaggaagtctttatttctccttcacttttgaaggataatttggctggacacataattctaggttggtggtttttttctttgaacactttagaactgtttaacttccctctgtccttgctggcatggtttctgatttctgacaagatgtcctctggaattcttttcgaattcttttccctgttcttctgtaggtccacttgcccccacccagctgctttcaagattttctcttttttttttttttgttttttgttttttgagacagagtcttgctcagccgcccaggctggagtgcagtggcgccatctcggctctctgtaaccactgtctcccaggttcaagtgatgctcctgtctcagcctcccaggtagctgggattacaggctcccgccatcatgcccggctaatttttgtattttaatagagatgaggtttcaccatgttggccaggctggtcttgaacccctgacctcaggtgatcgcctgccttggcctcccatagtgctgagattacaggcatgagccatggcacctggccaagattttctctttttctttggtattctgcaggttgaatagaatatgtcttcatgtagctttgggggtatttattccacttgatgttctctgaattctttggatctgtgctgtcagttgttaatttggagactttttagctattactacttcaactgtttctctagtctctccttccagcattccacttaccaggtgttatatctttcgaaactgtcccacaggttttggatgttttgttctattggggatattgtttctgtttttgtttttaattcttgtttctctttgccttgcagtatgggaagtttctgctgacatatcttgcagctccctgactctttccttggccgtgtcgtctcctgatgagtccatcactgatagtcttcgtttctcttagattgtttttattgccagcatttcttcccatctctctgctcacacggcccccttgttcttgcatgctgtctactttttccattagagcctttggcctaccaatcattttcaatttcctgtatgataattgccatccatgttatctccatgttcctgcaaccattcagttgtctctctcagcctctggtgagattgttgttagaccttcttctgttctgcattcctaacactctcttgcatgtttctcatctccttttctcccagttccatgttctgagaacttttttgggatcagtcctccagttaagtgattctgtagtggtgcctagcctgccacttaagtcctgattctgactatatttattatttataagttttaatttactttttttttccaaagatacttagtagctctttatattctcttgttccttgttttttttttctttctttaagcatttcacacatagttactctgtgtttgaatgaaaccttgagcatccagattcgttttctgctgatatcacctgtgatgtattatttccttttgcggatggagtatattaggaggttatgttttgctcagcttactctgtgagaaccacagccctccatagtggatgcttccctgtgagggttggcgtctgctgatgcgagagctgcctgagacctgggctcctcttgagggcctccagactgctgcccccacacgtcactgtggcgatggtgtacggctgttccttcccctcacctccacctcgcttctctcatgacctcctgatacttcttttcatcctttgcctttgtcgatagcagttggttaccaaagtgttcagtgtcatttctctcagatctagagctaagtagcccctcttacctagcaaggcccagaccaggggggaagaacggccttcaagagaagagcaaagccgagcaggtgcggctgcattttgctgctccttccacgtggcctaggagtaggaagttaacgactacagggcctgaatctataccggaacccaaggcatgtgactttgaatcctgggtctttttcatccaacacggaggatgtactgtgaaacagttggtgtactaagaaacggcctagaagtgaagacagggatgtctctaagtctccactgagaactttgcagtggagcatttgcagtggccactgggttctggccctcaggagttcagtgtatcaagtggagcctggtgacgtggtgtaaggggaggaccgggtgccaagtagccttggtcccttgttagcttcgagggccagggtgtatctttacactccctctctgggttactttgagacttaagtaaaaccactggaaacgcatttaatacagttaaaatatgattcagttaaatatagtttaaagtataagtgcagatttagattgggcaggtaaagctatgtggataatagggtcataaataggttgcaatatggggatcacattgtgatcttcgacctgcatgttcttttagagctgagattcagctcttccagcctgaaaactggcacagccaaagcaaagatggtccttcgcctctttaccaatctctgggagaaataccaaaaaacctgttaagcagaaatacagagagtctgtcatcttaaccttttcgttactggggatacaactggaactcatttttgctcggatgcttagtgttgggaacctctcacgtgtgggcctcatgactcagtctgcggctcttgctcctcatgtcttgcacccatgttccatgtccgagtgggtgtgggtggtagaggacaggcgagtcacctagctcctggataaactcagtgtgtgcgcagtggaaagcagtttgttgtgtttgcatatttgtgtcagagctttcatttaaagcaacagttttccttttctatggattacttcttttgtctcaaagtggataaaaatgcaaaacttctgctagttgaagctttgtgggtttgtataacgagtgaaattggtgttctgattcaatagcgtagtccacgttctgagagagttactttacagttatatcattggtggacttataaagtcatggtccaaaaatggtctaggtgacagacacctattttttcctgaaagaaatccataagctattgaggtcagtaggcatcttctgcaaaagcattaaagaaaatacaactttttttgttactgatccctgttacttttgtccctacaactgggcttccgtttttgagtgtgtggggttctgaatagtgtgtaaatcaaatgcgtagaatcattgccgtatgtttccaatattacagttatatagatgcattcccttattcctctaagctagacactgttcagcaaacacttattgaacacccaatatgtgccaggccctgtgctagactctaggaagacaaaaatcggttagtcttggcccctcttttcaaagagttcacagtctaaagagaagacaaaaacataatcaaaatatcaaaatgttgtgacttacagatgctaggcagaaaagtaacaccgaagagagaaaattttaaatgagcccacgggtggttttgcagaggaggtgatgctgatgaaatagggttttgaagcataagcaagagctctctgaacacacatgggtggtggagcccaggctctcagccaggcttttcaaacctgaaaccaaacaactcatggtcgtgtcttgaggagtccaggaggcacttaacgtagcttcagagccctgagagtgcttctagtcatggtttaccagctgggccggcacaatgggactgctgctcaaagctagcagtttggcatctgtcacgggcttctgccttttacaagaaggtcctcaagaccaagaagtcttctacttgttactttttgtcaattacttctcagcaaagcagctcttagcttatcgctgctttgtagaaatgggtatctattgaaatacgtttttttattttcctggctcttgtcccatggggctcccttaccaaaacaatgacttcaggccctttactgtatcctgggtggcccgtctggacctgtttattcctgctgttgagtcctgagtgtctgctctaccctcctctccccctttgccttcctgggcctgttccaggtcagtggactcgctgagctgtccagcagcccagaggggagtgcttcctctctgctccgaagcactgtggaagaagggcaaggtggaaaggtttggtcggttggtcaggtgttttgtgtccagggactctatgtctatataagtagtctctatatagtagtctctaagactattgtcctagaaaatcaaagcagtgcaccatcacactcactgaatacttactatgggccaggcagtgtgctcaactcttaccatacccctggaggtaggtatttccagattacagatgagaaaactaaagcacaaaaagattgagtgatttgcctgaggtcacacagctagcaaaagggagagctggcatccgagctcgccagactccagagcccaaaggccaagacgtgggactagagttcagatctagctgtcacctgaccgtgcctcctcatagtggagccagcagtggtagctcctggactagatgtgcagtcccagctttcatcttgatagctccagaattcctcctttccttgccaccttcactgccattgcttcatcctttctcatcccctgactaacctactcgtcctccttccgccttctggttcatccacagcattgccacaaattgatctttccacaaagctgaccaaatcatctcactctgctgtttaaatccctctgtgactccccagccccttcagaacaaagtggtacaaagttgtctttggcctggctgctgcccacactcaacctggagcctgtcagggtgtagcactgtcatccctgtacgtgcgccatccctttgctcctaacctcttcctgtcctccctctgccccagccaggccagcaggattctgccgaaccatcgcccattcttaagaaccctccagggaaccctcccacttgagtttaaagaattcactactcatttctgcatcccagaggatgtgatgaccaggttgcccataactgggcacttctcctctccagcagacagaagtcctgctgagggagaaccgtatgtctgcccagcattagcaaggactgggggagaagggccaggacccagatgtcccacctcatcctagagcgcatataatttggggaaaggcagacatcaaaccaacaggctacaagtaggtctcgaattataactgtggtaagtgctaagagggaaaatgacggattttagtgtgttcagtgggaaggctcgccttggtcttgggtgttggttcctgggaggtgacagcaaaggcaacgccggcttctctgaggaagcgatctttaggccgaggcctgcaggatgagtgcgagtgtggtagcgagctgaggcttgcacattctagagcatggacacagcacaagcagaacttagggccaagaaggtgaataggcgtgtgccggccaaggggaggcctgtgtgtccagggctttggtgagcaggaagggtggaggtggtgggcccagctcccttggaactttgcaggccagagccttgggaagccattgctgcatcctgagcaggggagtgacatgctcgaatttacattcaacaaagatcactctggctgtagtggggagaaggactgggaagagttcgtggtgcaaatgtgcaggctgttgcactgcgccactgtgagaacatggtgctcaggatctcctaaggaggtcagcagccagggcctgttgcctggatagtggctgaggcagagggaggacccaagggggccccagcctgtgcaggagcagccagatggctagtggctcaataaatgcatggatgttggctagccagctggccagaccctgctcaccttcccttggtgccttcaacaatggtctgccccacagggcccagggcggggcttgccaatgaggcagctcctttgagaacgccctggtctttagagcacagtatacaaatttctctaggtcattagatttgtgctgtaccttgcctgggtataagaggtcagtgtaagggttttatccattttcatcagtgattccaaagttgacttattagtgatgatcattaaaatgcttgctgagattaagccgtagaaacagatcttacgacgcacatggcacactcacatgtgacccagtaggaatgtgagaagttactgagttgtctaaagtttgttcagatatactcctcaaggcatcggttgcttttcatatctacatctggttgaaatttgacctgtcgtgtacagtctcataaatcaagtccatgttttgtgagatgtgctccccctgggctgagctcagctcatggcgagcacatcccatgaggctcataatgaattgtctgtctgtagtttaactacttacctaggtaaacagaatattaattttgatatgtgattagaaaatttttttttgtaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctggtaaggaatttgttaaaactttcttgaagttttaaaataacctgagtagactgacatctttgccgtagtctcccgtggaagccctggcgcagctgtagccagctgctgctccaccacctctgtctccagtgggaggcccctcggggctgtcatcctactccatcctctcgcatctgccaccagtcggtcccactgtgtgacagagcggagcaagactctggctccatggctgcccgtcagcccggtgagccacatgggcgtggcctcagcgctgctgagggtctcgtgaccacggtcgggtgcccggccttcaattctcgagcagtggtgacagccagacctcagcccccccggtgcacaggggcaggaagaaagtgccacagttgacttaaatctgtgactcacactccttcctctggttactgcattggcgccacgtggcatctctcccctttactagctccttactccccagctgcctcagccactgaggcccagccgttacttcagtcacagggtcaggggcacctgaaaaggggctggtacctactcctcatctctgtcttcctgcggccagagctcctggcagccccacacccagcccctgcatgtgccagaacagcaggctagacttgacatcctgatctgtgcttaggaaggatttctagctgtgtgaccttgggcaagttgcttggcctctctgagcctcagtttcttcatcttcttaggatgggagtaatagtaccaacctcagaaagtaattttaagactttacgtaactttggaaagcacctagcacaggaattggcacatagtaggtgctcaatacaattttttcttagattaaaagctagttgacttagtgtcatcccagtgggatcctgacttcagtagcacccccagtatcaagtgttcagtcatcagcatgtcttttagggtttagctaagtatgattgctgtcagaagccttaattttcctgttcttctttgaagggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtaaggcttgaaggctcactggccctcggggtctgcaggaaggctgggcttactgacttctcgtctttgtaactcatctttgtaactgccttttacttggcctagccagaggcgtaagtgtaattaactgcccaaaaatgctcacacacagagagctgatcccctaggactttgattagaattttagctgttgtgctagattcctctggggcttcgctgcactgtcttgcttttgtctctgtttctgttcttctgtgatttgagttagggtctcactcttgttcgcccaggctggagtgcagcagtgcagtctcagctcattacagcctctgcctcttgggttcaagcgattctcctacctcagcctcccaagtagctgggactataggtgcccaccaccacgcacggctaatttctgtattttttggtagagacggggtttcaccattttggccaggctaggaggtcattgctttctgagcatgtggcaagatttctcagaagctgctttaggaaaatgctgagcagatgtgagctgacagggctgcctgtcacccagcctagggtacagcccctggctgtcacttagggggcccaaaagcaataatgtgatcagagaccaatggcaactcagtagctggctcgaggaggcctcactagccaaagctgggacagattgagcattaaaaggaatgaggaggctgagtgtggtagctcccagcactttgggaggctgagaggggagggttgcttaagcctgggagtttgagactagcctgggcaacatagtgagaccccgtctctaaaaaaaaaaaaaaagttaaaaaaacaggaagtttgactatagcatacaaataaagtcaagaatccataaggattgggatgctcaaacagagcagtagggtgggaagctccttcttctaaaagcacacctcctctaaatgtgtaagaaggataagagtggcaagtcagcatgctgcacccccagggtaacagctggtgcaagtatgcagcattcatggaggttaacaagggatatcagtttggggaatggagtatttctactgttcaaaagcagcacccatagggtactgacagattacagcaggatgatgggcgcttgtgttaatcaattctcacactgctatgaagaaatacccaagactggatgatttataaaggaaagagttttaattgagtcacagttccacatggctagggaggcttcaggaaatttacaatcatggtggaaagcacctcttcacgggggagagaacgagtacacggcgaagggggaagccccttataaaaccatcagctctcgtgagaactcactcactatcactagaacagcatgggggaaaccatccccacgcttcagttgtttccactgggtcccttccaccacatggggggattatgggaacaaaattcaagatgagatttgtgtggggacacaaccaaaccctatcactgggtaccgacagattacaaaggaatggtgggtgccagactctggaggaacctagcagacagtgccatgcacaccaccatgaaacagagagacactgggtgcatcccattgccacaaactcagaaggatccaacgtaatatttgcaggatttgtgcccagaacattttatccaaatctaccaagacaagacaaatccaaattggcagacaggtagcctattaaaaatgttaagtcttgtgaaaagagaaaagggttggaagaggctgggttagtgggaaagctataatggacatgtgaaggaaattggaaaatggaatatgggttataccttagatgagagtatcctgtcagtgttaaatgccagtgaggtgatcatggtattcagcaaaatgtcaaaaaaagagagagggagggagggagggaaagaaagaaaagaaaagagaggagagagaagggaggaaatttttaagtaaaaagctcggtacagtggctcacacctgtagtcccagcactttaggtggccctggtgagaggattgcttgagcccaggggttcaggaccagcctggacaacatagtgagacactgtctcttagaaaaaggtgattttttttttttctttgagacggagtcttgctccgtcacccaggctgctggagtgcagtggtgcgatctgtgatcctcctgcatcagcctcccgcgtagctgggactacaggtatgtgccaccacgcccagctaattttttgtatttctagtagagatgcggtttcactgtgttagtcaggctggtctcgatctcctgacctcatgatccaccagcctcggcctcccaaagtgctgggattacaggcatgagccaccacgcccggccaagaaattttttttaaaaaaccaaactgtcgatgttctgaggagttcataccgaagtgttcagaggtgagtgtaacttgcagacgttcggctaaaaagtgtgtgtgcctgtaagaaataaagtttataaatatgacagaatattaggtcgtgaagatgaagcaaggtgaaggatgaatgggtactctttgtgtgttctttcagattttctacaggtttgaacatttttgaaacaaacttggcagtgactctcgcctctctaaatgcaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcaggtgagccaagtcctgactggggacgtgggagcactttggaaaatgggtgttatgcctcactaacacagctacagaaactcccctgggaccatgcagtggaaaagtctagtgaaatgccgagggaatgcagggatgtccccagcagaggccatgggtagaggggggctcccatctcagcctgtagttttgcagagggaagagcaggggccgtgggccgccatggataggtgggccaactacgcctaaacactgacagcatcgggggtgtgcattgttttttactcattgtataagttgtatttgttatacctagggtggaatcagaggaaaatgaatgaaatgtgtatatagtaaaaacacaatacaacaaacactcaacaggtgtgtttttttgttttttgttttttttctctgagacagagtctcactctgtcgcccaggctgaagtgcagtagtgcgatctcagctcactgcaacctccacctcctgggttcaagcgattcttctgcctcagcctcccaagtagtgagactacaggcatacgccaccatgcctggctaatttttgtatttttagtagagatggggtttcaccatgttggccaggctgatctcgaactcctgacctcaagatccaccttccttggcctcccagagtgctgggagtacagacgtgagccactgcacctggccagactttctttttaagacaaattctgttacctttgaactcgcctgtttgaagctataccccttttcgaagccccttagtatggaagctgtggtggcaggggcagtctcagaaggagtcattggagagactacgtgttcctgttcagtggcgctctgtgagcactttgagggaccgcctgcatgcatgcgcacacgccatgtctcccacgtgagccccttgctgcttgtgtatgactccctagtaaccctgggactatgcaccctctgcgctgcctcttgtctgtgaaatgggcaggacagtgggtggtcatgtgcaacaatgtgagtcattgcctcccgggccggccacttgctgatgagcttgtatgcggttttgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcggggtgagtgcatgaggtcagcgcatcatgatgtgggaagtgtgcaacacacgggctcctttgcagaaattctgtactaggttgaattcggggtatattccacttctagggtatatccattgtaaagaaacaaagaaaaatatatgcccaaagatttagccataatgattttttttcttcattttttactttgtggtttttaaggtaactggtaaatcagcagtgaggtattcctactgaatacccattggtaggaggttgttaaccatggtgtatccatatggtggaacattgtagccagcgacagcagcgttgtgtgtgtgcagttgggtttctcttgtttgaatacagagggcgttggtacacacacatacttgtccatctttccagagctgtgatttaatttatacaaccaattatcacccactgtttaagagggatgggtgacaggaatagcaggggcttatagttgttctttttctgctttagctctgtttgcatttcctaaaatgttcacatgtttttatagcaagaaatttggcagtaggattcagggctttttttggcaccaaaaaggaaacccacaaatggatggaaagatactacagacacatttattgacatgaaaagatattcacaccatgttaaataacaggtagaggccaagcatagtggcttatgcctgtaatagcagcactttgggaggctaagggaggatctcttgagcccaggaattgaagaccagcttgggcgacacaggagaccctgtctctacaaaagataaagaaaattagctgagtgtgacagcacacccctgcttgagctcaggaggtcaaggctgcagtgagctatgatcgcaccactgcactccaacctgggtgacagagcaagaccttgtctcaaaaataaataaataaataaataaataaaatacattaatcaggatttgtaattgtttccttttcagtttaaaaaatccacttatgtgcatagctatacatgctttatcaggtttttcatgaatatgtaaaatttgagagtaggtatcaaaatgccacttttgggtgacttgctgataggtttttctctttttctgctggttgttgtatttccttatttttcacaacaaatatatactacttgagtaataaaacagtttatttttggaggtgtggtctgaaatttattatattcaaaatttttaaaacttaagcataactttgttgtttttctcagcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaaggcaagtgacagttctcagcacctggaggcgccaggtctgagggcatttgaaggtgccgtgccacgccagtctctaggcagggctgagccacaggaggtcggggctctgacgtgtgttcacttgcccacaactttgttctgagagccagcctgtctctggtggcctgaactggagactggtaaaaaacttaactttgtgttttcgggaaattacttccccttttgtagaatgggtttgttcttgtgctggccatcatgagggcagcagcagacactccagctttatctgctggagaaccttcttttcgaagaaaggagccgtcaactgtagagatgatagaagaaaggcccaggtgggcttttggggcctgtgggttcagaagtgtctttgatatgagactggggcggggcacttggcacagggaagtcttctggactcaggtctgagcatgtcccccatgctgctcttgtcccactgctgttccagatgaagaccagcacatggcattgattagaggggaggaaaataagtcttcatgggaagacatgagcagttccctccttaccagagggcatggtgtgtcacaaaaagcaaatgtcaaatacaaaaaacgttagccagtcatggtggtgtacgcctgtagtcccagctactcaggaggctcaggtgggaggatcacttgaacctcagaggtggaggttgcagtgagccgagattatgccactgccctccagcctgggtgacagagtgagactgtctcaaaaaaaaagacaacttttttctcttggaggattgtctaaatgcccctatgctggagcagttccaaagagccttctggtttcagctccctaaaagtgtcaggctccaagaaccagacctcagtgagcagatgtgggctgcatgcagagggaacttgtaggttcctggggttctgacagtaggacagtggtcttgggaagaggccaggtttctgtctgcagcatggtcaggcaaaaaggtgaggaagaggacgatcccacagtggaccagagggtgggcccgatgtcctgtgttgttacttgtatcttagctgttgtgattgttctaccctcaagagctctgctcatacctcgcagtcctacagtagatttagactgactattgggcctgattgggaggctttgggggagaagccttgtcccgtgccccagaagactagagactgctggagtgcagagaacacagtgtgtcctccattcaggagcgtccagcatcggggtacccacgatggtccaaggccctgagacgtcccattgggattcactggaggcctctgggacgccttcctgagttttcagggtactctccaccccaggctcttgccctctgaccttgcaggtggtctgaatccagacttgaggcccagctgaaccttagaggctgatgtcataggccctgcccagcacccagtcccacctcgagggaccacctcctggtgctttctacgctgcacccattttacagagcagctcacagatgtgtgttgaggctcactggctggctggttgttgaagggacagcaatagttgacctatggactctgtcccgtagcaggtccaaaccgggggcctgtgctggggcagccgttctgctggagaccagggcacctgcctttacatgcttgttatttgtccatatattgacaaggcacgtgtgctggatttagatcagctctgagaggatgccaactggccagtgtgtgccagcgagtgtcctgatggagttggtctctcctctgctcccgtgcaggcccacagctcactctagacactggactgcaggacccatccacgaggtggctgctgggtgctgctcctgacatacacatggagaaggatgttaaataatttttacttgaattgtcaaatgaaatttttaataacataccattgttaaatttttatcataatttttaagtttttcaaaagacaagtcaatttgcctgtttaaaatattgtgaaaaataatttacacttggggagtacttttctatttctctaggagaaatgcttttggcagagtttctcataagccccagcatttctaaaggttggtggtgggtggagccgtgctcctaacactgatgactctcatctgctttctgaacacaaagaacagtttccatttgtgcccctggagtttgtgtgcatcactactcaaatgctgtctttacttgggatgaaaattaattttccatcaagttggacagtgagtcatttgctctgtcacatctgtcacactagtgaaaatatatggcacttctgtttatctgctagggtgggaagaaggaatttctagttctttactacacattgctttttgtggtgccatcacagctcattgcagcctcaacctcctggcttcaagcgattctcaaacctcagcttcccaaatagctgggaccacagtcgtgcgccctcacatccagctaattttgatactttttgtagagacggggttttgccatgttgcccaggctgctcttgaactcctaggatcacaggtgtgagccactgcaccagcctggtacacatttcttacattccctgttcaagtgaatgcattagccttcgcctggaaaggtgggtttgctcagagttctggcggcacgtgtacagcctcagtactgcccgggcagtctgtggtattggttacatcatccactcggccaggcggcatgatgccctgccgcacctgtgagggggtagctgactccctggatgtgtgctttgcagctgctttgtccttggttactgtgtttagtaccaggtcaaaggctatcgggaattttttgttaactaccacccccccccccacacacacacacacaaataagtaagcatatactttagtaaatagatgaagtttaacaatcctgcagagtaagagaattggaggtgggtgtgtgttaagttttgatttattacagcctcttcagagtttatgttccatatgtgattcgtttttgaaattatcttagtttttctgtatgacttaatttttagcactcactgtagtcttaaattgccttctttttgcattggcagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattggtaaatacagaatagcgggaaggtatttctgagcgatgcctggttttccatgtgtgatgtgctagtataggaaaacactgggtttggcatgctctcgccatgtggcctccctcctgtagaaaagagcgtagaggggccaggcatggtggctcacacctgtaatcccagcactttgtgaggccagggtgggcagatcaccagaggttaagagttcgagaccagcttggccaacatgctgaaaccctgtctctactaaaaataacaaaaaaaaattagctgggcttggtggtgcacctgtaatcctagctactcggggaggctgaggcaggagaatcgcttgaacccaggaggcagagattgcagtgagccaagatcatgccgttgcactccagcgtgggtgacagagagactccatctcaaaaaatacatatagagagagagaggatttctaccccctccagttccccaactttagttccccaacatcagtatttcccatgtttgcttcgttattctctctctccctctctctcttatttttctggacagaaggagagtcacttcatacatgatacccctttaacctaaaatacttccatgtatatttcctcaagataaagacacttataaaaccacagtacagtgatcaaaatgaagaagttgacactgatccaatgctattctctaattgtagaccttactcatgtttctccaattgtccttttaacatcctttatagcaaaaaaaaaaaaaaaaagctcttgttgtttctcctgacatgggatccaatccaggatcccatgtcgtatctctttaatttcctttcctttggatcggtttctctgtttttcatgacctttacttttttgaagagtgcagcgcatttattttttagaggatcccttggtcagggtgcatgccccatgtcttcccagtcaggttcagataccatgttttggcggcaacaccactgatgtggccagtccctgttggtatatcccaccaggaagtgggtgacggtgtctgtcccatcactggggatgggaactctgatcctgggttgagctggtctgcccattttcactacggtcaagttaatatttctcctttgctaattagtaagtgtcttatggggaaatgagtatcctgtttttattgaacattcaccgactagttgtagcatccattaatgattcttgccggaaatgtttattactgtgttgtcatatggtgatttttttttttttttgagatggagtttcgctcttgttgtccaggctggagtgcagtggcacgatctcagctcaccacaacctccgcttcccgggttcaagcgattctcctgcctcagcctctcaagtagctgggattacaggcatgcaccaccacacccggctaattttgtgtagtagagatgggatttcaccttgttggtcaggctggtctcaaactcccgacctcagttgatccgcctgcctcagcctcccaaagtgctgggattacaggcgtgagctgccacccctggcccaaatggtgaattttctaatattattctttctatatttgttacttgccattcaactgtaggaagagctttccaacctcatgtgtttttttcattcacttagttatatcaggatagatccacgaagttttacttgatgctatagatgagaatcttttacgaacactctttatgttgctgttttgattgtctgagattcggtcagtgggagccccctcggaatggctttttccttagaccatttgatgcggccctaccagcctttaagcattttatactttgtgtcatggttcgatgctccgggctcatctcgtgtcttctctctcccagccctgaaccagccatttctccaaggagccctcctctttcttcaacagtggtgttcagaaacccagacctggacactgccatatggcattgcttttaggccctctcagtcagcagagcaggaggagtgggggtgtgagcatgtgcacacgagcgcctgccacctacacacactaattgctatgtacaagccgtgagttcccacagatatcccagccccactcctgtgctacagtgagcgttctcccttccccgtccacctttgtaactccttagacagtaagaacctggaccccatcatccatggtgcctttactgacttgctgagtcctacaacacaggtaaagggttcagaagtccctgcccttacccgatggaaaactccgggcatgctttcggtatttgttcagttctttttgtctttagcctcagggtgtggtgattacactgaatttacaaatgacttaaattagttcttttcacctttagtacaattacgttattgattgaaaacacacctgattgcgtttttccatttgtgttccatttgttttctcccctacccagttcctctttttttttaatctgttcccacccactccctgtaggtaactaatcagtttcttatttgcttttcttttttacataaaaggtagtgtattatagacataatagtgacttctgggttcttttctacttcatatattctgggaatcactgcacatcagttcgtagagattgtcctcattctttctgcagcgacacggtactccatttaaagtgtacgatgatttctgcagtcactcttctttgtgcgagcgtttaggttgtttctaatgctttggttttttgtttttgtttctgttttaaggtggagtctcactctgtcatctaggctggagtgcaatggcgcaatctcggctcactgcatcctccaccccccaggttgaagcaattctcccacctcagcctcccaagtagctgaaattacaggcacgtgccaccatacccagctaatttttgtatttttaatagagatgaggtttcaccatgttggccagattggccttgaactcctgaccttaagtgacctgcccaccttggcctcccaaagtgctgggattacaggtgtgagccaccgtgcccggactcaatgctttgttttaatcattacacccagtgctacagtaagtacttgtgtgcatatgtgtttccatattgtttggaggtgtttccttggagcactttcccagaagggagagggctgggtcaaaaggtaagtgtgttcccggtgtggtggctcacgcctgtaatcccaacactttgggaagctgaggcaggaggattacctgaggccgggaatttaagaccagcctgggcaatatagcaagaccccatctctactaaaaaaaaaaaaaaaagccacttatctgggcatggtggtgcacgcctgtagtcccagctacttgggaggctgaggcaggagaatcgctggagcccaggagtttgaggctgcggtgtgtcatgattgcaccactgcactccagcctgggtgacagagtgagaccctgtctcttaaaatttaaagcagccgggcatggtggctcacgcctgttatcccaacatgttgggaggccgagggaggcggatcacgaggtcaggagatggagaccatgctggccaacatgaaaccccgtctctactaaaaatacaaaaatcagttgggcgtggtggcacacgcctataatcccagctactcgggaggttgaggcaggataattgcttgaactggggaggtggaggttgcagtgagccgagatcacaccactgccctccagcctggcaacagagtgagactccatctcaaaaaaaaaaaaaaaaaattaaggctgggcatggtggctcacatccataatcccagcattttgagaggccaagacaggcagatcacttgaggtcagaagttcgaggccagcctgaccaacatgtggaaccctgtctctactaaaaatacaaaaattagtcgggtgtggtggcactcacctatagtctcagctactggagacaccgatgcaggaggatcacctgagcctgggaggcggaggttgcagtgagtcaagatcacgccactgcattccagtctgggcaacagagcaagaccctatctgaaaaaaaaataaaataaaaatttttaaaaaggtaagtgctttcatagtttttttgctagctacgtccaagttctccaaaccctccagtcagcccacccaccagcagcatctgagtgcctgtttggccacagccttgcttatagagtagttgtcaggctttttaactgttgccaatccgttagctacagtaagccctcagtgtagttttcatttgcatttttctcctctaattacaatgaggtcaatatattattaagggctatttctttttgtgtgtatgaattttctattcatacctatttctcatttcttactaggtttttggtcttttcccttttgtatttaagaattttgtttttgtttttgagacggaatcttgctctgtcgcccaggctggagtgcagtggcgcgatctcggctcactgcaagctccgcctccgggggtcacgccattctcctgcttcaacctcctgagtagctgggattacaggtgcccactaccacgcccggctaatttttatatctttagtagagacggggtttcaccgtgttagccgggatggtctcaatctcctgacctcacaatccgcctgtcttggcctcccaaagtgctgggattacaggcatgagccaccgcacccagccaagaatttttttatatggtagggacattagccttttactcatgcagtatgctgcagacattctctcccagttcataagttgtcttttgactttgtgtatgcttttcagtcaggtggaaatgttcttccttttatgcggtcagcttcttgattttttattgcctctggattttgaataattgttagaaagctttacgctaacattgtgattaaagaggaacacacccatgctgccttccagtgtttgtgtagtttctttttttttcatttatatccctaatatgtttggaaatttttcttctctgtggtgtgaaatatggatccaatttctctttttccaaatggttagcgagtggtcccagcacattattattatttattcttttttttgggaagtggggtatagggtcttgctctgtcacccaggctagagtgtggtggtgcggtcatagctcactgcagcctggaactcctgggctcaagtgattctcccgcctcagcctcctgagtagctgggactacaggcacgtgccaccatgctggctaatttttttttttttagtagaaacagggtcttgctacattgccttagctggctataactcctgggctaaagcagtcctcctgcctcagcctcccacagtgctgggatcacagacgtgagctaccatgcccggccttagcaccagttattagaaagttcatcctggaccaggtgtgagggtgatggctcatgcctgtgatcccagcactttgggaggccaaagcaggaggatcattcgagcccaggagtttgagactagcctgggcaacatagtgagaccccatctctacagatattttttttaaaatagcagggcatggtggtgcacaccagtagtctcagccacttggaaggctgaggcaggaggatcacttgagcccaggtgtttgagattacaatgagctataattgtgccattgcactctagactggtctataatgagaccttgtttctacaaaaacaaaaataaataaataaaatcatcttgtcccagtgattcaagatgccacctttgtcctacaataaatttctttctttcttttttttttttttttttttttgagacagagtttcactcttgttgcccaggctggagtacaatggcatgatctcagctcactgcaacccctgcctcctgggttcaagcgattctcctgcctctgcctcccaagtagctgggattacagccatgcaccaccacacccggctaattttatatttttagtagagacagggtttctccttgttggtcaggctggtctcaaactcccaatctcaggtgatctgcccaccttggcctcccaaagtcctgggattacaggcgtgagccaccgttcccgtcctgtcctacagtaaatttcaatatgcacttgggtctgtttctggaatttctcttcctttcctctctgtttacttgtgtcattattgcatttagttagttatttttagaggctctacatgttgtaatatctcgtagggctgttctctcctcatagcttttccagctcagtatttcccaggctatttcatgtttgtagttctatatgaactttagcatcaatgtgcctggctccatttaaaaaaagcttgttggggccgggctcacacctgtaatcccagcactttgggaggcctgggcaggcggatcacctgaggtcaggagttcgagatcagcctggccaacatggtgaaacaccatctctactaaagataaaaaaaattagccaggtgtggtggcgagcgcctgtggtcccagctgctcgggaggctgagatgggagaattgcttgaacccaggagccagaggttgcagtgagccaaggttgctccactgcgctccagccgaggcaacagagtgagactctgtctccccccacaaaaaaaaaagttgttggtatctttgtcaggattccattacacttatacattaatttagggagaattgatgtctttatgatattgatcattccttccaagaacaagggatgtttttccatttgttcaagtttactttcaggtcattcaggaatattttaaattttctcttaaatatttttcacatttcttactgagtgtatttctcagcatttaatcaccattgtttttaatttaaatgggatcttctccaccattatattttataattctgaactatccaatacagtagccattagttatatgtcattatcgagcacttgaaatgtggccagtccaaattgagaagtgttataagtgtaaaatatatactggattttgaaaacctagtgtaaataaaagaatgcaaaatatctcagtataatttttaatattggttacatgtttaaatcataatattttggatatattaaatatattactgcaattaatttcacccgtttctttaaaaaaaattttttttaatgtggctgttagaagaatcttttgtgtgtggctcagactcagatttcagattatatttcttatttttttttttttttttgaggcagagtctcactccatcacccaggctggagtgcagtggcgcaatctcggctcactgcaacctctgcctcactgcggactttatttcccaggttcaattccacctcctgggttcaagcagttctcatgccccaccctcccgagtagctggaattacaggtgccgcaccagcacactcaactaatttttgtatttttagtagagaccaggttttactatgttggccaggctagtctcgaactcctgacttcaagtgatcctcctgccttagcctcccaaagtgctgggattacaggcgtgagccactgtgcccagcctcagattgtatttctattggatagtgctgccctaactggttatttatttgtgtatgaaagctattgatttttgtttgtttgtttgtttatttcgagatggagtttcgctcttgttgcccagtctggggtacaatggtgcaatcttggctcactgcaaccttcgcctcccaggttcaagcgattgtgctgcctcagcctcccaagtagttggaattacaggcaagcaaaaccatgcccagctaattttttgtatttagtagagatagagtttcaccatgttggtcaagttggtctacaactcctgacctcaggtgatccacccatctcggcctcccaaaatgctggaattacaggcgtgagccaccacgcccggctgtatgttaactttatttttttattttttattttttttaatttttatctattttttgagatggagtttcattcttgtcgcccaggctggagtgcagtggcgcgatcttggatcactgcagcctacgccttctgggttcaagcgattttcctgcctcggcctcccaagtagctgggattacaggcgcacaccaccatgcccagctagtttttgtatttttggtagaggtggggtttcaccatgttggctaggctggtctcgaactccagacctcaagtgatctgccctccttggcctcccaaagtgctggaattaacaggtgtgagccccctcgccctgcctgtatgttaactttatatattttactttactgaattttattgtttgagtcttactgttgattctctggggttttccaggcattctattatatatgtgtacaaatagagaaagttttacttctactttttcaattcttacgcctctaattgttgtcttttacttaactgcatcttttctgatcttaacagaaatgtctctggtgtttccacattaagtaagatgttggctttagggttaaggtttatatattataagataattatttaaaattagccacattaaaaaaatttaatgttaaaaaaaaatccagcgattcctcatctcttgagtgtttttcattaggaatgggtgttatgggtgttaaacttcaaaggttttctagcatctgtggagataaccatgatgtttctccttagatgtattaatacgatgttttacattatttgatttttaagtattgaactgaacttgaattcctggaataaagctcacttgattatggtatatccttttgttttggaatctgtttacattatttaatatatttacatctatattatttttaggagagatgggtctgtgacttccgtttttgttctgtctgtattagctttgagtatcaatattatacttgcctcataaaaagaattaggaagtttttggctgggcacggtggctcatgcctataatcccagcattttggaaagccgaggaggggtgcggatcacgaggtcaggcgttcgagacaagcctggccaacatggtgaaaccccgtctctactaaaaatacaaaaatttgccaggcgtagtaacacgcacctgtaatctcagctactcaagaggctgaggcaggagaatagcttgaacccgggaggtggaggttgcagtgagccgagaacacgccactgcactccagcctgggacagagagactccacctcaaaaacaaaacaaaacaaaacaaaacacaggaaattttcttgttttttacattttcagtgatctggaacaattcacattgggaccatccaggctttaaaggtttgatagaaatccctttgcaagccccctggacctggtgtgttttctgtggtccttgctagcagtcttctctcctctctggaaattattctatctctagtgaggttaattttggtaaaccatctttctgtagtaaattattcttttcaactagattttcaaatttatttgcatagatgtctgcaaggtagtctagtcatagttttaaatttctttgcaatgattattttcgcctgtcatttcttagtttgtgtatttttcctttctccctattttgcttaagttaatagtttatgtattttgttagttttttaaaatcatctgagtttattatttaggtttactgttcttcttttgtttttttttttttttctttttttttttttttgagacagagtctcgctctgtcccccaggctggcgtgcagtggcgtgttctcggctcactgcagcctccacctcccgggttcaagctattctcctgcctcagcctcccgagtagctgagattataggcgcgtgttactacgcctggctaatttttgtatatttagtagagatggggtttcaccatgttagccaggatggtctccatctcctgacctcatgatccacccgccttggcctcccaaagtgctgggattacaggtgggagccactgtgcctagcttactgtttttctttacctcctttctttcttttttattttttattttaagacagagtctcactcatgttgcccaggctggagtgcagtggcacactcacagctcactgcaacctcaacttccctgggctcgggtgatcctccccactcaccttctcaagtaggtggtaccacaggtgggcaccaccacactcggctaatttttttgtagtttttgtaggaacagcattttgccagattgtccaggctggtctcaaactcctggtctcaagccatctgcccacctaggcctcccaaagtgctaggattacaggcatgaaccaccgtgcccagcctaccttgttaatttctgctttcgtctttattttctttctgtgctttcttttttttttttttttttgagacagagtctcgctctttcgcccaggctggagtgcagtggtgtgatcttggctcactgcaaactccgcctcccgggttcatgccattctcctgactcagcctcccaagtagctgggactacaggcgcccaccacctcgcccggctaattttttgtattttttagtagagacggggtttcaccatgttagccaggatggtctcgatctcctgaccttgtgatccacccaccttggcctcccaaagtgctgggattacaggcgtgagccaccacgcccggccactgtgctttcttttgttttactttcttggggttttttctaactttttaatttagaaattcagttcattttgttttttcttccatttttattgataaaagtgttcagcacgtggaactttcctctgatctttttcttaacaatatcccatggaatctgatagataatttttccttttttgtttgtttgtttgtttgttttgtttttgagatggagtctctctctgtcgcccagattggagtgcagtggcatgatctcggctcactgccacctctgcctcctgggttcaagcaattctcctgtctcagcctcccgagtagctgggattacaggcatgcaccaccacgcctggctaatttttgtatttttagtagcgacggagtttcaccatcttggccaggctggtcttgaactcctgacctcaggtgatccacccgcctctgcctcccaaagtgctgggattactggcgtgagccaccacgccgagcctccattattttttttaaagaaattctgggctgggcgctatggctcatgcctgtaatcccagcactttgggaggccgaggcgggcagatcacttgaggtcaggagttcggaaaccctgtatctactaaaaatacaaaaattagctggacgtggtggcacgtgcctgtagtcccagctactgtggaggctgaggcagaagaatcgcttgaatttgggaggcaaaggttgtggtgagctgagatggtgctgctgcactccagcctgggagacagagcgagactccatctccaaaaaaaagaaattatgtaatttccatgcgtcttttttctttcactcgatagtgtaataggcagcttttaaatttccaagaggagaaactttgttgttgttaataatttacaggtttttttcattgtgatcagagaatattgcttttgttttgcaaaacctattgatactttctgaggcccagtgtatgtcagcttttgtaactcctccatgtgtacttgatagaagtgtattttcttgggtcttggtatagagttcactgtgtgtgtgtgtatatatatgtacgtatgtatttacatatggagatacatatatgtatacacctccatgatacattaattctgttgtttagtcttctgtatatccttattttgtgtcctcatggcctgtcttctgtggcttattattaatatgtttctgtgttttcttgcatctcctgtttccgtgttgtttggtgcacattcctgttatatatttttagttacttgtggctttttgtgttgagaagcggccaccttctggtcgtgctttgtgcctgcggcctaagtcctgctctgtctgcgttgtgactgctgcccctgctctccttcggcccatttgcctgacgagacagccttgtccttggccctttgtttccagcctttttctgagtgccttggttttaggacgttctcttgtgtgaagcaaacctgaggcttgctttgtgagccaaattgaaaatcttcttttcagtcagttaagcccattcacacttagtgatataactatgtggttggtctcaaccctgtcattattttataatttctgtattttctatttactgttttgttttttgggtttttttaaaatgtgttgtggggttttttgcttttttatttaaaaaaaaaattgtggggctgggcgtggtggctcatgcctgtaatcccagcactttgggaggctgaggcaggcagatcacctgaggtcaagagttcaagaccagcctggccaagatggtgaaaccccatctctactaaaaaatacaaaaattagcccaggtgtggtggtgcatacctgtagtcctagctacttgggaggctgaggcaggagaattgcttgaacctgggaggtggaggttgcagcgagctgagattgtgccactgcactccagcctgggcgacagagctagactctgcttcaaaaaaaaaaaaaaaaaattgtccaggtgctgtggctcacgcctgtaatctcagcactttgggaggccgaggggggcagatcatgaggtcaagagatcaagaccatcctggccaacatggtgaaaaccctgtctctactaaaaatacaaaagttagccaggcgtggtggcgcgcacctgtagtcccagctactcgggaggctgaggcaggagaattgcttgaacccaggaggtggaggttgcagtgagctgagatcgtgccactgcactccagcctggcaatagagcgagactccttatcagaaaacaaaaaaaaattggggtattaggaaaatgggtgcttttttcctagtgcattcctatagacttgcataccccactcatgctccttgggcctgggttccctgtgtaccccctcgtggcctgctgtgttggcattagggggtcctctgacacccactcattgcctccacagcaggcagtgagtgaattccattctttgtgttttctctttcctgtctccctgtctctcctcttcccattttttgttggtggtgtttctgctctgtcagaacacacggtattcttaggtacacaatttactacaacagggctcccgcttgcctctgctgagtgttcccaggtgtcttcaggttggtgaagctcatcctcaggcagtggccttgagtagggccacagaattctctgagttctggagaagtaaactttgacctgttgtgttgtcaatgaacagatagtttggttggatataaaatccttggatcaactgatttctcctgtttaatatagtgtggttgttgtaaaaaaattttttcctgataccaaattggttaaagttgtgtttcctgtttttcttacaccaagattttatagactgattattctagttctagtcaggaaaagagagtattagaaatctattatgacagcacttccagcagacatgccagctctttttcctcctcaagttggagctcttttcttctagaacttcttgtgggcggctgctgacatcatgctttcttagatcttcactttttgtacatctgtaaatgctccggccctctctcacccttgcttgtgcatcagtttcctgcatcagcagacggtgttctgtgcttcctttctgctgcttgagtttttaaaaatcgagactcagaatgctttcccatgccctgaagcacctctctgtacaaacatgtggagcctgctgtggctgggggctgtcctcactctccagtcacatccgctattctgtgccaggattgagctattggctgcgtttcctttaacctaatctttcccttcctcctgagtgtagattaccaaaggttgactttcccaggcctttccctgaacacacccagccttcattcctagaccacccagtcccagtggcaccagtgattgtggcctccaccccgctgtgtgccctcagggatacagttgggatccgagatagccaaggctgtcatagagcaggtccctagagagagactcctaagtgacatgtctgtgaacaaacacacttgaaagcacttgcctggtgctgtgtgagttgtcaaaaatattagctgctattatgcgagtaaaacgtgcctcatgctaccatggaaattccccagtggtagaaagaaatggagtgtttattaaaggttctgaaaaattgtcccgtgttgagggctgcagggaaatggagactcacctttaacaaagaaatgtcagtggctcctgtcctctttgttcacatcgatgaggctgaatgctgtgtgcactgcacccccccaaccccgccccagcccagatgtgtgctgctggaccctctttgatacttaaggctcacataagcctccgggaatgtattcacgattgaattagataagtgaccagaacagaacagagaagtagaaattctcaaacttgcctgagagtctaggaaattgagtaattctcaatcaatgatttccctgctatcctgcctgttttcaaagatggttgtgtaattgcagcatgaaatgtagccttggtttttgtttggaacaacttgaaagtgtttggccaggcacagtggctcacgcttgtaatcccagcactttgggaggccgaggtgggtggatcatttgaacccaggaattcaagaccagcctgggcaacatggtgaaaccctgtctctaccaaaaatataaaaattacacaggcatggtggtgtgcacgtttgatcccagctactcaggaggctgaggcaggaggattacttgagcctggaagatggaggttccagtgagccgagatcatgcctgggtgacagaatgagacttcatataaaaaaaagaaaaaagtttttgatgaaatctctggatgtcatatgggtgagatgaatgcctgggagaaccaccttcctgtagggttgatgtctgggtcctcttcctgtcaagggcacattcgagggacagccctttccttaacatgggcctgtcccctgggcagcttctgctggcagctgtgctctgcctgactccaacggagacttagggcagtccctgggcttgcgtgcgaattagatttctgggaatcttcttgctaaagggctctctgatgggctgcctgtcatataatgaccagtcacatggggagtctaggttctggcaaacatgtcttctaacgggacctgaagccacagttgctttgcttagtggacatgtgagttctgcagtttccaggtcagacctgggtgttcataagcacaccaaagagatctgtcctctaaaatctcattttagaaaaaatgtttacaatttttgaagttgtttaaattgagcgaagacaaatgatttcttccgttctgataagatagcctgctgctgtaatttgacttgctgcttctcttttgttttacagatgatgtctttctacctaaagatattgacctagacagtgtggatatggatgagacagagagggaagtggaatatttcaaaaggtaaatgtggaggctgtgtctgaaaccgtggtgactgtgtgcttgccatacatgtttggttttctgtctttccatggcacttctagttgtcttggacgaagttacatcaagcaagccagacaacatggcttctgaagagccttgtagtaggacaggccagccacacacacccctcccatactcccaacactcacacaatcacttctgctccccctcacatgctagaaaaatagttgatggcagtggcttcccccccacccttccccgccaactggctgttgcgcttctgaggcggtggctctccaggtgtcctgggccagcagcgtctcctggggatacaggcccctacttagacctgtcggatcagattctgggaaggggccggcatctacgttcttgacagccttccgggtgaccctcacatatgctgatggttgaacacactggagtggtatgcttttgagaagaaaagtaacattttacatacttgctgttttcctgatgggcaagttttatcagtgcttgttctataatgttttaactactatgtgaattattaatggcaacaaaattttatttattttatttttaagagggaatctcactctatcacccaggctggagtgcagtggcacgatctcagctcactgcaacctctgcctcccgggttcaagcaattctcctgcctcagcctccagactagctgggattacaggcgcccacaaccacaccaagctgatttttgtatttcagtagagacagggtttcaccgtggttaccagactggtctcaaactcctgacctcaggtgatacacctgccttagcctcccaaagtgctgtgattacaggcgtgagccaccgcgcccagcctatttatttcattttttttattttttgagacagagtctctgtcacccaggctagagtgcaatgttgtgatctgggctcactgcaatccccacctcctacgttcaagcgattctcctgcctcagcctcctgactaactaggattacaggggcctgccaccacgcctggctaatttttgtatttttggtggaaacagggttttgctatgttggccaggcaggtctcaaactcttgactttaagtgatgcactcacctcagcctcccaaagtgctgagattacaggtgtgattaagcgtgcatttgtattataataaaaacaacaaaactggactagaggctgcgcctggtggctcacacctgtaatcccaacactttgggaggccaagacaggcagatcacttgatcaggtcaggagttcgagacgagcctggccaacatggtgaaaccccgtctctactaaaaatacaaaaattacctggacgtggtgacaagagcctgtaatcccagctactcaggaggctgaggcaggagaattgcttgaacctgggaggcacaggttgcagtgagccgacatagcaccattgcactccagcctgggaaacagagagagactttgtctcaggaaaaaaaaaaaaaaaaagccaggcatgcacttgtagtccaagctactcaggaggctgaggccagaggatcacttgaacctaggagtttgaggttgcagtgaactatgatcacggcacttgcactctagcctgggcaacagagcaagaccctgtctgaaaaaaaaaaaaaaaaaattccccgagtagctgggattacaggcgcctgccaccacgcccagctaatttttttatttttagtagagacgaggtttcaccatgttggccaggctaatcttgaactcctgacctcaggtgatccacccccccttggcctcccaaagtcctgggattacaggtgtgaaccaccacgcccagactgtcaaaatttttaaatacacagaactaaaaagataattaaaacattgcatatgaaaacctgcgggatatcgaaaaacgttaactttttagagctgtttatgtaaggctataattgcctaaattagtttttaaaaatcctgaaacataatgagttaaagatttcacttgagaaattaggaaaagaacaatagaataaaccaaagaatatataaagaaggagataagagagataatgaaatagaaaacaaagatttggtagagaagatcaacaaagctaaaatatgattgattgaaaacaccaaataaatctttaggagacagattaagaataatagagaaaaaaagacacaaaaaatagcataattagatggaagaagaattaagatgttgataactatcaaagtcaggtgatggctatgttcattatgctatactatctgtttttgtgtgtgtttgaaaatgtcagtaattaaaaaaaaaaaaagttttgtccgggtgctgtggttcatgcctgtagtcccagcacttcgggaagccaagacaggcggatcacttgaggtcagttcaagaccagcctgggcaacatggtgaaatcctgtctctacaaaaaatacaaaaaaagtaagccagatatggtggcatgcgcctgtagtcccagctactcaggaggctgaggtgggaggatgggttgagcctgagaggtggaggttgcagtgagccaagattgtgcatctaccctccaacctgggtgacgagagccctgtctcaaaaataaatttttttttttaagtgtgtaaatatataagtgaaaaggaggaaataactacagatactggagagattaaaataagagaacactgggaacaacttcattacaattgactttaaaactatgaaatgcaaaatcaacctgaggtaaaaatagcctgaatggtccagtaactactaaagaaatgaaaacaatagctgtaagtctcagtgagaaaactacattttaacagttttaccgagaattctaccaaactttcagactttgaaagaatggattatccagtcttgagcaaactctaccagtgaatttaaatgagtgagacatcacacacacaagtgaatactccctactttgttttatgagacaagtaaaattctgataccaaaatctgcccaaaacaataccagaaaaaatgaaaaatcacaggtttatctcactcatattagattcaaaaatcctaaagaaaatattctccaggaggctgaggcaggagaattgcttgaacccaggaggcagaggttgcggtgagttgagatcacgccattgaactccaatctgggcaactagagcaagactccgtctcaaaaatattctcatacctacatcagtgtaattttcaaaaaaaagaaacaatataccaaatcgagcagtgtattttaaaaagcagtataccatgagcaaattggtttatcccaggaacgcaaatagtgtttcatattagaaaatccactttattggccaagcgtggtggctcacgcctgtaatcccagaactttgggaggcccaggcgggcggatcacctgaggttgggagtttgagatcagcctgaccaacatggagaaaccccatctctactaaaaatacaaaattagccaggcatcgtagcgcatgcctgtaatcccagctactcgggaggctaaggcaggagaatcacttgaacctgggaggcggaggttgtggtgagccaagattgcaccattgtactccagcctgggcaacagagagacactctcaaaaaaaaaaaaaaaaaatcctccttccttcctccctccctccctccctccctcccttccttccttctgacagggtctcactcttgtcacctaggcttgagtgccatgacacaatcactgttcactgcagccttgacctccccagggtcaagcagtcctcccacctcagccctccaagtagccgggactacaggcacatgcaccatgcctggctaattttttttttcttctttttgtagagacggggtttcgccacattgcccaggctggtctcgaactcctggcctcaagtgatctgcccacctcagcctcccaaagcgccagaattacaggtgtgagcccccgcacccagctagaaaatccactaatgttagttgctacattaatatattaaagaagagccatatgatcatggcttagtagatcatggatcagtagatttccaaaaaaagtattttatattcaaccttaaattgtaattcctaggctaaaggagtataaaagaggaactaaaaatcaattttacaggtgatctaattgtctacataggaaatataaaagaacttacagcaaggggctaactgtgtaggatcagtacagaagttatttgcttttgttttttgtttttaaacagagcacggtggctcacacctgtaatttcaacattttgtgaggctgaggtggaaggatcacttgagcccaggagtttgagaccagcctgagcaacatagcaagatactgtctctacaaaaaataaaataattagccaggtgtggtgacatgcacctgtggtcccagctactcaggaggctgaagtggcaggatcccttaaacccaggagaccaaggctacagtgagccaagatgcaccactgtgctccagcttgggcaacagtgagactctgtctaaaaaaaaaaaaaaaaacagttatttttctctatacccacaccacaaataattggaaatgtagctcaaaagagcatttataatagcaccaaaatctctcactatccacagataaatctggcaaaagttgcataagacttgtatacaaaagactgaaactttattggaaaacattaaagaagatctaaatcacagagattcattatccaaagacaggaagggttagtatcataaaagctgtcaaggaccgggcatagtggctcatgcctgtaatcccagtgctaggagaccgaggcaagaggattgcttgaagccaggagtttgagaccaacctggacaacatagaccacaactctacaagaaaattaaaaattagccaggcgtgggccgggcgcggtggttcatgcctgtaatcccagcactttgggaggccgaggcaggtggatcacgaggccaggagctcgaaaccatcctggctaacacggtgaaaccccgtctctactaaaaatacaaaaaattagccaggcgtggtggcgggcacctgtagtcccagctactcgggaggctgaggcaggagaatggcgtgaacctgggaggcagagcttgcagtgagccgagattgcaccactgcactccagcctgggcaacagagcaagactccgtctcaaaaaaaaaaaaaaaaaaaaaaaaaaaaagccaggcatggtggtacatgcctgtagtcccagctactcaggaaattgacacaggagtatcccttgagctcaggagtttgaagcttcagtgagctatgcttacgccacctcactccagcctaagcaatagagagatcctttctccaaaaaaattaaaacaaaaggcaaaccattaggattacacagcaagcttttgaccactaaactacaaagaggtcttcagcctgaccaaggagccccatggcaagaccagaggaggtgctgctgcttcatgggtttgcagctagcgagccctccctctctcctgctggaggaaggtgtgaagcgacgggagtccctaaccactgctccggggagcataactgttaaattactttggaaaagagtttggcagactctagcaaaattgaagttgtgcctcccgtgcaaccccacaaacagctgcacacttgtgtgcacgactagaggttctcctgcatgtcccgggggcggggcaaacgtgaggcaagcagcagcatctgtctgttcactgccatgtgttcataccgcagtgaagacgaacagactgtcacctcatggagaactctcacagacataacattgagtgaaataagaagctgtaagaccatgtacatacagtgcagttccctcgatatgaggccacacagcacaaccatactaacatttaggatgtcatagagaagtcacgaaattaccaagaactatggtgaactaattactccaaaccctagggctgtgactacctcttgggagaggacagcacggcgccacggttagcagtgtcaggttttgtgacctgggggtgctgtgactcaggattctccctgctggttatgtggctgtcctgtgtgtcagacaccgtgtgcatgtctcacgtagtctgcagtcgacaaaacaggcctgatgcagaggccactgtgtctcgggtgcaggtggtgtggggagggacaaagccaggtcacactgggcctgggaccttagagagcagcgtgagctctgtgcccatgctgcaagaacctgtggaagctgtgcagtggtttggattggatttcttccttgaatggcttggagcaggaatgtggttgatgttcttgagcattctattccagctgctgtgtccagaaggggctgggggacagggtcacacatgcactaatggaaacaggattagtgattgtcagagttaggaggggacagcagaggcagaaggtaacatcacaaactcagggcttgaccagctagggacagggaaagagaatttggattctgggagatgacacagtcagcccttccagtttaggggagtgaggggatcagtctcatagaggctgcaaggcaagaacgctgttgggcattcacgaatgtttgtggttgaataaacaagccacagtttaagcaaccataattaaacctaatggatgggtgacagtaataaccattttcaggtttcattcaagtttagagacaaataagtaagtaagtaagagacagggttttgccacattgcccaggctggtctggaactctggagctcagaggattctcaaaccttccagagtgctgggattgcaggaatgagccaccacacctggtccagtgtttcaattttgcttacaaaagtatactttaggccgggcgcagtggctcgcacctgtaatcccagcactttgggaggccaaggcaggaggatcacgaggtcaggagatcgagaccatcctggctaacacggtgaaaccccacctctactaaaaatacaaaaaaattagccgggtgtggtggcaggtgcctgtagtcccagctagtcaggaggctgaggcaggagaatggcgtgaatccaggaggcggaagttgcagtgagccaacatcacgccactgcactccagcctgggcaacagagcgagactctgtctcaaaccaaaaaacagtatcctttaggccaggcacggtggctcatgcctgtaatcccactttgggaggccaaggcgggtggatcatgaggtcaggagttcaagaccattctggccaaagatgttgaaaccccctctctactgaaaatacaaaaattagcaagatgtggtggtgggtgcctgtaatcccagctgctcgggaggctgaggcagagatttgcttgaacccaggaggcggaggttgcagtgagttgagatcgtgccactgcactccagcctgggcaacagagcaagactccgtctcaaaaaaaaaaaaagtttgaagtaaaaaagactaatttagaatttaaaatttgattttaggaagtatgtcagatatcaaaggtttaaaacacttgatatcaaaataagatcatcacaaaagaagttattcatttaaccaaactaataattcaaaggtttcaaaaagcaaaaacctttatgttttgataggagactctggttttggagggttggggtttctgggttttttgtttgtttgttttgttttgtttttttgagacagggtctcactccattgtccaggcagtggtgcaatcacggctcactgcagccttgaccaccaggcccaggtgatctttccacctcagcctcctgggtagctgggaccacaggcgtgctccaccacccgctgcctgagactcagttttctcaacagtcagaagacataatgaaaatggcatgaggccaacagaatgtcttttttttttttttcagcttactcaaaagataattgacaaagtattttattatctcttattaatactacatgaaatcttattgaaaagagaaaaccagttgcatcagtgtattactattaattgtagtaaaatcttttaaacagatccatctaatttcaatcagctttgaccacacaggatttccataaatcttttataacctcttagaattttcccattcacttccttttcccaactttctatattcatttattttcttttccatctgtttttcaacttaagaccacttttaaataacctctaaactagtcaaaatcactttttcctttgacaaaaccacatcctcatgtttttcttataaccttccttaccaaaacacatcttactttttcttatgtattttatatgtagaactgttttcctgcttatctctactttgagttaccatgttagtcagaattttagcttttagtaaccttaaattatagtgaaaacttaagaaataagcaattattaatattttgtttatctgaaataagccaggcacagcgttcacaccttgtaatcccagctctttgggaggctgaggtggaggatcacttgagcccaggagtttgaggtgtgagctgcgattgtgccgctgcactccagcttgggagatagagtgagaccctgtctcaaaaaccaaacagaggataaagaatttaagctttccagtcaatgaagctttacattattggcagaaatcatgtcaacaaacagaaaagcgggctgagaaagtgcatatcgttatcaagggttacggaagagaggaattcagtcaactgagaaggtttttttattatgaattttttaactttttgagatggagttttgctcttgtcacccagactggagtgcaattggtgcaatctcggctcactgcaacctccgccttccagattcaagtgattctcctgcctcagcttcctgagtagcctctattacaggcacccaccaccatgcccagctaatttttttgtgtttttagtagagacagagtttcaccatgttggccaggctggcctctaactcctgagctcaggtaatccacctacctccgcctcccaaagtgctgggattacaggcgtgagccaccacacctggccctgtctctattttttaattaaattaaaaactatatatatatgtatgtatatacacacacatatatatggtgcttgcctgggcaacacagcaagacgtcatctctacaaaaagtaaaatcagctgggcatggtggcacactactgtagtagttccagctacctgggaagctcaggttggggagggtcgcttgagcccaggaggtcgaggttgcagtgagctgtgatcgtaccactgcactccagcctgggcaacagagtaagaccctgtctccaaaaaaaaaaaaaaaaaaaaaaaaaagtaatcacaccagagaggcagtgaaatgtgagagcgggtacatcctaccccttcccccacctcaagctgagtaatccacctgctgtattgtatagactctagatagagtgtggccaaagtagctgtaaattaacctcttaatgttgtcatagggataactcatatcctgtagttcaacagtttatagccaatcactatcaatataatttctgtaaagcaatgagaattcttgacaactttttttttttttttaaggcaatagtcttgctctgtcacccaggccggagtgcagtggtatgatcttggctcactggacccttgacctcccaggctcacttgatcctcccacctcagcctcctgactagctgggactacaggcgtgggccaccaatctcagctaatttttatttttatttttattttattattattattttttgagatggagtctcgctctggcgcccaggctggagtgcagtggcgcgatttcggctcactgcaagctccgcctcccaagttcacgccattctcctgcctcaggctcctgagtagctgcgactacaggcgcccgccaccacgcctggcaattttttttgtatttttagtagagacggggtttcaccgtgttagccaggatggtctcgatctcccgacctcgtgatccgcccatctcagcctcccaaagtactgggattacaggcgtgagccaccacgcccagcctcagctaatttttaaaatgtttagtagagacagttctcattatgttgtccagggtggtctcaaactcctggattcaagtgatctatctgcctcggccttccaaacgttgggattagaggcgtgagccaccaagcctggccctgataaacaacttttgtaatcacctcctctcctaatttgttctttttttcttaaaaacttgagttgttctttctaacccccttccctttctaaagaggcaagagatttgggtttcagggaaaaaaaagggaaactgccttctctggccttgcttcacagcatgggatccgggtcccggtactggcagtttggctccgttcctcctgtggcttctttttttttggcctaaattacacagcatgcttttaaaattgctgcttcctactgtttgtaattcagaccttttttcctccttaaatttgtgaccaaggccaggtacagtggctcatgcctgtaatcccaatactttgggaagccgaggcgggtggatcacttgagggtcaggggtttgagaccatcctggccgacatggtgaaaccccacctttactaaaaataccaaaaaaaaaaaaaaaaaaaaaaaaagccgggtgtggtggtgcacatctgtagtcccagctactctggagtctgaggcaggagaatctcttgaacccaggaagaggaggttgtagtgagcccagatcgtgccattacactccagcctgggcaacaagagcaaaactccgtcccaaaaaaaaaaaaaaaaaaaattgtgaccagccgggcgcagtggctcctgcctgtaatcccactactttgggaggccaaagcgggcggatcacgaggtcaagagatagagaccattctggccaacatggtgaaaccccgtttctactaaaagtacaaaaattagctgggcgtggtggtgctcgcctgtagtcctagctactctggaggctgaggcaggagaatcgcttgaaccccggaggcggaggttgcaatgagccgagatcgcgtcactgcactccagcctggcaacagcaagactccgtctcaaaaaaaaaaaaattgtgaccaattgctgttagttttaaactggtgcatgaaggtgagttctctccctggccctcaagagatttggaagtttgttttagagagtgctctcagtcacttaaggatgtaaatcttacttacttatttatttattattttttgagacacagtctctcactctgtcatccagggaattagcagcattcccgctgagactggatttgaaacaaagttacagttccttagagccactacagatttctttcctcaatggatacctttagcttaggataaccactaataggaattaatttgaatttacttgaaattatttatgactcttgaccatttgggatacccatttgtcatcttttctactaaaggaaactaaaatattgctctctcaaatactgggtattgttgagctgaagacagagtgcaggggctctctctacctctcctttgtttgcctaaaggtaggacataaatccttttttactgaagacagctactccgcagcccacagatggtgccagtggggcagaggaatctgtgagcagactttaaaccccaaaagactttctaaaaatgaagtctcagttcaggccgaagtgaagtggcttgatcacagttcattgctgggactacagatgcgccaccatgcctagctaattaaaaaaaaaaaaattattttatttattttttttttgagatggagttttgctctagttgcccaggcacgatcttggctcaccgcaacctccgcctgccgggttcaagcgatgctcctgcctcagcatcctgggtagctgggattacaggcatgcgtcaccacgcctggctaattttgtatttttagtagaggcagggtttctccatgttggtcaggctggtctcgaactcccgacctcgggtgatctgcccaccttacctcggcctcccaaagtgctgggattacaggcgtgagctgccacacccggcccaatttttttttttttttttttttttttggtagagaaggcatctctttatgttgcccaggctggcctctgagtatctttccacctcagtcttccaaagtactaggattacaagcatgaactacctccccagcccaaccccacaggtttaccttccctcatttttggcactagtcccatgggcagtttcgtttttctattttcctgtctctttaaatcttccacctggcatttgtgcatagactgtcagctgagaagctgagaccttagaaaatatggcctgacagatgtggcttgcaccctattcgcagctagcaagactttctttaagctgttcttgagaggggcctggggctgaaattttgttccctcttcagagaccttggttaaagccataaagggattcttaattttggtctcatgcatgtctgtgtgtgttggctttgagtcgtttgtgcaggtatgcccttgaatgattataaatttctggtttatatttagaatatgataggggttttttgttgttttgtttagccttctcctaagctaaatgaaaccatatactcagaaagtaaacagtttattaaaacattcaaagacaaacagctttaaatagtggttaccctagacctctaataagcaaatatgttccacctccaaaacttttttttttttttttttttttttttggtgggagcacaaagtctggttctgtccgtccaggccgtagtgcagtggcgcattctcagtttgttacagtgggtagctagtcaggtgtgagcagggcaggggagggcctcctccatccaccagggatgtcaggtgaccatcaggtgatggttaggcagttgtcacactgcctctctaaaataataattggtcatagccagcaccagggaaactgaagctggtgatcagcagcttcccgataagatctcaggaattgggcaagtgggctcaagcatgtgcactaaggcacagaatggtggagtttaactggtgtgtgaccttccaggtactttacaccgggaagggaagatcgcctcaggtgagcatgcgcatgctccagtaaacacactacgcatgctccctcccaagtgctagcaggccagtgtgtgtgcaggcagcccaccccaagggaggaattgggagaagggacgcgaggccctgaagtatgccaacacctagaaccctacatcagaggccggatggggcacttgcctctcgagttgcccacttggcctcttccaagtgcactttccttccttttgtttctgctctagagctttgtaatgaacttccactcctgttctaaaacttgcctcagtctcttcttctgccttatggcctttggtcagattctttcgtctgaggaggcaataattgaggctgctgcagacacatacggattcgccaccggcaactcaggtacctgccaccggcaacaggctcgctcagcctctgcccaccaggctgaagccatgctcccaccacagcctcccgagtagctaggaccacaggtgtgcgccaccacacctggctaatttttgtgtttttttgtagagatgaggttttaccatgttgcccaggctggccttgaacttgtaagctcaagtgatccacgcacctcagcctcccaaagtgctgggattataggcatgagccaccacagcaaggctttattatttttgagacgggtctcacctttgtcacccaggctggagtgcgggggcaccatcacagctcactgcagccttgacctcccaggctcaaggatcctcccacctcagccccgagcagctgggactataggcacatatgtgtactgccactcctggctaactttttactttttgtaaagatggagtctcactgtgttgcacgggctggtctcaaacgcctgggttcaagtgattctccaacctcagcctcccaaagtagtaggaaaacaggcatgagccaccatggccagcttcagatctcctctttggtgtcagtttcaggaaggaaaaaccaagaaacaagaatgttgactatttgcctggctaagacctgacacaggaatccttttaaacagctttagagttgaaagttgacttaattagaagctgatatttaggatatatgtgtatacaattttttcgaggcctctgctttctataaaagcttcttggaggccgggcgcggtggctcacgactgtaatcccagcattttgcgaggccgaggagggcagatcacaaggtcaggatattgagagcatcctggctaacatggtgaaaccccatctctactaaaaatagaagaaattagctgggcgtggtgataggtgcctgtagtcccagctacttgggaggctgaggcaggagaatggcatgaacctgggaggcgaaggttgcagtgaaccgagatcacgccactgcactccagcctgggcgacagagcaagactccgtgtcaagaaaaaaaaaaaagcttcttggccagggaagaagctacaaaaaatacaaaaattagctgggtgttgtggtatgcacctgtagtcctaactatttgggaagctgaggcaggagaatcgcttgaacctgggaggcagaggttgcagtgagccaagatcgtgccactgcactccagcctgggtgacagagactccatttgaaaaaaattaaaaattagctaggtgtggccaggcacagtggctcacgcctgtaatcccagcactttgggaggccgaggcaggcggatcactttaggtcaggagtacagatcagcctggtcaacatggtgaaaccctctttctactaaaaatacaaaaatcagctggacgtggtggtgggcacctgtaatcccagctacttgggaggctgaggcaggagaatcacttcaacgtgggaggcggaggcttcagtgagctgagattgtgccattgcactctagcctggatgacaagagcgaaactccttctcaaaaaaaaaaaaaaaaaaaaaaaaaaaaccggtgtggtggtacatgcctgtagtcctagctacttgggaggctgaggcagagaattgcttgaaccttggaggtggaggttgcagtgagccgaaactgccactgaactccagcctgggcaagagagtgagaccctgtctcaaaaaaaaaaggatttcaccatgttgcccaggctggtctcgaactcctaagttgaagtgatttgccctcctcagcctcccaaagtgctgggattacaggtatgagccaccacaccctgcctgggcctgataatttaagggcgctcacagctctcagattaaacgtttcttttctttctcaggactccttccgcccacccattcctcctcccgagtcctttccccttctcaagtgcagcctgtagcagggcctggaggggacccttgacactgtgcccctcaccgagaatctaaacccctgaccccgcagtgagtttctggcaagaacaggagtgtgatgggctttgccaagcaccagcttggttgtgggctgtttccttcagtgactgtttggctttttgtctttgcaggttctgcttggattctgctagacagacccgacaaagactgtctatcaactggtccaattttagcttgaaaaaagccacctttgctgcccactgaatgaggactccctggagagggacacgcgagaggcaggccaggctgcaccaccccaagagccacgcccctcgctggcgccccagagccgtggtgcttgccaagggctgtgcggagctggtgctgcctgaaaccccagaccgagaagttgatgctcggcccacgccgttagctcgtgtgcgtgtagtctgtgcgtgagactccttcgattgtagctctgtgctgtcggattggaacagtagttcccgccaagtcctcccaccaccgcggcctcggaggcctgggccgtggccagataggagtttgcatcatccacgtggctccgttgcctctgcattgcgccctgtcctgtcatgtgtcctcaccggggtatcggccgtcactcagctctcctgtgcccctgcgtctcaccctaggcgggctgggcggggcaggcctcctttgttctccacaatctactgtctccgagtgtacacgttgcgctgtttgtgtttgatccccctgacttgtagccagcttgtgtaagatcccttgcagaacgagaaagttaaaaacaagcccacccagtactcacaccatcaagtctgttatagagtgtacgactgtattaacacggaggcctgcctggctacttttttaacatattgttaagtaatattaaaatcatgtctttctttttgaaagatggaatacattagtacagcaggaga

SEQ ID NO: 2572 - DNA, 107145 bp, Homo sapiens; identical to SEQ ID NO: 2571

SEQ ID NO: 2573 - DNA, 107145 bp, Homo sapiens; identical to SEQ ID NO: 2571

SEQ ID NO: 2574 - DNA, 107145 bp, Homo sapiens; identical to SEQ ID NO: 2571

SEQ ID NO: 2575 - DNA, 107145 bp, Homo sapiens; identical to SEQ ID NO: 2571

SEQ ID NO: 2576 - DNA, 107145 bp, Homo sapiens; identical to SEQ ID NO: 2571

SEQ ID NO: 2577 - DNA, 46793 bp, Homo sapiens
caatggggacatgatggggggcggagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggtaagtcagggccttgcagatgcgaggtttaggcagcttcgcggcctacagaggcctcggcccgcgcctcttgggggagccgcgctgcgcggcttgacccagccgaggctttgcagcccgggacctcgagccagctctggtcgctcgcactgccgtccgcgcgggcgcaccgagcccggcttggcgcgggcaacagaagttaggaggtctgcgtctgggtctcggctcaccctggggggccgcggccatggggcttagttcctagcctaggaagggaaactgagactctgggaggggcaggaacgcccccaaggtcacttggaaagtcgggcaggatgtgctgttagggggaagacccgggcagggtttttgttccccgctgacgacgcctcctttgtgtgttcgcgccgccgccccgccatcgtggggcctgcgagtttgccggggtgcgtgggccgcgtggcggggccttttgtaggtcgggaggatctgagtacgggtgcgggcctgaccgtgggggcgccgaggtcgcagtctaaaacttagtagggcctcgatttccgggcgcgcttccgggccccggctggtggttggtggaacgtgcgactgtgaggcttgcggcccagccctgcaccgctcgggcccttcaccgctctggcgcgcctatagacaggtgtatgaagattctcacgacccgaaacagagttgctagtaaacaccgcttttccgcctttgatccatcgagggaagagggaaaaggatagagcttgggcaagccgttttggtagggatttcagcttttgtctttcacttgtcagttcccatagacgttcacaaacttaataatcttcgttctgtttctgcaccaagttcttgagccagacgtagggtctcagctctggagcctggcttagactgtccaactgactggggagactgaggtccagaaaagtgaagtggtctgcccaaggtcacatagccagctatttggcagcagatgaggttaagtcctacctgcaagatttgggttttgaattcattgaccaggagttttgggaccactgtcaataaaagagacattgaagggaatcttttgttactttcttggtgatttgctttttaatggacaaggacatattgggttcagttttatctgtgagtttgaggtgaaatagaggcattcgagtagcaagatatattgctggcttttgtattgcctgaatttgagcttccaaaaatcttactttaacacatcgtttattgatcttttcttgaattactacctttgtaaggaccttttgtaaacattgtttttctaatcttcatgaaatcttaatgccatacgtaaactatttctttttatataatgtatgcacatctgtgctttgtacataaaatgagtaagatttttcactctcctcaagatcaaagtagcgtatttttgaggtctcctgtatgccaacctttctgcttggaatacagcagtaaacagtcgtggtcctcctgtagctgggtgaggatggagggaataagagataactcattttattgtgttttgcaaatactgcctttttttttttgcaaggtgaaggtttatagcaaggattcatcgagcaagtctgtaaatgccagccatttttccaacagcatgtgctcactttgtgtctcttgtgtcacgtttgggtaattcacaatatttcacactttttttttttttttttttttgaggtggaatctcactctgtcacccaggatgcagtgcactggcgtgttctcggtctcactgtaacctctgccatctgggctcaagtgattctcctgcctcagcctccggagtagctgggattacaggcatgtactaccacacccagttaatttttgtatttttagtggagacggggtttcaccatattggccaggctggtctcgaacgcctgacctcaagtgatccgcctgcctcggcctcccaaagtgctgggattacaggcatgagccaccatgcccagccccaaaccttttcattgttacatctgttatagtgacctgtgatcaatgttttgggttaccatgaatagcactcatataagacagtgaacttaattggtaaaagttgggtgtgtactaacagctccactgactggcagttcccagtctctctcctcaggcctctcaattccttgagacacaatattgaaattaggccagtcagtgaccctacagtgtccaggcaaaaggagcagtcagttgaatctctcttactttaagtgaagttaagaaatgtttatccttagtgagaaaggcgtatcaaaagttgagataggccaaaagctaggcctcttgtgctgaatgacagttagccaagttgtgaatgcagaggaagagttcttgaaattaaaatgctactccaatgaatacatgaatgataagccaaacagccttattgctgatagggagaaagttttagtggtctggatagaagatcaaaccatccatgacattcccttaagcgaaagcctaatccggagcaaggtactaactctcttcaattctgtgaagagtgaggaagctgcagaagaaaagtttgaaactggcagaggttagttcatgaggtttaagggaagaagccacctctgtaatgtaaaagtgtaaggtgaggcagtaagtgttgatgaagaagctgcagcaagttatgcagaacatatagctaaaataattgatgaaggtggccacactaaacaacagactttcaatgtaaatgaaacagccttatatggaaaaaaaaatactatctaggactttcatagctagagaaaggtcaatgcctggcttcaaaggacagtctgattctcttgttaggggctagtgtggccagtgacttaagttgtaactagtgctcatttaccattctgaaaatcctagggcccttaagaagtatgcaaaaatctactgtgtgctgatcattgaaacaggaaagcctgtatagtagcatatctgtttacagtatgttttactgaatattttaagcccactattgagatctacagctcagaaaaaaagatttctttcaaaatattactgctcattgagaatgtgcttagtcaccaaagaggtctcatggagatgagtaagattaatgttaacatctgttctgcagcccatggatcaaggagtaatttcaactctcaaatcttacttaagaaatgcatcttgaggctgagcacagtggctcatgcctgtactcgcagcacttcgggaggccaaagctggtggatcgcttgagctcaggagttagagaccagccggggcagcatagtgagaccaccccctccactgccagtctcttaaaaaaaaaaaaaaaaaagggcggcagggggaaagaaagaaatgcattttgtaaggctacagctacatagattgtgattcttctgatgggtatcaacaatgtaaattaaaaacctcctgaaaggatatactattctagataccattaagaatatttgtctccaggcacggtggctcacccgtgtaatcccagcactttgggaggcgaagtgggcggatcacaaggtcaggagatcgagaccatcctggctaacatggtgaaaccccatctctactaaaaatacaaaaaattagccggtcttggcagcgggcacctgtagtcccagctactcgggaggctgaggcaggagaatggtgtgaacccgggaagaggagcttgcagtgagccaagatagcaccactgcactccagcctgggcaacagagcgagactccatctcaaaaaagaaaaaaaaaaagaatatttgtgattcatgggaggaggtcaaaatatcaacatcagcagttcacggtggctcacgcctgtaatcccagcactttgggaggctggggcaggcagatcacctgaggtcaggagtttgagaccagcctgcccaacatggtgaaaccccgtctctaccaacaaaatacaaaaattagccaggcatggtggcacgctcctgtagtcccagctacttgaggagctgaggtaggttaatcgcttgggcccaggaggtggaggctgcagtgagccgagattgtgcctctgcactacagcctgggcaacagtgagattccgtcttaaaaaaaaaaatcaattaacacaacaagaacttggaaaaagttgattctgaccctcatgggtgactttgaggggttctagacttcaatggaaaaagtaactgtagatgtggtggaaatagcaagagaactagaattagaagtagagcctggccgggcctggtggctcacgcctgtaatctcagcactttgggaggcctaggcgggtggattacgaggtcaggagttcacaaccagcctggccagatggtgaaaccccgtctctactaaaaatacaaaaaattagcagggcgtggtggcgcacgcctgtaatcctagctactctggaagctgaggcagagaattgcttaaacctggaggggcagaggttgtggtgagccgagatcacactactgcactccagcctgggcgacagagcgagactctgtctagaaaaaaaaaagtagagcctgaaggctgggcctgatggatcacctgaggtcaggagttggagaccagcctggccaacatgataaaaccttgtctctactaaaaatacaaaaattagctgagcgtggtagtgggattgttactgcatagtaatcccggccactccagaggctgaggcaggagaattgcttgaacccaggaagcagaggttgcagtgagccaagatcgggccactgcactcaagcgtggacaatagagtgagactttgtctcaaaaaaataaaagggccaggcaaggtggctcacacctgtaatcccagcactttgggaggccaaggcaggcggatcacgaggtcaggagattgaaaccatcctggctaacacggtgaaacaccgtctctactaaaaacacacaaaaaaattagccaggtgtggtggcacgcacctgtaatcgcagctactcaggaggctgaggcaggagaatcgcttgaacccaggaggcagaggttgcagcgagccgaaatcacgccattgcactccatccagcctggttgacagaacgagactctgtctcaaaaaaaaaaaaaaaaaaagtagaacctgaagatgtgactgaattgctgcaatttttaaataaaacttgaacacatggagagttgcttcctgtggacaggcaaagaaagtggtttcttgaggtggaatttactgctgaaggtgcagtgaacattgttgagattataacaaaggatttagaatattttataaacttagttaataaaacagtggcagggtttgaaaggattgactccaattttgaaagaagttccactgtgggtaaaatgctgtcacacagcattgcacgctacagagaaatctttcatgaaaggaagagacaactgatgcagcaaacttcattttaagaaattgtcacagttggcccagtgcggtggctcacgcctgtaatcccagcactttaggaggccgaggcaggcggatcacctcaggttgggacttccagaccagcctggccaacatggagaaaccccgtctcgactaaaaatacaaaaaaattagctgggcgtggtggggcatgcctgtaatcccagctactcgggaagctgagacaggagaattgcttgaaccagggaggcagaggttgcggtgagccaagattgcgccgttgtactccagcctgggcaacaagagtgaaactccatctcaaaaaaagaaaaagaaaaactgtcacagctgccccaaccttcattagccactgccctgatccatgagcagccatcatcagggcaagacccttcaccagcaaaaatattacaactttgtgaagactcaaatgatcattagcattttttatttattttttaagagaatatctccctgttgccccagttggagtgcattggtgcgatcgtaactcactgcagcttccaacttctgggttcaagagatcctctcacctcagcctcccaagtagctggggctacaggcgcacgccaccgcacctggctttttgtttgtttgtttgtttgtttttgagatgtagtctcactctgccgcccaggctggtgtgcagtggcgcgatctcggctcattgcaagctccgcctcccaggttcacgccattctcctgcctcagcctcccgggtagctgggactacaggcacgtgccaccatgcccagctaattttttgtatttttagtagagatagggtttcaccgtgtttgccaggatggtctcgatctcctgacctcaagatccacccgcctcagcctcccaaagtgctgggattacaggcgtgagccacctcgcctggcccacacctggctaatttttaacaaagttttgtagactgggtcttgcccttttgtccaggctggtctcagactccagactcatgatttaatatctatggttgagtgattccctacttcttactctcttacagaaccactctataagatagttgttgtagttagccccattttactcttcctgaggcactgggagatcagggtcacttgcccaaggtcacacaattagtaagcagagctcgaaacttcaccccacccctgactcctacctttgttccttttgttaggctttgttatgtcatctgctttttttgtgtggtgggaaagcacatggccaatgtttctagaaacttcaaatagtaaaaacaaaatagtatctttatttttgctttcaccgcagaggagtctgataattatcctcaagaaaatttattgattctcagtaactgtattgtattcctcaaagttatttttcctaagttttctcctctcaccagctaagggaagttgtcctagggcctaggcatttccctgtctgccacacctcacctcttactttagccaaactactgctaaattctgctcctaaatatggcagcattctgtgttacctgcactaaaatttgcttcccttgtaagtaccttcttgatgtcttccagtgttggttctcgcctcctactcttgcaagttgaaaagttgaaaatgcctcaggtagaaatgttctctcctattctcccatcatgatcatctgtgtttttttgttttttgtttgttttttgagacggagtcttgctctgtcacccaggctggagtacagtggcacgatctcagcactgcaacctctgcctcccgggttcaagcaattctcctgcctcagcctcctaaggacctgggattacaggcatgtgccaccacggctggctaattttttgtatctttactagagatggggtttcaccatgttggccagcctgtctcgaactcctgaccttgtgatccacccacctcggcctcccaaagtgctgggattacaggtgtgagccaccacgtccagcccttttctttctttcttttttttttttttttaatttaagagaaggttgtcttcctatgtttcccgggcaggagtgcagtggctatttgcaggtgcaattatatagcacagtacagcctaaaacttttttttttttttaaagacagaatcttgttctttctcaactcacttcaacctccacctcctgggttcaagtgattcacctgtctcagcctcccgagtagctgggattacaggtgggcagcaccacgtctagctcatttttgtatttttattagagacagggtttcactatgttggccagcctggtcttgaactcctgacttcaggtgatctgcccgcctcagcctcccaaagtgctgggattataagcatgagccaccatgccctgcctacagcctcaaactttaagctaaattaatcctcttgcctcagtgtcccaagtaaatgggaatacaggtgctgatatggtttggctgtgtccccacccaaatctcacattgaattcctacatgttgtgggagggacccagtgggaggcaattgaatcttgggggcaggtctttcccatgctgttctcatgatggtgaataagtctcaagagatctgatgctttaggtcgggggcggtggctgatgcctgtaatcccagcactttgggaggccaaggcgggcggatcacgaggttaggagttcaagatgagtgtggccaacatagtgaaaccctgtctctactaaaaatacaaaaattagctggacatggtggtacatgcctgtagttccagctacttgggaggctgaggcaggagaattgcttgaacccaggaggtggagattacagtgagccgagatcatgccactgcactccagcttggacaacagagtagacttaatctaaaaaaacaaaagagatctgatgcttttataagggggagtttccctacacaagctctctttgcctgctgccatctatgtaaggcatgacttacttgcttctccttgccttccgccatgattgtgaagcctccccggccatttggaactggcttttgtaaacttcttgcttttgtaaattgcccagtctcaggtatgtctttattagcatcgtgaaaacatactggtacagtaagttggtaccagtagagtgcgatgctgctgaaaagatacctgaaaatttggaaacagctttgcaactgggtagcaggcagggattggaacagtttggagggctcagaagaagacaggaaaatgtgggaaagtttggaactcgctagagacttgttgaatggctttgaccaaaatgttgataaggatatggacaatgaaatccaggctgagatggtctcagatggagatgaggaacttgttgggaactggagcaagggtcactcctgttatgtttcagcaaagagactagccgcattttgcccctgccctagagatttgtggaactttgaacttgagaaagatgatttagggtatctggcagaataaatttctaagcagcaaagcattcaagagatgacttgggtacagttaaaggcattcagttttataagggaagcagagcataaaagtttggaaaatttgcagcctcctgtcaatgtgctagaaaataaaattccattttctgaggggaaattaaagccagctgcagagatttgcataagtaacagggagccaaacgttaatccccaagacagtggggggaaatgtctccagggcatgtcacaggccttcatggcagcccctcccatcataggcccagatgcccaggaggaaaatatggtttcctgggctgggcccagggttcccctgctgtgtgcagcctaggggcctggtgccctgcgttccagccgtctcagctgtggccaaaaggggccaacatagagtagaactcaggctgtggtttcagaaggtgcaggccccaaaccttggcagcttccacatggtgttgagcctgcgagtgcgcagaagtcaacaatgagggtttgggaacctccactagatttcagaggatgcatggaaacacctggatgcccaggcagaagtttgctgcaggggcgggacactcatggagaacctccgctagggcagtgtggaagggaaatgtggggttggagcccccaagcagagtccctactggagcaccacctggtagagctgtgggaagagggccactgtcctccacaccccagaatgatagatccactgacagcttgccctgtacacctggaaaagctgcagacactcaacaccacccagtgaaaacagccgggagggaggctgtactctgcaaagccacaggggtggagctgcctaaggccatgggaactcacctcttggatcagcgtgacctggatgtgagacatggagtcaaaggagatcattttggagctttgagatttggactgctctgctggatttcggacttgcatggggcctgtagcccctttgttttggccaatttctcccatttggaatggctgtatttacccaatgcctgcacccccgttgtatctaagaagtaactaaattgcttttgatttacaggctcataggtggaagggacttgccttgtctcggatgagactttggacttttgagttaatgctgaaatgagttaagactttgggactgtgggaaggcatgatttattttaaaatgtgaggacataagatttgggaggggccaggggtggaatgatatggtttggctgtgtcccccacccagatctcatcttgaatttccacatgtgggagggacccggtgggaggtaattgaatcatgggggcaggtctttcccatgttctggtgatggtgaataagtctcatgagatctgatagttttataagggggagtttccgtgcacaagctctctttgcctgccgccatccacgtaagacgggacttactcctccttgccttccaccttgattgtgaggcttccccagccatgtggaactgttaagttcattaaacctctttcttttgtaaattggccagtctcaagtatgtctgtctcagcagcgtgaaaacggactaatacaggtgcacacggctgtactgtcccccgtcctgcttttaaggctttctttgtttcctaattgtgactgtttttacttgcaatgtaaaggcttcatttcccccatctctgaaattatttttttctctttcaaaaacactctgccatcttttcaaggtatccgccatctctttcaagcatgtgaggagcttgataacttttgttgggggtcggtgttcagaatgacaagggtcttgcccaggctggagtgcagtagcacagtcataactcactctagcctcaacctcccagggcacaagcgatcctcccatcttagcctcctgagtaactgggactacaggcacgtgccaccacaccctgctaatttttttttttctttggtattaatattttgtagagaaggagtttcaccatgttgcccaggctggtccagaactcctgggctcaagcaatcctgccttggcttcccaaagtgctgggattacaggcatgagccaccatgcctggccctagagcttgataatttcattcattcattcttttttttttttttttttgagacaaagtctcagtctgtcacccaggttggagtgcaatggcgcaatcttggctcactgcaacttctgcctcccgagttcaaggggttctcctgcctcagcctcctgagtggcagggattacagatgcccaccaccatgcctggctaatttttgtatttttagtagaggtggggtttcaccatgttggccaggttggtctcaaactcccaacctcaggtaatctgcccaccttggcctcccagagtgctgggattacaggtgtgagctcagaccttgataatttcagtgaggaaaaaaaaaaaatctcatttacatgtttgtgccaagtgctgtgctagtgggtggggacaccatgataagtatttgataagttatgtttcttgatttaagggagtatagaagaaatggttaagtcaggactaggaggagtgagagaaatggaagcaacctttgaggtaggccctgaagaacgagcagaaattccctaaagcggggtgggagcggcaggaccaacctggccaacttcggaccttctttgaggtccaaagtcaggtactttgaactgacttccaggatacctggagtaaagtacagttctgtttgaagtgtttgtttggaaagatgagtttgttccagtgaggttgctgtattagagaaccacttgagagtttgctgcccacagtgtcatctgtgagaaatattaggtgaacgcaaaaagttgaggccagctgaaccaagccatgtaatatacacaccttccacatagatcagtcacctcagttgacttgtatgtgagccacatttgtgtccatctgatgttacagcattcactctctttgcctccacttctcaataactcacaatctgtaaactgactgaggcccgcttccacagagcaagcttcaggcctttttcaaggtaaagtatcacagttacttgtatttcttaaccatttctcatgtgtagagctttactaccattttcactagattgttttgtgtgtgtgtgtcactgacaacatttttcagtgttgtgccctaattccatttttcctcacaaatggtgggtttttgcatagcaagatgcttttttattttttttaaggaacacatatgtccgtaactgcaaatgaacccagaaaagtgaggacgagttgggaggggaggttggtatgatataaagactttgacctatgttctgtaggcaatgcttgtgattatttgggagcaatacttgcaatattcttggatattttggagcctggtgattcttagcattaccttgtggcgcttttcagttccttggacctcctcctcctgctctcttctgcctttctgtctccttcagagcattcctgttgtgcgtgcctgcttttatcttccctgggagccagtgatttttttgacttgcatgtgtgtttttgtgtttttttaaagacagagtctcgctctatcaccgaggcaggagtgcagtggcatggtcagggctcactgcagcttcaacctcccagtctcaagcgagcctcccacctcagcctcccaagtagctgggactacagtcgtacaccactatgcccggctaagtttttgtatttttttgtagagacaggatttccccatgttgcccaggctgggacactgatttgttagtctactttctaggtaaagtgttgaaggagagttgaagagggcctagattagggcttctgggtgctggatttctccaccaagatgcaagcccctagagagttgagtttggctagccctttggtgacagcttgtattgtcccttagcccacagatgcatctgactaagagtagaagaacatgtctctctttaggagcccggagccagagacagtgctgtttgagattaggccccctctggtgtgcccttcgagaattcccattgtggggcactgctcagttgctcccatctggtatgggtcaaataatcagatttgtgagtgtctcacaaccatccctgtaccccagccaaccctgggttctgaatacagtagaggcagctaagctgctagctggtctccagcaggctctgtgctcagtggccatcaacaccaggtagcttggcaagcctgcctcctgtgctgactgtgggccctggggaagtgtcgaggatgttgacggcctctagcatctgaggtacatctgcccctcggcctccggaggagtggatccttaggtttccttcattatcttaccctttctcctggctcccagaaattaccttgtttttatatgaggccccaaagcctaggccatcttggctgatagatgtgaaagccctttgctcctttcaggcccctggggattttggttgtagcctgattgctggtggcagcttaatcggggccataagataattttatggaagacctggttacttggcatctgaacaagcctcattgcctctctgagcatagtctgctgctttctgctttgatcaaattcattcctcttgtccctgcaaaccttcaggggaggccaatgttcaaggcccctgagccttaggaataaataactctgggtgagaactgcctgtcattggctgtgtgccggctttcttcaacctcctctgagtcctgttctaagtctaagccgttgtgattagctacatcctgccaagtctgttctggaaatgaataaagcccttgctgagagccggaaacattggttccagttcctcctggggtgaaggtttgttttgcctttatttaatagcactcatacctgtaagaagggacatgctctccagcccttctgatataatacctatttattacttgatttgttgatcatctttccagctaggatatatgctccatgggtagttttttgttgctgtttcccatcccattcctagcccctggagcagtgccttacccagactaggcacctgtgaatagttagcaaattagttgatagagctgccttctgggtgctaggaaccatactgggtgtttcattcagcggtcactggttccacagaggtgaggtgttctactcaattaaagatgtggacactgaggcacagaaggcaagtatttgtccaaggctgtagggcttattggccagccacatcattgctgaccgcttaaccacataccctcatttgtataatgagcaagaggctcatatttcttctgagtattaaggtgtggttattgatatgactgagggtatcaaagttctgtttaagaggtgtttgtgaacaggtgcggtggctcacacctataatcccagcactttgggaagtcaaggtgggcagatcacttgaggtcaggagttggagaccagcctggccaacatggcaaagccccatctctactaaaaatacaaaaattagccgggcatggtggtgggttcctgtaatcccagctagttgggaggctgaggcacaagaattgcttgaacctgggaggtggaggctgcagtcagccaagatcacaccactgcactccagcctgggtgacagaacaagactgtgtctcaaaaaaaaattatttgtttttattgatttttatttatttatttattttgagactgagtttcacttgttgcgcaggctggagtgcaatggtgcgatctcggctcacctccacctcttgggttcgagcgattctcctgcctcaggttcccgagtagctgggattacaggcgcccaccaccacacccagctaattgttgtatttttagtagggggtgggtttcaccatattgttcaggctggtctcgaactcctggcctcaggtgatccccccccgcctcggcctcccaaagtgctgggattacaggtgtgagccaccatgcctgacccaggtctcttattttcagtgggtaattgtatcagactctgcctcccaggtggggtttgagggttctgtgtacctggtgtaggcctaggctaaacagaagagcttctcgttagagcatctccctgtggactggctgcagagttacgatatcattctggttctgctgtgctccccactgccccttttcagctgactctttgctcataggaatacagtggtatgagatagggtcatagaatttggttccagtctaacactcttcctgtttcctgcccgcctgtatgtctctatccattagcagactcctttatgtatgatagagacacatgcacatatgcatacacggacagtccctgacttacagtgtttcatttagaatttttcaacttatgatttattgggagttagccccattgtacgtcaaggagcatctgcacatcgtatacatatataccatgaatacacataattatatgtcacactcctgctagagtggggggggtcaatatctgaagtgcttataatagctttattgggggggacctctaagaaaaacagaataattacttagaccttaaataataaatctataagaatgaagaaagccccaaagcccttccagcttccatcccgtcagtcacctctctgtcctatactctgccactaccccgagcctcatggctttcttctcacctgggctaccctgagtctcctccttggtctacagtctgacttgttcagtctcccatctgttctcaccagacacaggtgacatggtctctaaatgcagatctcaacatgtcatctctgtcccaaaaccctcgatggccctgtcctgagggtgtagtcagtgaggcttgttaggaaccctcggcacctttgttgtcctccacacagtgctcgtgtgggacatccctgctcccttccgcccaccccacccacatacattgtttcttaattaactcctcctgtcacttgaggccccattcagcactgcttcctctagacagcccggcttgatcctcagcgcgtttgggctgggactgcgactcctttgctgctgcttccacttgcttaggtcaccagcgtcccacttccgtgtttgagctcactggccgcctttcagttccccagcctgtgcattgcagctgttcactgcttcctcctccttgaagaaggaggttttgtctgagtgacggctccaggttctcctagctttgtttcttttaaattctcttttacagattctatctacctgcctccccaagttttcacacattctgaaatctctacgtccatccgagttctcactcttgagtttccagctaccttgggccctttctccctgggtgtctcacaccctgcttttctaaaactacactcagcacctgtttctgttctcccttccctcattgggttttatggcctcattcttgcagagtaagaagctagataccttggcgtgagttgtttctcctttcaccttggaagctttaggaatacctagcatccggctctcctgaccatccccagttaggaatgaccacttctctaccccagctcctcttttctcagtggcaggggcgccatcaacaccccactcttaccctcatttattccttcaataaatatgagcatctgctttgtgtaaggtcttagctaggtagaaagtaaatagagccttgtcctcgtagcgcttacctaagtgagagcatactggacgagagactggaggatggtggggccctttcttgaaatggagtatatgttggcggaaggaggaggcaagggttccttttggaacacactaaatttgagaaatctgaaaaatcaccgtcagtgttcccgctagtttctggaattgatgtatttgattctggcactaacatacctatttgagggtgtgggtcttggtatcagactgccctggtttaagtctaggctctgtttactaggtgtggatgactttggggaagttccttaactttaatccttagctgcttcatgggtaaaatggggaacataacagtgcttatttccttactgggtgatgtgaggagcacatgtggtgatattaatatttaggaagcgcagtgccttgtgcagatgcagagaaggcacctctcagctgttgttagttttcttattccattggactctcacctgcatgatccagaaccctttgtagttggtgagggctactttcccatgaccgctaaggtctccattcactctgcatttctacgtccccaccacgctgggatgctctgctggaaatgctcctgtctcacctcagtgccctggtgaaatccagcctcttggtggcttatccccaagaccagccttccaaattcctttgaactctgactcctgacccttactaaacccaaaagagagagaaaaaccagatttggggtgaattgctgtatgggccagggcatggagaatgagggggctccagaaagcttcccagggaagtagtaatggtctagctgggcctgcagggatgcaggaggctggtttcagagtggtgaggggtgtgcaggccaggacagccacaaggcacatcttcagcagccgtatttggaagcctcaatatcagtgaagtgggaggagagaggcttaggaacagcctgggtgtggacatcaggtgtttccctttgctctgcaggctgatttctctgtcttcctttgtcagtagcttctcttttctaaattctaagacacgctattgatgtggcggggagaacaagcccctatatgatagatgtgcacccaaatgtaagatatttcttgagatcagaaacattcgtggatatgagaacccaggacatgtggtggatctgggactgtcgtgtggtctgaatgatcttgtgagtcctaaggtgatgtcgaggcacctcccacctctgttgaaaccaactagacaagtcttttcctagccagagcctcttccctgaatgtctgtttaaagttgaacacttaccaggtgaggtgttgctttgagaagcatttgtgctccgggctggagtgcaatggtgcagtcatggctcactgcagtcttgacctcctgggctcaggtgatcctcctgtctcagcccctggagtagctgggactacaagtgtgcaccgtcacatctggctatttttttaatgtgtttttatttttattttttgagacagagtctctctctgttggccaggctggagtgcagtggtgccatcttggctcattgcaacctccgcctcccgggttcaagtgattcttgtgccttagcctcctacgtagctgggattataggcgcacaccaccacacccggctaatttttatatttttagtagagacggggtttcgccatgttggccaagctggtcttgaactcctgatctcaagtgatctgcctgcctcagcctcccagagtgctgggattacaggcatgagccactgcccagcctcattattttaatttttttatagagacaggatctcaccatgttaaccaagctagtttccaattcctgggctcaagagatcctccctcttcaacttcccaaagtgctggggttatagggcatgagccactgtgcctgccccatttgtgcattctgttgagagcacccgtagtcccatagtatgggccagcctaaggagatgcaagtcaccctttattagagtgaaacagtgaaggggatttcccctctaaaccattgaggtcaagctagagaatgaggcgctcagggagtgagatacagtatgccattttctcagaaccagacgaccaagtgctgaagaaaatgctcagctcagctgggacggcggtccctttgggcatctcctgaaaaacctactctggcctccctttctcctcctgtacttcttgcacacttagttcctaacttcgttatagctgcctgccagcaccctcctcacccttctccccgccctagattctgcacagaggctgtgtttgctcattgctgtattcccagggcaggggctgtactgtgaatgaggcggggaggtatgcatcctttcttaaagctgggtgggaggacagacgtggtggctcatgcctgtaatcccagcactttgggaagccgaggcaagtggatcacctgaggtcagaagttcgagaccagcctggccaacctggtggaaaccccatctctactaaaagtagaaaaattagcctggtgtggtggcacatgcctgtagtcccagctactgggaggctgaggcaggagaatcacttgaacctgggaggtggaggttgcagtgagcccactgcactccagtctgggcaacagagtgagactccgtctcaaaaacaacaacaacaacaacaaaaaaaaactgagtgggatgtgatatcacacagcattttagggcttgagcagaaggttggagctggtcactgggaaggtttatttggagagactgccaacctggtgctgtggggctgagtgtggtgatgggtatgtgtcagcccacagacactgagcctttccagtgtgcctgcactgttccaaacactctcttgtaataacttctggaatcctcacacaccattaaggtaggtgcagttctgttctatagataaggaaatggggcacagagaagttcaatgccatgccccaaggtcacaggttggggtttgcaggtgcctggattttattttcattttttatttatttatttatttttttgagatggagttttgctctcgttgtccagggtggagtgtaatggcatgatctcggctcctctgcctcccaggttcaagagattctcctgcctcagcctcccaagtagctggaattacaggcatccaccaccactccaggctaattttttgtattttctagtagagacggggtttcaccatattggccaggctagtctcaaactcctgacctcaggtgatccacccgccttggcctcccagagtgctgggattacaggtgtgagctactacacccggccgatgcctggatttcaatctcagttgcctggctcaagagatgtgccctaattgcagtgccagcctggctccacacaccatgcttaggagttaggccttgataaggagccagggaaagttgctgcggcaaatgtttcggaaagatggcctggcagtagggtagacgggcacccagggacaggagacccagcatgagcaggcatggtaatggtgcacaggaggatgacacggcacagcactggggatgcacagaagggtggatgtgagagcgttcctgtcgtttccgccacctggatccctctcacctgtgtctgttttgcaactccatctcgttatgctacttcagtacgttccatggtgtggtctctggaagcagcacctgggaacttgttagatacgtaaattggagggcctagcaggctgtgcttaacgagccctctgtgggggagcctgatacaggctcatgcttgagaagcactctcctaatctaagccactagcacccagcagtgggtggccacaagggtcttgtccttgctttggctctctctcaaccctcaggcttgcctgtgctcagggctttgtggctccattaaccatgcgtcgctgacgctgagtttaccgtggtcggcctcgcttctcagtgaagtccaagggcctcgcagcctctgcatctggtgatttctctgcctttcctcaaagcttctgcttggctgcctagtccacagcctcccgattcaccattcacctggtcccagcaacagaagtctcagctggacacacaacatgctttagagtgagtggctcttgtcttctcaactccggacggcgacagtgaaattgtgggaagaacctgaggctctgagctgtggcctcagaagctctgtcccttcccttctggttcctgaggagttggtgtggtcatgtgtggcagtcctgactcgcacctcctcccagcagttagcacggtaccttgccaaggtggcaggagccaggaagaagagtaggaggtggcataataattacaattgcaggctttgggatcaggaagtcctacatgcgacaagaatgcttacttcctaagatgaatataggattaaggatgtcattgcgtgaaatagtaagcaaataacctagggacaggaaggaccagtacattattgagctcagctttgtttcaatgatgtaagtggcagtatttatcaaattaatatctttgtttttcaggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacagtaagttttatcatctcttgaatttttaattttgtagggctaattaactaccttattccttgtagcacattagtgaaagtgagttccataatgtcacttctaagtaaccccacttcttgaaggagtatgtataggagctttctggtggttacatcagcttacttaccgacattgagctacattcgagtcataaagggcagagccctgaagacaaaaggctgagaaggaatagcttagggtttggtaatctcagaccttcacaacagttgtcagtgtcatagaaatactaaaactttttgctttttaaaattgtttgtagactgggcatggtggctcatgtgtaatctcaacacttggaggcgtgaaggtaaaaagattacttgagcctaggaccagccagggcaacataggccccatctctacaaacaaacaaaatgtagccaggcgtggtggggcgcacctgtagtcccagctacttgggaggctgaggcaggaagattccttgagcccaagagttcaaggctagctatgatcacaccactgcatttcggcaggatgactgagtgagactctataaagtatttgcaacccagttttctgttttcccgtctgttttgtttccctgtgacattcttggttcattcagtgtgagcatggtagtaataatccatagtgaaaagtttcttatattcactgaccaaagttgattcgtcattataattactgtttagcgcttttgtttgtttgtttttgaaacagggtctcgctctgtcacccagcctggagtgcagtggcccgacctcggctcactgcaacctccacgttctgggttcaagtgattcttgtgcctcagcctcccacatagctgcgattacaggcatgcacctccccgcccagctaattttgtatttttaatagagaccagtttttgccatgttggccaggctattttggtttgttttttgagatggagtctgttgcccaggttggagtacagtggtaccatctcggcttgctgcaacctccgcctcccaggttcaagcgactctcctgcctcagcctccggagtagcttggattacaggcacctaccaccacacccagctgattttgtatttttagtagagatgtgatttcaccatgttggccaggctggtctcaaactcctgacctcaagtgatcttggcctcccaaagtgctaggatgacaggcatgagccaccgcacccagccgtttttatttgtttttaagagacagggtctcactcagtctcccagtctggagtgcagtggtgtgatcatagctcactgcagtctccaactcctggagtcaagcaatcctttcacctcagcatcctgagtagttgggatcataggcatgcaccaccgcacctggccaatttttaagaaaaaattggccaggtgcggtggcttatgcctgtaatcccagcactttgggaggccgaggtgggcggatcacgaggtcaggagatcaagaccatcctggctaacacggtgaaaccccgtctctactaaaaatacaaaaaattagccaggcatagttggcgggcgcctgtagtcccagctactcaggaggctgaggcaggagaatggcatgaacctgggaggcggagcttgcagtgagctgagatcgtgccactgcagtccagcctgggggcagagcaagactccatctcaaaaaaaaaaaaaagaaaaatcatttttgtaggcatggagtcttactttattacccaggctgatcttgaactcctggcttcaagcagtcctcccacctaggctcccagagtgagcgacaatacccagactgtttagagcttttatcacatctgtgagacagctctggtttggtgtaattcaggtgtctcctggaaccccttgagctctcgaggagattacctgaaggtccccctgtcccagtttattctctactgacagagttctcactgcaagtttgttcaaatgatctaaactcaaaacatctgttgtctgagatcctgaattccttgtcagacagaccagatgtgaaatagcctgctgatttcttccagtgctccagaagtactgtgaatggtatgggaagatggatggtggggacaggtgagactgaacaaacagctgtcagagggaacagtgatggaaatgctggtcacaccctctgagccttttgggtcctcaccctcttctgttacttcctggccgccattgtgctccagggcccacttttgatggtgatacacaaaaaagcccacttctttgacctcccaccttggtgcttcacctgcaggttaccatgtagctcacctatggggaaataggtgctttaagccttaacccatctctgcttaggccagatcagaacaggcaaaacaatgtagccttttgtgcatgtgtgtgaagaaattggttaaaattcctgaaagttacggtgtggttatagcttatgtggttgtgataggatggtcagttttcaccaaaagctatggacctctgagggccctgctagtgaaaaggaagagaattatgaccagaattatgggagggccagagtggggagctctgcagatattcctggattgattgagcctgtcttgagtggtgcagggaagctacttgggaggaggaggctcagagacagcagagtgggagggtaaaggatgtcctcaggaaggaggtgacatttgagtgggttctggaaagctgtgcaagaattggccaagtaaagaaagggagggacaggcactccaggcagggaagaagctctggttaaaggcatggaggggtcgatagagcaggcagaaaagaggattcctgaggttagggaggggtggggacattcctgtaattatccgtgaggggagattttgggtccaggacccatggctgctttcttggctccctcagtggggcccagaaaccacacaggtagctgtgggacatggaggtctgcttagcagtgcctagtaagaaagacttggtctgctacaggctgggcatggtggatcacaaggtcaggagttcgagaccagcctggccaacatggtgaaaccccgtttccactaaaaatacaaaaaaattagctaagcacagtggcgggtgcctgtaatcccagctactcgggaggctgaggcaggagaatcgcttgaacctgggaggcagaagttgtggtgagccgagatcattccactgcactcctgcctgagcaacagagtgagactccgtcttaaaaaaaaaaaaaaaaaaaaaagacttggctacaagggaaggagcctatacgaggacaaaggacattgtcaaagagaatggggtaaatattttcatttatttattattattattttgagacagagtcttgctctgtcgcccaggctggagtgcagtggatgcaatattggctcactgcaacctctgctgcccgggttcaagcgattctcctgcctcagcctcccgagtagctgggactacaggtgcatgccaccacgcccagctactttttgtgttattagtagagacggggtttcagcatcttggccaggctggtcttgaactcctgacctcgtgatccacgagaatggggtaaatattaaagagtcctaagtgtttgaaatgcttgttttctggtgctgtaaagaaatagcatttgaacgtaaattcaattttttttagcaaggccatatttatactttctgcagaaagggtacactcaccagttgttttgccatgagaatacattgaataaaggagacagggttatttataacttgatgtgtttactctgctgctgtatccagtttttattggctggaacaggacctcacattctgtatttgtcccaattggctagcaacttagaacttttttttttttttttttttggagacagagtctcactctgtcgcccaggctggagtgcagtggcatgatctcggggtcactgcaagctccacctcccgggttcacaccattctcctgccgcagcctcccaagtagctgggactacaggtgcccgccaccacgcctggctaattttttttgtattttttagtagagatggggtttctacgtgttagccaggatggtctcgatcttctgaccttgtgatccgcccgcctcagcctcccaaagtgctgggattacaggcatgcgccaccacacctggccagaacttttgaaaagaggcaaaggcagaggagaataaaggaaggaggaagtaacttgtggaatgctgaaaaaggtaaaaataacctttaaataaggaagaggaacaggctatgatctaatgcttgcttggactaatataagcatgccaaggtaaatatttaggctaaattgtgggagctaagaatataaagtacattgatttctttattatggctagcagatatttaagaatgttagtacaggtctttgaataaattttgcttttaagagaagttactatttatttctaattagatggggaggaaagtctttgaagaggaacctctactttactttttacataagcaacctggtggctgctggggaaacccttaaaacactgggcagtagaactccactgaggttagtgtcagctcccttgaggccaagagcagctgctcacttgggagttttggctgctgtcgcttggcctctgggccctcctggggctggttctgtgctccttagtccgtgggaagttactagacccagcttcatttccaaaacatctcaagctgccatttgataagagtagcattggaacacagaatcaggcttatccctgttgcctagcgagggcttggctggatggtgggtgttcctggatcttgtatgaatctctcctgcaatatctggtcctttcagagtttcctgggacagattgaccctagtaaggctaaggaattgggatagtagtagcatcttccgtctctgcgcagtactttacatacatgatctcatttagaccttataacagctctgcaaggctggtactggtgaggaacttgagacttagtagtgcagtacttgtcccaggttgtccagtgcaaaggatagcaggacagggcacagggagaagagcacggaaacaccagtgggaatacaaggtgacaggctctgttgggaagctcttttttttttgggggggggtgagatggagatttactcttgttgcccaggctggagtgcaatggcacaatctcggctcaccgcatcctccacctcccaggttcaagtgattctcctgcctcagcctcccgagtagctgggattacaggcatgtgccaccacgcccagctaattttgtatttttagtagagacgggtttcaccgtgttgcccaggctgatcttgaactcctgacctctggtgatccgcctgcctctgcctcccaaagtgctgggattacaggcctgagccactgcgcctggccagctctgtctcttgattaaggtggaggatattctcagcttgtcttttgggaccaggcagaccagaaatgctggagcatattggcaaaccagcagcctaaggatttggaagaaaggctggtcagagtgtcagttgcttatcaaccagctgagagcctgaactttccggaagacatggctcttgggtagccactgggaacaggcttaaaacagctttggttctttgagttctttgtggggagtgattgtctggtgtgaatcacagttgatagtgccctgaaaggttcaaggccacatttcccaggggaagataagctttccacaatgtatagaaactcagaaaactccaagttctttatgctaagaaacaaaaagggctcagaaaggctgaacacaaagtcaaggaagagaaattgataacttttggttaaagggaagagtttccagccttttggccagggcatccactaccaagtccaaatcctgacttggcctcaagcttttgtaaagggatgcatcgtgtcccttttgacctgctgatagtttttttgagatggagtctcacactgtcacccgggctagagtacagtgacgcgatctcgcctcactgcaacctctgcctcccaggttcaagtgattctcctgcctcagcctctggagtagctgggattacaggtgcctgccaccacgcccagctaacttttgtattttcagtagtgatgaggcttcaccatgttggccaggctgaccttgaactcctcacctcatgattcgcccacctcagcctccgaaagtgctgggattacaggtgtgagccaccatgcccagccgacctgctgatagtttgataaaacagaagttttactttctggaatttctactcattttatgttttggatggtttctctctccgtaagcattcagtattcttgaatctcaagttttgaaaggagccctaacttcaagtctactcgctggcttcttaatgaagtgaaccatttctattgcccatttagttcttcctgaaaccctgacattctggtgttcatgtgactcttctttcccccttgctactcagagaaagcgtcgtggtggagcaataaattctagacaagctcagaagcgaactcgggaagcaacctccacccccgagatctccttggaagcagaacccatagaactcgtggaaactggtaagattgccagggacactacaactgtggggtgttaaagtggagagagaacactgtaccagggtgagctagtagaaggtgctttcagtgtctttagaaggcctatgcagtctcacactcaccatgtacaactcaaagcttcacagattctgaaatagcttctcaactgggctaactgttcaactctggtaatgtgcagcagtggggtaggatccatttaaaaaaaaatctagcgcaaatgagatagcccaccttttctatctgaaactgcatccccaattgctggaccttgtaaagtacttcgctttcctcttctgtttttcattaggacatgaaatcacccaagaaggcaaacttgtccacagagctccctgtgttggagcttggtataggcagaggccagattggatttccccttctgcctgctcaagaagtggttgatggctggcctaagtccctttgctctgcatatattgtttttataactaggatacctgcaaactggcattttatttttacttatttatttttgagatagagtcttgctctgtcgcccaagctagagtgtagtggtgcagtctcggctcactgcaagctccacatcctgggttcacgccattctcctgcctcagcctcccaagtagctgggactataggcacccgccaccacacccggctaattttttgtatttttaatagagacagggtttcaccatgttagccaggatggtctcgatctcctgaccttgtgatccacccgtctcggcctcccaaagtgctggtattacaggcgtgagccactgcacccggccatgcaaactcgcgttttaaacagaagaaacttagtgcaagataaatttcatgggccccccaggagaaatgaagttctctatatggtctctgagtttcacttctacaaatgagttcttgaaagccttgacttgaggctaggatcctggctctagaccaaaaaggaacgaactgctttccgtcatggcacttgtcatcctctaggcagtcttacccctgtgtgtacttagggctgcccattagagcactgttttgtttttgtttctgtttgaggcagagtttcgttctgtcagccaggttggagtgcaatcgcgtgatctcggctcactgcaacctctgcctcccaggtttaagcaagtctcctgcctcagcttcccaagtagctgggatcataggcgcccaccaccacacccggctaaattttttttgtatttttagtagagacggggtttcaccatgtcagtcaggctgatctcgaactcctgacctcagattatccacctgccttggcctcccaaagtgctgggattacaggcctgagccacccgcctggcctagagcactgtttttgtaagagcccagaattgtgttcaccagaaagagaatggttcaataaattgttgtatatcagtatatggactgttggacagcccttctttttaataaagaatgcaataattttatataaattatattgtatatgtaagattatcacggtttttattcttgtgaaactttatgatacaagaaaataaaacaggccagccagattgcttgagcccaggagtaccagaccagcctggacaacatagtgagaccctgtctctataaataaaaaaattagccaagtgtgggaggctgaggtaggaggatcacttgagcctggaacattgaggctgcagtgagccgtgatcgtgccactgcactctagcctgggcaacagcaagaccccacctaaaaaataaataaaagaagttacgttgggttgggcgccatggctggctcctataatcccagcactttgggaggccgaggcgtgcagatcacctgaggtcaggagttcaagaccagcctggccaacatggcgaaaccccatctctactaaaaatgcaaaaattagacgggcgtggtggcgggcgcctgtaatcccagctacttgggaggttgatgcaggagaatcacttgcacctgggaggcagaggttgcagtgagccgagatcgtgccactgcactcctgcctggacgacagagcgagactctgtctcaaaaaaaaaaagttaaatgcattacaagacactttccccaaatattagaccaatactgtttcttaaaaaacttcatttagtgttttgttgttgttgttgtttgtttgtttttgagatggagttttgctcttgttgcccaggctggggtgcagtggcgtgatctttgcatcccggggttcaagcaattctcctgcctcagcctcccgagtagctgggattacaggcatgtgccaccacacctcgctaattttgtatttttagtagaaacggagtttctccatgttggtcaggctggtctcgaactctcaacctcaggtgatccgcccacctcagcctcccaaagtgctgggattacaggtgtgaaccactgtgcctggcccattccgtgctttttaatattaatattaatagtaatcagaaataaaaatggttgtgcgtcattttttactttatataaatggaagttgtacgttaactgtttggtccatgtccttctcacctttatcctgtgcacatgtagacatcacagtataccctaagggctgaaaggcaagcttcacaacagatgcaacccattttgtatgttgaggttctagctatcagtatatatcactgttattctccatccaactagggagacaaacttgagagataaatggaaattaaaagtttgtccttggccgggcacggtggctcacgcctgtaatcccaacactttggaagactgaagtgggtggatcacaaggtcaggagttcaagaccagcctggccaagatggtgaaaccccatctctactaaaaatacaaacaaaattagccaggcatgctgccaggcgcctgtaatcccaactactcgggaggctgagacagagaattgcttgaacccaggaggcggaggttgcagtgagccaagatcgcaccactgcactccagccttggcgacagagcgagactctgtctcaaaaaaaaaaaaaaaaaaaaagaatttgccctagattaaccgatgaagttactaagctaagcctgacttttggtccttgggccaagtgagagtggtcagcttcacctgctgggaggagcagaggtttcaggctagtccatcccaaagagaaaggcctggggctgggcatgcatggtgcgttctcccagatggggcacagaggcatagccgtgtggaagtgggatgccgtggaatagaggtatgcacatgcgcacacatacataaccccccaggtacatttgtaaaaaccatacctccccactcagagcagaattctggaagggtggttactggctttccctcctgagggaggtgttggtcctggtgctctttgcagtgtatacttcaggattgttttagtttggggtaagcctataacattagcagtcatactaaagtgtagagggatacaaccttactttcctcttaatcttaatgcttgttgaaatactttcttttgaagctggagatgaaattgtggacctcacttgtgaatctttagagcctgtggtggttgatctgactcacaatgactctgttgtggtaagtgttggagtgtgagagtcggctgtttcttgggtatgggtccctggccagtgccagcatctgacagccttggtcacagactccaagtcaaggttacagcttatgctaaagaagttcatgcatcttgtggaattgagcttttagaaagaaaataaacagtaacaataataataacaaagaagttcatgcattcagtgacgagagcccaaaatgaaaaatgtttctggaaaatcatttgttatagccttgtcgcctatggagtaggtctgtgtaacctgaccttgccacacctgggcacaaaagtggtttggggagaatctcaagacccccacatctgtcttcagtccctgattccacagtttacaccagctgtgtgaccttgggcatgtgacttagcctcattcactttccatgaaatggggacaggtcactcatgtcagcagggcatggtgtaagacatcttacaacagatgccgtgtttgagtgcctgacacctagaatggtgcccagtcactgtgagtgtatgccctcccaactgaaaggaaagggaacgttggctcagcactgcccatgggaaatctctcaagttccaaaagtgcctgctacttagcatggcctcaggggatgcaggctccctgcattgccacctgatgcctgctgcgtcctgatgccagggaggctggagcccaggaggctgcctgtgtccctgtctcatggcaccggttacagactgcaggggacgtgtgtatacgtgtcctgcctgccaggagggaggccttgtctggtcagaggacacacggagaagctatttctgatagacctgtttcatggtgcatgcaggtctgggaatctggtcagcatcttaagggcaagtttgcctctggaagatgccacttgagtgttttctgacagtgtgctcggaacacaggtcggggtgggggcacacttggcagcattggcagtggggtggtaagtgctgctgaggaggactgtggggtgtgggggctgctagtagctgagtcttcgccttggccctgggctcactggtgttggggttatcctgtttggctgatgcctgggtatctgaatagggacaccccataggtgttgcttcttagttgtgctgagaacttcagaatagggttatactgagaagtttcaagacttcaatgcaaagaaaaggacagggatggaaaaccatctgagataagcagcagtgggtttagttgtacgtggtccctgcttaggtctcattaacgtgttttctgaggtacatacacacatatgactttgcttatcatccctgtgtcctgcatggagttctggaaagataactaatttggtatattagctggcagctacagcacagtcactgatttttcccctctttctttttcccagctgacaccttggtttcaccagttgctcattaaagctggaaagtggtgtctgcagaagtttttttgttttttgttttttgtttttcttgaatactcagtgttcaccacagtcttcttggccttctctctgccagaccctgaggagagagctaggattttgactgcaggaagacaatgattgattggcttttgttggctgacaaaccaacatcatttcccctttcacacttgtgttttcttttgctttagaaacagggtctcaggctgggcgcggtggctcacgcctgtaatctcagcactttgggaggccgaggtgggcggaccacaaggtcaggagtttgacatcagcctggccaacatggtgaaaccctgtctctactaaaaatacaaaaattatgcggacgcctgtagtcccagctattcaggaggctaaggcaggagaatcgcttgaacccaggaatcagaggttgcagtgagccgagatcacgtcactgcactccagcccgggcaacagagtgagactccatctcaaaaaaaaaaaaaaatacaaaaattagccaggtgtgatgatgcatacctgtaatcccagctactcgggaggctaaggcaggagaattacttgaacccaggaggcggaggttgcagtgagccaagatcgcgccactgcactcaagcctgggcgacagagcaagactctgtctcaaaaaaaaaaaaaaagaaaagaaaagaaacagggtctcactctgttgcccaggctagagagcagtggcatgatcacaccttactgcagcctccaacccctgagcttaagtgattctcccacattatcctcctgagtagctgagactacaggtgcatgccaccatacactactaaatttgggtcgggtggtggtggtgattttttaatatttttgtagagacagggtctcactgtgatgcccaggctggtcttgaactcctgggctcaagcagtcacccacctcagcctcccaaagcactaggattacaggtgtgagccaccacactggccagctttgttttgttttgatgactaagctgctcttgctaaaagggcttcctctctgaacttccctacctttcttctgtttccctgggctagggctccatgttggcagtcctactcccaattaacctggggctgtctggttaacctttataagatctgcagtcattgggagacccggggaccaggaatattggtgttgagggagctaccctggaaagtggatgggtggccagagggagagctgataggtaaaagggagacgctcctggcttgggaagcaggagtcctaggttctggtctctcagatctactggtcagtttgatcagtggatttatctcacactgtcctcagtgttgtcagccacaaaataactgctttggacttgatagctcttgctaatcattctctacttatttttgattttaataagtccaagtgccagtttatgaatttacactgagacatatacttgagtttggaattctgcctctgagcagatctgtttgggaggcctctaatgctagtcactgaggataaggggcatctgtagatggatcgtgtgttcagggtgaccctaggctgcacctgcaggagagtataaaatggataaatgtattcattctggaagcggggtaaccttccttaccagttccgccaggacctgtcgaatagtttgagtgcactgctttagctccagtagctctgtacctgtaatataggaatccctggataccaggatccagaggtagccgtcagaacatcagggaaccctctaaactttgtgcctgtggtcccagctactgggaaggctgagcaaggaggatcacttgaactcaggagttcaaggcaagcctgggcaacatagtgagaccctgtcttcttcaaaaaagaaaaaaagactggaaactttgcatacaggtgtgcacattcttccaactttcgaaggaattcaaagcccctgaaaaatgaagggaaatgaaaaatgcggtaagatgcagtgagagactttgttcatctcatttgattagtttccctcaaaatgaactttcatttttggcattgcatagcctagaaaaggcatcactgctgtgtcccgaggtgtgagtgtctttgatttttactggataaatgccagacttttctaaagagggagcagttcacattcatgccagtgtttgaggttctccacatcctcatggccacttttaattttagccattctgatgcttgtccagtggtgtctcattgtggttttaatttgtgcttttttattacaaatgggatcaaacaccttttcatgtttatttttctcttttgtgaagtgcctgtttaaaacttctttgttttatagcttttatttatttatttatttatttatttatttatttatttattttgagacagagtcttgcactgttacccaggctggagtgcagtggcgtgatcttggctcactgtaagctctgcctcctgggttcacgccattctcctgcctcagcctccagagtagctgggactacaggcagccgccaccatgcccggctcattttttgtatttttttttttttttttttttgagacagagtctcactctgtcacccaggctggagtgcagtggcacgatctcagttcactcagttcacctccgcctcccgggttcaagcaattctcctgcctcagcctattgagtagctgggactacaggcacgcaccaccatgccaggctaattttttatatttttagtagagatggggtttcaccatgttgcccaggctgttcttgaactcctgacctcaggtgatccactcgccttggcctcccaaagtgctgggattataagcatgagccgctgcacctggctgttacatagcttttttttatgcaactttcgtatataaacttttttcatcataaataggacttttcactttagtacctagctcatcccagtagcttttccagaactgctgtcttcaccacaaagctccctacgttttcccaatgcaaacctgagtgtttttagcattttaactttcctcacagagaagacatcgtggagcggataaatagatttgcaggcatttctgtgtcttctccagtgctgtctggaataattttctccaccacttctttcaagttatttgtctgcatctctctttttttttttttttgagatggagtctcgctctgttgcccaagctggagtacagtggtgcgatcttggctcactgccagctccgcctcctgggttcacaccattctcctgcctcagcctccagagtagctgggactacaggtgcccgccaccacacccggctaattttttgtatttttagtagagacggggtttcaccatgttagccaggatggtctcgatctcctgacctcgtgatccgcccgcctcggcctcccaaagtgctgggattataggtgtgagccaccgcgcccggccttgggtcatgatttccatcatcttagacctgttggtgctgaggttttctttaaccattggtagtctagacatcaacatgagcttcaatcatggtctgccttttttttttttttttttttttttttttttgagacggtttctcactgtcactcaggctagaatgcagtagcgtgatctcagctcactgcagcctctgcctcctgggtagctgggactataggcatgcaccaccacgcccagctaatttttgtattttttgtagagacaggattttgccatgttgtccaggctggtctcgaactcctgacctcaagtgatccacccgggtggtctgccatttttaaatcacacaacacattttgtcatgggtaagacccacgcatggaagctaggcagtttttgccctgaacatcttgaacagtcagcttgagttttctgcaagtcagcaagccttcaaacataacccttgaggccatcagatacagttttggttccttgagtcctataaactttttaaatcgttgaaaaaattgaactagaacaaagcaaaccatttgttgttttctttttcccccctgagacagagtctcgctctgtcgcccacgctggagtgcagtggcacagtcttggctcactgcaacctccatctccagggtgccagcgattcccatgtctcagcctcctgagtagctgggattacaggtacacaccaccacggccagctaatttttgtatttttaggagagacggttttgccatgttgaccaggctggtcttgaactcctggcctcaagtgatatacctgactcagcctcccaaagtgctaggattacagacgtgagccaccatgtccggcctccttggttgctttttaacagcaaataatcttttttttttttccaagttgtgtgctttctccaaatttgttttttttcttcttcttcttctttttttttcccttgaaacagggtctcactttgttacccaggctggagtgcagtggtgccatcacggctcactgcagcctgtaccttctgggctcaattgagcttcctgcctcagcctcctaagtagctgggactataggggtatgtcaccatccctggctgattttttatatttttttggagagacaaggtcttaccgtattgcccagggtggtctcaaactcctgggctcaagtgatcctcccaccttggtttcccaaagtgctgggattgtagttgtgagccactgagcctgaccttgggtcacttttcatgagcattttcagtatgccagtctctgctctggctagaagcaatgcagtggtagaaaagagactggcaactctctttaaggaatcgagattctttaaggggaaggttattgaaaatgttacttaggctgtttttcttaaatttccaaagattgtctcttagtaaggttgatttttctggaatctttttttggtctgtttctataatgtatgaataagtcacactatgtgtgttttattctgtatcctgcctggttttccatttatgagactctgtagaaaggatgcttgataaaggcttttctggaaggaaggaaggaagagggagggagggagggaaggagggagggacagaaccctgtagatctctgggtgtaaaggacacaggaggcacactgttggaataagtgagccagcccaattccatagaaagaaagaagagctcagaaaagcccaaacatcatatccaggaattagccaagatgggttggctactcaactacaatgtgattgtccgcaccagtcttcccgactttcctgccagtgccgcaagtaacaggcatcagtaactgcatgatgtgtgtagctgttggacattgagtagccttttgtgtgcacagtgcttggagatggctgtttttccagtggagcaatgtgcagtgctgtgagctgtaaagttgtctaaagcaagtgtgtcttggtgcccttggctgggtgaacattcctagaaatgccaggggccagcctgagtgcacgggacccagtgattcctatacttgcttctttcatgcagaggtgttctgaggctcacctgtgcttttagaagcacaaaggggcttcgagtgaccaatcagatgtgcctgctgcaggtccactcgtctctaaatgctctgacctatggactgttgtccatagttgagaagaagctagagtaaaataaaatgtatgagtgagtgaatctttttctttttttttttcttttctctttttgagacagggtgttgctctgttgcccaggctggaaggcaggggcccgagctcagctcactgtagcctcaacctcccaggttgaagagatcctcctgcctcagccccaggagtactgggactacaggtacacactgccatgcccagcttattctttgtattgacgggatctcgccgtgttgcccaggatggtctcgacctcctgagctcaagtgattcatcccgccttggcctcccagggtgctgggattgcagatatgggacaccatgcccagccgaggaagtgtgaatttctgatcttgggctagcttaccacagtactaattaaactattcagttcaggggattagttaattgttgttatttcagttttggtttttcacttatcttaaaagcctctcaaatagattagaggccccagagcttgtgttacacctctatccatctctcaactcatctggtaggcatttatgaagcgctggtactcttccctctgcacctatcttctgtgctgggcaagtactgtgccacctgcagggccatagctgtgatttaggttcattacagagttcttgagatgtctgcagggattctggaatttgatgtgactcggccactgggtggagggaacaccagtaatcaatactgtattgtccaccagctgagaggccaggctgtggtcgttggttttgtttttttgtttgtttggtttttgttttgttttgttttgttttttgtttttgttttgttttgtttttgagacggaatttcactcttgttgcccaggctggagtgcagtggtgcaatctcggctcaccacaacctccacctcccaggttcaagtgagtctcctgcctcagcctcctgagtagctgggattacagacatgagccaccacatgcccggctaattttgtgtttttagtagaggcggggtttctccatgttggtcaggctggtctcaaactcccgacctcgggtgatctgcccgcctctgcctcccagagtgctgggattacaggcatgatccactgccccaggcctttttttttttttttttttttttttaattaaagacagtttcactattgtcgcctaggctggagtacaatggatctcagctcactgcagcctccacctcccgggctcaagtgattctcctgcctcagcatcccaagtagctgggattacaggtgcccaccaccacacccggctaatttttgtagttttagtagagacagggtttcaccatgttggccaggctggtctcaaactcccgacctcaggttttctgcccgcctctgcctcccaaaatgctgggattgcaggcatgagccaccgggcctgtgcttttctttttttctttttgagacagtttcgctattgttgtctaggctggagtgcaatggcgtgacctcggctcactgccccctccacctcctgggttcaagtgattctcctgcttcagcctcccaagtagttgggactacagccacgcgccaccacacccagctaatttttgtagttttagtagagacagggtttcaccatgttggtcaggctggtctcgaactcctgacctcgagtgatccgcccatctcggcctcccaaagtgctgagattccaggtgtgagccaccgcgcccagcctgtggtgttgttcttatactgaagactcatctggaagctgtttttctctcattaaaagcggggacagtcagaattgttaccagtgaggaaacactctggcgaccctgttcttatgcaccccagtagttgtgtgtgtatcacctgctgcttgccagcagcccctgggctcagtgctcaggacaggcctcagtttggtaccatccacaggcaagctgggtatgactcacaagagaccataaagactcagtacgcgcactgtcatggctggggcactgggagtgtcataccctttccaggtgtccacacctaattagtgggtcatcttggcagagggtgggggcatgttggagctgtagaaagctggggtcatttctagccacagaagaatttgcttttgctcccagctaaacccaaggctttccccaagggccagcactgttaccagagcctccttttctagatttcatgcggacagtacattgtgccggccctggtaagtttggtcctgatggtgaggttgactgattgtccccagatttcccttttcaccgtctgcagtctcctctaagaggaaaggggagcacgtttcagtggctccacgtatgtggattatattctcatcctcaaatcaaagacctttatactcagtcctgcattcttcctgcatggccgtttgtgtatgtcaggatgccatttgggaaacaaaatccactctaattattcctaagcttagtggattttaacatggaaggagaagcctaaatcagcagtgtctgggctgggtctccaggaataactcttgacctcgaagcattgacccacctagggagctgctgtgtctgctccatgaagaaggtctggaggcggcatccaccccctgcactcatatctttgggttcgtgtagacagtactgcagaccctttctagggaggagaggcctgggctcaagacatagcagcctctgccagaagtgtttcttcaggatgcagctgtgcctgccagtgccaacaccctcagcagctcaaatcggcctccatcccctgccctgccagtagcatgagtgtgtctgtttgagggaactcggttcacgtctaggatcctggctgcacgggagtcagagtagaggattagagcttcttgtcactgtagggcaggatgtcctgcccaggggacaggcagggtgaggtgagcagtagggctttggtggtgagaactttcctgaaacagcccctcctacgtgctcagcaagagggaaagggcgttccactggcccccctagatgggtaagagcacttggccagaaggtgggaggaaccacgtttgaaactgttggagcagaaattgtctagatgtaagttctgagctggcaggtgagaggcttgtcaggttcttaggcccccaggacagagaattggattgtgttcaatccttggtgtgtgtcacacgcattggtcatgcatagcctgcttttctctgttagttacttgtaacaacctactgagcaatgcaaatcctcctccacatgaaggctccaccttggcagtggcctacattggtcgcgtcagcttgagagagcatcatgcccctagtgctgtctaaatgttcactgcctcacgtaaccctcacaacagcacagtcagatgtgggctctggtgactctgcttcagaagagaaagctgcagcccccagatagtaagtaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggctgtgttcacgctccaggagactccactaaacacccagcagggagagacacagcacatcagctgggaggtggagtgacttgggaagtgggcttgactgactgggagaggtgcacagatcctctgtgggtgggaggagggtggggcctctgctgctcaccagagggttccacagagggtgtcacacgtcagaaaaaagaaatggcttcgtttatcacttatatcaaactgattgcttctttctcttttgtttttctccttctgtttacaagattgttgacggtgagtggtttcgtttcctttttcactgggtttggagaggaaactggcataggtgagagccgcggtgctgcaggtcttgccagaccatccccaagggcttggagcgctccaagcaggaagatgccttcgcagatgctgtggtcagacccacacagccagtcccccttgtgcctgctgaagaaacttcaccactatcattgagcactgagctatagtcctttcttgtggcctaccagattttggagaaggctggtagctcacagcaggggttggggggtttctcctgggaagataagatagtggcctccagagctgggcagaaccttctgggttatagctgagcatggcagcagtttgtctctgggggtcccaggcagggaaggaagagggtcttaagaggcgtcaggatgggagtggtgaggatggtaagagtagagagcctccaacctgaaaatgtgacctcttaccttagaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggtaccaacgtgcccccagctctgctgccgccatgctaggatgtggggccagggcatgggaatacttttcagcaaatctgtgagcccttggccctggaagggcttgcccaagcctctacccagcatctggatacagttggaactgggtccagaactgagtccagctattcccactgtaaccagaggatgccaagcgctgacacagtgtgtgcagacagtcccagtggccccagacagggatcctggggctggtaggggcctgggggagggcagggtgactcaggttgtgtgcaccttctcatgttcaccctcccacatgcccttggggcagttggctttcctgaaagtctctcggatgcccgcgctaaggcagagtcaggaggccagggacgggactcttgtaggggataggggccactcacgtgacagggtataataaaatgtttgcgttgactgagaaactaacgtgaagcactgtgctcttaggccctcaggtactgtcagttgtcccatctgcatggacggatactcagaggtaagtaaaccaagctgtatcttccaggcttctggtttctaaacttcactgaaagaattggatgagacaggatcttccccctcggtgggattggacacccctactcacagtcatgcctgggccgtcacttattgcagatctgcctgtgaggggagaatgtgccagtttctccttggaccctacaactttcaccttcagcccctatactcctgtatgccctgagcttccgggtgcaaatgcgtcctccttttttgtgccccatcctggctctaactgaaagctgctagtgtttactggggtccctcataaccctcttgggctgtcacactgttgagatgccatggcccctgcctcctgctctccagctgagagagaccacagcagacacagttagctctccagacccctccctgttgtagcctggcccttgctttcctttaattagtcatcttaggcataggtgggtgggattctctggccccatggctgctctgggacaagggcaaactcggaggctcttctttttaatgccttctagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctggggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaagaaatgtctttccttttttcaatgtacatagttcaactctttctttgttacatttaaactatatccatggatatcagtctgctttggactcctctgctagtgttacagatggaaataaaaccattaatttgaaccaaata

SEQ ID NO: 2578 - DNA, 46408 bp, Homo sapiens
cagaagttaggaggtctgcgtctgggtctcggctcaccctggggggccgcggccatggggcttagttcctagcctaggaagggaaactgagactctgggaggggcaggaacgcccccaaggtcacttggaaagtcgggcaggatgtgctgttagggggaagacccgggcagggtttttgttccccgctgacgacgcctcctttgtgtgttcgcgccgccgccccgccatcgtggggcctgcgagtttgccggggtgcgtgggccgcgtggcggggccttttgtaggtcgggaggatctgagtacgggtgcgggcctgaccgtgggggcgccgaggtcgcagtctaaaacttagtagggcctcgatttccgggcgcgcttccgggccccggctggtggttggtggaacgtgcgactgtgaggcttgcggcccagccctgcaccgctcgggcccttcaccgctctggcgcgcctatagacaggtgtatgaagattctcacgacccgaaacagagttgctagtaaacaccgcttttccgcctttgatccatcgagggaagagggaaaaggatagagcttgggcaagccgttttggtagggatttcagcttttgtctttcacttgtcagttcccatagacgttcacaaacttaataatcttcgttctgtttctgcaccaagttcttgagccagacgtagggtctcagctctggagcctggcttagactgtccaactgactggggagactgaggtccagaaaagtgaagtggtctgcccaaggtcacatagccagctatttggcagcagatgaggttaagtcctacctgcaagatttgggttttgaattcattgaccaggagttttgggaccactgtcaataaaagagacattgaagggaatcttttgttactttcttggtgatttgctttttaatggacaaggacatattgggttcagttttatctgtgagtttgaggtgaaatagaggcattcgagtagcaagatatattgctggcttttgtattgcctgaatttgagcttccaaaaatcttactttaacacatcgtttattgatcttttcttgaattactacctttgtaaggaccttttgtaaacattgtttttctaatcttcatgaaatcttaatgccatacgtaaactatttctttttatataatgtatgcacatctgtgctttgtacataaaatgagtaagatttttcactctcctcaagatcaaagtagcgtatttttgaggtctcctgtatgccaacctttctgcttggaatacagcagtaaacagtcgtggtcctcctgtagctgggtgaggatggagggaataagagataactcattttattgtgttttgcaaatactgcctttttttttttgcaaggtgaaggtttatagcaaggattcatcgagcaagtctgtaaatgccagccatttttccaacagcatgtgctcactttgtgtctcttgtgtcacgtttgggtaattcacaatatttcacactttttttttttttttttttttgaggtggaatctcactctgtcacccaggatgcagtgcactggcgtgttctcggtctcactgtaacctctgccatctgggctcaagtgattctcctgcctcagcctccggagtagctgggattacaggcatgtactaccacacccagttaatttttgtatttttagtggagacggggtttcaccatattggccaggctggtctcgaacgcctgacctcaagtgatccgcctgcctcggcctcccaaagtgctgggattacaggcatgagccaccatgcccagccccaaaccttttcattgttacatctgttatagtgacctgtgatcaatgttttgggttaccatgaatagcactcatataagacagtgaacttaattggtaaaagttgggtgtgtactaacagctccactgactggcagttcccagtctctctcctcaggcctctcaattccttgagacacaatattgaaattaggccagtcagtgaccctacagtgtccaggcaaaaggagcagtcagttgaatctctcttactttaagtgaagttaagaaatgtttatccttagtgagaaaggcgtatcaaaagttgagataggccaaaagctaggcctcttgtgctgaatgacagttagccaagttgtgaatgcagaggaagagttcttgaaattaaaatgctactccaatgaatacatgaatgataagccaaacagccttattgctgatagggagaaagttttagtggtctggatagaagatcaaaccatccatgacattcccttaagcgaaagcctaatccggagcaaggtactaactctcttcaattctgtgaagagtgaggaagctgcagaagaaaagtttgaaactggcagaggttagttcatgaggtttaagggaagaagccacctctgtaatgtaaaagtgtaaggtgaggcagtaagtgttgatgaagaagctgcagcaagttatgcagaacatatagctaaaataattgatgaaggtggccacactaaacaacagactttcaatgtaaatgaaacagccttatatggaaaaaaaaatactatctaggactttcatagctagagaaaggtcaatgcctggcttcaaaggacagtctgattctcttgttaggggctagtgtggccagtgacttaagttgtaactagtgctcatttaccattctgaaaatcctagggcccttaagaagtatgcaaaaatctactgtgtgctgatcattgaaacaggaaagcctgtatagtagcatatctgtttacagtatgttttactgaatattttaagcccactattgagatctacagctcagaaaaaaagatttctttcaaaatattactgctcattgagaatgtgcttagtcaccaaagaggtctcatggagatgagtaagattaatgttaacatctgttctgcagcccatggatcaaggagtaatttcaactctcaaatcttacttaagaaatgcatcttgaggctgagcacagtggctcatgcctgtactcgcagcacttcgggaggccaaagctggtggatcgcttgagctcaggagttagagaccagccggggcagcatagtgagaccaccccctccactgccagtctcttaaaaaaaaaaaaaaaaaagggcggcagggggaaagaaagaaatgcattttgtaaggctacagctacatagattgtgattcttctgatgggtatcaacaatgtaaattaaaaacctcctgaaaggatatactattctagataccattaagaatatttgtctccaggcacggtggctcacccgtgtaatcccagcactttgggaggcgaagtgggcggatcacaaggtcaggagatcgagaccatcctggctaacatggtgaaaccccatctctactaaaaatacaaaaaattagccggtcttggcagcgggcacctgtagtcccagctactcgggaggctgaggcaggagaatggtgtgaacccgggaagaggagcttgcagtgagccaagatagcaccactgcactccagcctgggcaacagagcgagactccatctcaaaaaagaaaaaaaaaaagaatatttgtgattcatgggaggaggtcaaaatatcaacatcagcagttcacggtggctcacgcctgtaatcccagcactttgggaggctggggcaggcagatcacctgaggtcaggagtttgagaccagcctgcccaacatggtgaaaccccgtctctaccaacaaaatacaaaaattagccaggcatggtggcacgctcctgtagtcccagctacttgaggagctgaggtaggttaatcgcttgggcccaggaggtggaggctgcagtgagccgagattgtgcctctgcactacagcctgggcaacagtgagattccgtcttaaaaaaaaaaatcaattaacacaacaagaacttggaaaaagttgattctgaccctcatgggtgactttgaggggttctagacttcaatggaaaaagtaactgtagatgtggtggaaatagcaagagaactagaattagaagtagagcctggccgggcctggtggctcacgcctgtaatctcagcactttgggaggcctaggcgggtggattacgaggtcaggagttcacaaccagcctggccagatggtgaaaccccgtctctactaaaaatacaaaaaattagcagggcgtggtggcgcacgcctgtaatcctagctactctggaagctgaggcagagaattgcttaaacctggaggggcagaggttgtggtgagccgagatcacactactgcactccagcctgggcgacagagcgagactctgtctagaaaaaaaaaagtagagcctgaaggctgggcctgatggatcacctgaggtcaggagttggagaccagcctggccaacatgataaaaccttgtctctactaaaaatacaaaaattagctgagcgtggtagtgggattgttactgcatagtaatcccggccactccagaggctgaggcaggagaattgcttgaacccaggaagcagaggttgcagtgagccaagatcgggccactgcactcaagcgtggacaatagagtgagactttgtctcaaaaaaataaaagggccaggcaaggtggctcacacctgtaatcccagcactttgggaggccaaggcaggcggatcacgaggtcaggagattgaaaccatcctggctaacacggtgaaacaccgtctctactaaaaacacacaaaaaaattagccaggtgtggtggcacgcacctgtaatcgcagctactcaggaggctgaggcaggagaatcgcttgaacccaggaggcagaggttgcagcgagccgaaatcacgccattgcactccatccagcctggttgacagaacgagactctgtctcaaaaaaaaaaaaaaaaaaagtagaacctgaagatgtgactgaattgctgcaatttttaaataaaacttgaacacatggagagttgcttcctgtggacaggcaaagaaagtggtttcttgaggtggaatttactgctgaaggtgcagtgaacattgttgagattataacaaaggatttagaatattttataaacttagttaataaaacagtggcagggtttgaaaggattgactccaattttgaaagaagttccactgtgggtaaaatgctgtcacacagcattgcacgctacagagaaatctttcatgaaaggaagagacaactgatgcagcaaacttcattttaagaaattgtcacagttggcccagtgcggtggctcacgcctgtaatcccagcactttaggaggccgaggcaggcggatcacctcaggttgggacttccagaccagcctggccaacatggagaaaccccgtctcgactaaaaatacaaaaaaattagctgggcgtggtggggcatgcctgtaatcccagctactcgggaagctgagacaggagaattgcttgaaccagggaggcagaggttgcggtgagccaagattgcgccgttgtactccagcctgggcaacaagagtgaaactccatctcaaaaaaagaaaaagaaaaactgtcacagctgccccaaccttcattagccactgccctgatccatgagcagccatcatcagggcaagacccttcaccagcaaaaatattacaactttgtgaagactcaaatgatcattagcattttttatttattttttaagagaatatctccctgttgccccagttggagtgcattggtgcgatcgtaactcactgcagcttccaacttctgggttcaagagatcctctcacctcagcctcccaagtagctggggctacaggcgcacgccaccgcacctggctttttgtttgtttgtttgtttgtttttgagatgtagtctcactctgccgcccaggctggtgtgcagtggcgcgatctcggctcattgcaagctccgcctcccaggttcacgccattctcctgcctcagcctcccgggtagctgggactacaggcacgtgccaccatgcccagctaattttttgtatttttagtagagatagggtttcaccgtgtttgccaggatggtctcgatctcctgacctcaagatccacccgcctcagcctcccaaagtgctgggattacaggcgtgagccacctcgcctggcccacacctggctaatttttaacaaagttttgtagactgggtcttgcccttttgtccaggctggtctcagactccagactcatgatttaatatctatggttgagtgattccctacttcttactctcttacagaaccactctataagatagttgttgtagttagccccattttactcttcctgaggcactgggagatcagggtcacttgcccaaggtcacacaattagtaagcagagctcgaaacttcaccccacccctgactcctacctttgttccttttgttaggctttgttatgtcatctgctttttttgtgtggtgggaaagcacatggccaatgtttctagaaacttcaaatagtaaaaacaaaatagtatctttatttttgctttcaccgcagaggagtctgataattatcctcaagaaaatttattgattctcagtaactgtattgtattcctcaaagttatttttcctaagttttctcctctcaccagctaagggaagttgtcctagggcctaggcatttccctgtctgccacacctcacctcttactttagccaaactactgctaaattctgctcctaaatatggcagcattctgtgttacctgcactaaaatttgcttcccttgtaagtaccttcttgatgtcttccagtgttggttctcgcctcctactcttgcaagttgaaaagttgaaaatgcctcaggtagaaatgttctctcctattctcccatcatgatcatctgtgtttttttgttttttgtttgttttttgagacggagtcttgctctgtcacccaggctggagtacagtggcacgatctcagcactgcaacctctgcctcccgggttcaagcaattctcctgcctcagcctcctaaggacctgggattacaggcatgtgccaccacggctggctaattttttgtatctttactagagatggggtttcaccatgttggccagcctgtctcgaactcctgaccttgtgatccacccacctcggcctcccaaagtgctgggattacaggtgtgagccaccacgtccagcccttttctttctttcttttttttttttttttaatttaagagaaggttgtcttcctatgtttcccgggcaggagtgcagtggctatttgcaggtgcaattatatagcacagtacagcctaaaacttttttttttttttaaagacagaatcttgttctttctcaactcacttcaacctccacctcctgggttcaagtgattcacctgtctcagcctcccgagtagctgggattacaggtgggcagcaccacgtctagctcatttttgtatttttattagagacagggtttcactatgttggccagcctggtcttgaactcctgacttcaggtgatctgcccgcctcagcctcccaaagtgctgggattataagcatgagccaccatgccctgcctacagcctcaaactttaagctaaattaatcctcttgcctcagtgtcccaagtaaatgggaatacaggtgctgatatggtttggctgtgtccccacccaaatctcacattgaattcctacatgttgtgggagggacccagtgggaggcaattgaatcttgggggcaggtctttcccatgctgttctcatgatggtgaataagtctcaagagatctgatgctttaggtcgggggcggtggctgatgcctgtaatcccagcactttgggaggccaaggcgggcggatcacgaggttaggagttcaagatgagtgtggccaacatagtgaaaccctgtctctactaaaaatacaaaaattagctggacatggtggtacatgcctgtagttccagctacttgggaggctgaggcaggagaattgcttgaacccaggaggtggagattacagtgagccgagatcatgccactgcactccagcttggacaacagagtagacttaatctaaaaaaacaaaagagatctgatgcttttataagggggagtttccctacacaagctctctttgcctgctgccatctatgtaaggcatgacttacttgcttctccttgccttccgccatgattgtgaagcctccccggccatttggaactggcttttgtaaacttcttgcttttgtaaattgcccagtctcaggtatgtctttattagcatcgtgaaaacatactggtacagtaagttggtaccagtagagtgcgatgctgctgaaaagatacctgaaaatttggaaacagctttgcaactgggtagcaggcagggattggaacagtttggagggctcagaagaagacaggaaaatgtgggaaagtttggaactcgctagagacttgttgaatggctttgaccaaaatgttgataaggatatggacaatgaaatccaggctgagatggtctcagatggagatgaggaacttgttgggaactggagcaagggtcactcctgttatgtttcagcaaagagactagccgcattttgcccctgccctagagatttgtggaactttgaacttgagaaagatgatttagggtatctggcagaataaatttctaagcagcaaagcattcaagagatgacttgggtacagttaaaggcattcagttttataagggaagcagagcataaaagtttggaaaatttgcagcctcctgtcaatgtgctagaaaataaaattccattttctgaggggaaattaaagccagctgcagagatttgcataagtaacagggagccaaacgttaatccccaagacagtggggggaaatgtctccagggcatgtcacaggccttcatggcagcccctcccatcataggcccagatgcccaggaggaaaatatggtttcctgggctgggcccagggttcccctgctgtgtgcagcctaggggcctggtgccctgcgttccagccgtctcagctgtggccaaaaggggccaacatagagtagaactcaggctgtggtttcagaaggtgcaggccccaaaccttggcagcttccacatggtgttgagcctgcgagtgcgcagaagtcaacaatgagggtttgggaacctccactagatttcagaggatgcatggaaacacctggatgcccaggcagaagtttgctgcaggggcgggacactcatggagaacctccgctagggcagtgtggaagggaaatgtggggttggagcccccaagcagagtccctactggagcaccacctggtagagctgtgggaagagggccactgtcctccacaccccagaatgatagatccactgacagcttgccctgtacacctggaaaagctgcagacactcaacaccacccagtgaaaacagccgggagggaggctgtactctgcaaagccacaggggtggagctgcctaaggccatgggaactcacctcttggatcagcgtgacctggatgtgagacatggagtcaaaggagatcattttggagctttgagatttggactgctctgctggatttcggacttgcatggggcctgtagcccctttgttttggccaatttctcccatttggaatggctgtatttacccaatgcctgcacccccgttgtatctaagaagtaactaaattgcttttgatttacaggctcataggtggaagggacttgccttgtctcggatgagactttggacttttgagttaatgctgaaatgagttaagactttgggactgtgggaaggcatgatttattttaaaatgtgaggacataagatttgggaggggccaggggtggaatgatatggtttggctgtgtcccccacccagatctcatcttgaatttccacatgtgggagggacccggtgggaggtaattgaatcatgggggcaggtctttcccatgttctggtgatggtgaataagtctcatgagatctgatagttttataagggggagtttccgtgcacaagctctctttgcctgccgccatccacgtaagacgggacttactcctccttgccttccaccttgattgtgaggcttccccagccatgtggaactgttaagttcattaaacctctttcttttgtaaattggccagtctcaagtatgtctgtctcagcagcgtgaaaacggactaatacaggtgcacacggctgtactgtcccccgtcctgcttttaaggctttctttgtttcctaattgtgactgtttttacttgcaatgtaaaggcttcatttcccccatctctgaaattatttttttctctttcaaaaacactctgccatcttttcaaggtatccgccatctctttcaagcatgtgaggagcttgataacttttgttgggggtcggtgttcagaatgacaagggtcttgcccaggctggagtgcagtagcacagtcataactcactctagcctcaacctcccagggcacaagcgatcctcccatcttagcctcctgagtaactgggactacaggcacgtgccaccacaccctgctaatttttttttttctttggtattaatattttgtagagaaggagtttcaccatgttgcccaggctggtccagaactcctgggctcaagcaatcctgccttggcttcccaaagtgctgggattacaggcatgagccaccatgcctggccctagagcttgataatttcattcattcattcttttttttttttttttttgagacaaagtctcagtctgtcacccaggttggagtgcaatggcgcaatcttggctcactgcaacttctgcctcccgagttcaaggggttctcctgcctcagcctcctgagtggcagggattacagatgcccaccaccatgcctggctaatttttgtatttttagtagaggtggggtttcaccatgttggccaggttggtctcaaactcccaacctcaggtaatctgcccaccttggcctcccagagtgctgggattacaggtgtgagctcagaccttgataatttcagtgaggaaaaaaaaaaaatctcatttacatgtttgtgccaagtgctgtgctagtgggtggggacaccatgataagtatttgataagttatgtttcttgatttaagggagtatagaagaaatggttaagtcaggactaggaggagtgagagaaatggaagcaacctttgaggtaggccctgaagaacgagcagaaattccctaaagcggggtgggagcggcaggaccaacctggccaacttcggaccttctttgaggtccaaagtcaggtactttgaactgacttccaggatacctggagtaaagtacagttctgtttgaagtgtttgtttggaaagatgagtttgttccagtgaggttgctgtattagagaaccacttgagagtttgctgcccacagtgtcatctgtgagaaatattaggtgaacgcaaaaagttgaggccagctgaaccaagccatgtaatatacacaccttccacatagatcagtcacctcagttgacttgtatgtgagccacatttgtgtccatctgatgttacagcattcactctctttgcctccacttctcaataactcacaatctgtaaactgactgaggcccgcttccacagagcaagcttcaggcctttttcaaggtaaagtatcacagttacttgtatttcttaaccatttctcatgtgtagagctttactaccattttcactagattgttttgtgtgtgtgtgtcactgacaacatttttcagtgttgtgccctaattccatttttcctcacaaatggtgggtttttgcatagcaagatgcttttttattttttttaaggaacacatatgtccgtaactgcaaatgaacccagaaaagtgaggacgagttgggaggggaggttggtatgatataaagactttgacctatgttctgtaggcaatgcttgtgattatttgggagcaatacttgcaatattcttggatattttggagcctggtgattcttagcattaccttgtggcgcttttcagttccttggacctcctcctcctgctctcttctgcctttctgtctccttcagagcattcctgttgtgcgtgcctgcttttatcttccctgggagccagtgatttttttgacttgcatgtgtgtttttgtgtttttttaaagacagagtctcgctctatcaccgaggcaggagtgcagtggcatggtcagggctcactgcagcttcaacctcccagtctcaagcgagcctcccacctcagcctcccaagtagctgggactacagtcgtacaccactatgcccggctaagtttttgtatttttttgtagagacaggatttccccatgttgcccaggctgggacactgatttgttagtctactttctaggtaaagtgttgaaggagagttgaagagggcctagattagggcttctgggtgctggatttctccaccaagatgcaagcccctagagagttgagtttggctagccctttggtgacagcttgtattgtcccttagcccacagatgcatctgactaagagtagaagaacatgtctctctttaggagcccggagccagagacagtgctgtttgagattaggccccctctggtgtgcccttcgagaattcccattgtggggcactgctcagttgctcccatctggtatgggtcaaataatcagatttgtgagtgtctcacaaccatccctgtaccccagccaaccctgggttctgaatacagtagaggcagctaagctgctagctggtctccagcaggctctgtgctcagtggccatcaacaccaggtagcttggcaagcctgcctcctgtgctgactgtgggccctggggaagtgtcgaggatgttgacggcctctagcatctgaggtacatctgcccctcggcctccggaggagtggatccttaggtttccttcattatcttaccctttctcctggctcccagaaattaccttgtttttatatgaggccccaaagcctaggccatcttggctgatagatgtgaaagccctttgctcctttcaggcccctggggattttggttgtagcctgattgctggtggcagcttaatcggggccataagataattttatggaagacctggttacttggcatctgaacaagcctcattgcctctctgagcatagtctgctgctttctgctttgatcaaattcattcctcttgtccctgcaaaccttcaggggaggccaatgttcaaggcccctgagccttaggaataaataactctgggtgagaactgcctgtcattggctgtgtgccggctttcttcaacctcctctgagtcctgttctaagtctaagccgttgtgattagctacatcctgccaagtctgttctggaaatgaataaagcccttgctgagagccggaaacattggttccagttcctcctggggtgaaggtttgttttgcctttatttaatagcactcatacctgtaagaagggacatgctctccagcccttctgatataatacctatttattacttgatttgttgatcatctttccagctaggatatatgctccatgggtagttttttgttgctgtttcccatcccattcctagcccctggagcagtgccttacccagactaggcacctgtgaatagttagcaaattagttgatagagctgccttctgggtgctaggaaccatactgggtgtttcattcagcggtcactggttccacagaggtgaggtgttctactcaattaaagatgtggacactgaggcacagaaggcaagtatttgtccaaggctgtagggcttattggccagccacatcattgctgaccgcttaaccacataccctcatttgtataatgagcaagaggctcatatttcttctgagtattaaggtgtggttattgatatgactgagggtatcaaagttctgtttaagaggtgtttgtgaacaggtgcggtggctcacacctataatcccagcactttgggaagtcaaggtgggcagatcacttgaggtcaggagttggagaccagcctggccaacatggcaaagccccatctctactaaaaatacaaaaattagccgggcatggtggtgggttcctgtaatcccagctagttgggaggctgaggcacaagaattgcttgaacctgggaggtggaggctgcagtcagccaagatcacaccactgcactccagcctgggtgacagaacaagactgtgtctcaaaaaaaaattatttgtttttattgatttttatttatttatttattttgagactgagtttcacttgttgcgcaggctggagtgcaatggtgcgatctcggctcacctccacctcttgggttcgagcgattctcctgcctcaggttcccgagtagctgggattacaggcgcccaccaccacacccagctaattgttgtatttttagtagggggtgggtttcaccatattgttcaggctggtctcgaactcctggcctcaggtgatccccccccgcctcggcctcccaaagtgctgggattacaggtgtgagccaccatgcctgacccaggtctcttattttcagtgggtaattgtatcagactctgcctcccaggtggggtttgagggttctgtgtacctggtgtaggcctaggctaaacagaagagcttctcgttagagcatctccctgtggactggctgcagagttacgatatcattctggttctgctgtgctccccactgccccttttcagctgactctttgctcataggaatacagtggtatgagatagggtcatagaatttggttccagtctaacactcttcctgtttcctgcccgcctgtatgtctctatccattagcagactcctttatgtatgatagagacacatgcacatatgcatacacggacagtccctgacttacagtgtttcatttagaatttttcaacttatgatttattgggagttagccccattgtacgtcaaggagcatctgcacatcgtatacatatataccatgaatacacataattatatgtcacactcctgctagagtggggggggtcaatatctgaagtgcttataatagctttattgggggggacctctaagaaaaacagaataattacttagaccttaaataataaatctataagaatgaagaaagccccaaagcccttccagcttccatcccgtcagtcacctctctgtcctatactctgccactaccccgagcctcatggctttcttctcacctgggctaccctgagtctcctccttggtctacagtctgacttgttcagtctcccatctgttctcaccagacacaggtgacatggtctctaaatgcagatctcaacatgtcatctctgtcccaaaaccctcgatggccctgtcctgagggtgtagtcagtgaggcttgttaggaaccctcggcacctttgttgtcctccacacagtgctcgtgtgggacatccctgctcccttccgcccaccccacccacatacattgtttcttaattaactcctcctgtcacttgaggccccattcagcactgcttcctctagacagcccggcttgatcctcagcgcgtttgggctgggactgcgactcctttgctgctgcttccacttgcttaggtcaccagcgtcccacttccgtgtttgagctcactggccgcctttcagttccccagcctgtgcattgcagctgttcactgcttcctcctccttgaagaaggaggttttgtctgagtgacggctccaggttctcctagctttgtttcttttaaattctcttttacagattctatctacctgcctccccaagttttcacacattctgaaatctctacgtccatccgagttctcactcttgagtttccagctaccttgggccctttctccctgggtgtctcacaccctgcttttctaaaactacactcagcacctgtttctgttctcccttccctcattgggttttatggcctcattcttgcagagtaagaagctagataccttggcgtgagttgtttctcctttcaccttggaagctttaggaatacctagcatccggctctcctgaccatccccagttaggaatgaccacttctctaccccagctcctcttttctcagtggcaggggcgccatcaacaccccactcttaccctcatttattccttcaataaatatgagcatctgctttgtgtaaggtcttagctaggtagaaagtaaatagagccttgtcctcgtagcgcttacctaagtgagagcatactggacgagagactggaggatggtggggccctttcttgaaatggagtatatgttggcggaaggaggaggcaagggttccttttggaacacactaaatttgagaaatctgaaaaatcaccgtcagtgttcccgctagtttctggaattgatgtatttgattctggcactaacatacctatttgagggtgtgggtcttggtatcagactgccctggtttaagtctaggctctgtttactaggtgtggatgactttggggaagttccttaactttaatccttagctgcttcatgggtaaaatggggaacataacagtgcttatttccttactgggtgatgtgaggagcacatgtggtgatattaatatttaggaagcgcagtgccttgtgcagatgcagagaaggcacctctcagctgttgttagttttcttattccattggactctcacctgcatgatccagaaccctttgtagttggtgagggctactttcccatgaccgctaaggtctccattcactctgcatttctacgtccccaccacgctgggatgctctgctggaaatgctcctgtctcacctcagtgccctggtgaaatccagcctcttggtggcttatccccaagaccagccttccaaattcctttgaactctgactcctgacccttactaaacccaaaagagagagaaaaaccagatttggggtgaattgctgtatgggccagggcatggagaatgagggggctccagaaagcttcccagggaagtagtaatggtctagctgggcctgcagggatgcaggaggctggtttcagagtggtgaggggtgtgcaggccaggacagccacaaggcacatcttcagcagccgtatttggaagcctcaatatcagtgaagtgggaggagagaggcttaggaacagcctgggtgtggacatcaggtgtttccctttgctctgcaggctgatttctctgtcttcctttgtcagtagcttctcttttctaaattctaagacacgctattgatgtggcggggagaacaagcccctatatgatagatgtgcacccaaatgtaagatatttcttgagatcagaaacattcgtggatatgagaacccaggacatgtggtggatctgggactgtcgtgtggtctgaatgatcttgtgagtcctaaggtgatgtcgaggcacctcccacctctgttgaaaccaactagacaagtcttttcctagccagagcctcttccctgaatgtctgtttaaagttgaacacttaccaggtgaggtgttgctttgagaagcatttgtgctccgggctggagtgcaatggtgcagtcatggctcactgcagtcttgacctcctgggctcaggtgatcctcctgtctcagcccctggagtagctgggactacaagtgtgcaccgtcacatctggctatttttttaatgtgtttttatttttattttttgagacagagtctctctctgttggccaggctggagtgcagtggtgccatcttggctcattgcaacctccgcctcccgggttcaagtgattcttgtgccttagcctcctacgtagctgggattataggcgcacaccaccacacccggctaatttttatatttttagtagagacggggtttcgccatgttggccaagctggtcttgaactcctgatctcaagtgatctgcctgcctcagcctcccagagtgctgggattacaggcatgagccactgcccagcctcattattttaatttttttatagagacaggatctcaccatgttaaccaagctagtttccaattcctgggctcaagagatcctccctcttcaacttcccaaagtgctggggttatagggcatgagccactgtgcctgccccatttgtgcattctgttgagagcacccgtagtcccatagtatgggccagcctaaggagatgcaagtcaccctttattagagtgaaacagtgaaggggatttcccctctaaaccattgaggtcaagctagagaatgaggcgctcagggagtgagatacagtatgccattttctcagaaccagacgaccaagtgctgaagaaaatgctcagctcagctgggacggcggtccctttgggcatctcctgaaaaacctactctggcctccctttctcctcctgtacttcttgcacacttagttcctaacttcgttatagctgcctgccagcaccctcctcacccttctccccgccctagattctgcacagaggctgtgtttgctcattgctgtattcccagggcaggggctgtactgtgaatgaggcggggaggtatgcatcctttcttaaagctgggtgggaggacagacgtggtggctcatgcctgtaatcccagcactttgggaagccgaggcaagtggatcacctgaggtcagaagttcgagaccagcctggccaacctggtggaaaccccatctctactaaaagtagaaaaattagcctggtgtggtggcacatgcctgtagtcccagctactgggaggctgaggcaggagaatcacttgaacctgggaggtggaggttgcagtgagcccactgcactccagtctgggcaacagagtgagactccgtctcaaaaacaacaacaacaacaacaaaaaaaaactgagtgggatgtgatatcacacagcattttagggcttgagcagaaggttggagctggtcactgggaaggtttatttggagagactgccaacctggtgctgtggggctgagtgtggtgatgggtatgtgtcagcccacagacactgagcctttccagtgtgcctgcactgttccaaacactctcttgtaataacttctggaatcctcacacaccattaaggtaggtgcagttctgttctatagataaggaaatggggcacagagaagttcaatgccatgccccaaggtcacaggttggggtttgcaggtgcctggattttattttcattttttatttatttatttatttttttgagatggagttttgctctcgttgtccagggtggagtgtaatggcatgatctcggctcctctgcctcccaggttcaagagattctcctgcctcagcctcccaagtagctggaattacaggcatccaccaccactccaggctaattttttgtattttctagtagagacggggtttcaccatattggccaggctagtctcaaactcctgacctcaggtgatccacccgccttggcctcccagagtgctgggattacaggtgtgagctactacacccggccgatgcctggatttcaatctcagttgcctggctcaagagatgtgccctaattgcagtgccagcctggctccacacaccatgcttaggagttaggccttgataaggagccagggaaagttgctgcggcaaatgtttcggaaagatggcctggcagtagggtagacgggcacccagggacaggagacccagcatgagcaggcatggtaatggtgcacaggaggatgacacggcacagcactggggatgcacagaagggtggatgtgagagcgttcctgtcgtttccgccacctggatccctctcacctgtgtctgttttgcaactccatctcgttatgctacttcagtacgttccatggtgtggtctctggaagcagcacctgggaacttgttagatacgtaaattggagggcctagcaggctgtgcttaacgagccctctgtgggggagcctgatacaggctcatgcttgagaagcactctcctaatctaagccactagcacccagcagtgggtggccacaagggtcttgtccttgctttggctctctctcaaccctcaggcttgcctgtgctcagggctttgtggctccattaaccatgcgtcgctgacgctgagtttaccgtggtcggcctcgcttctcagtgaagtccaagggcctcgcagcctctgcatctggtgatttctctgcctttcctcaaagcttctgcttggctgcctagtccacagcctcccgattcaccattcacctggtcccagcaacagaagtctcagctggacacacaacatgctttagagtgagtggctcttgtcttctcaactccggacggcgacagtgaaattgtgggaagaacctgaggctctgagctgtggcctcagaagctctgtcccttcccttctggttcctgaggagttggtgtggtcatgtgtggcagtcctgactcgcacctcctcccagcagttagcacggtaccttgccaaggtggcaggagccaggaagaagagtaggaggtggcataataattacaattgcaggctttgggatcaggaagtcctacatgcgacaagaatgcttacttcctaagatgaatataggattaaggatgtcattgcgtgaaatagtaagcaaataacctagggacaggaaggaccagtacattattgagctcagctttgtttcaatgatgtaagtggcagtatttatcaaattaatatctttgtttttcaggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacagtaagttttatcatctcttgaatttttaattttgtagggctaattaactaccttattccttgtagcacattagtgaaagtgagttccataatgtcacttctaagtaaccccacttcttgaaggagtatgtataggagctttctggtggttacatcagcttacttaccgacattgagctacattcgagtcataaagggcagagccctgaagacaaaaggctgagaaggaatagcttagggtttggtaatctcagaccttcacaacagttgtcagtgtcatagaaatactaaaactttttgctttttaaaattgtttgtagactgggcatggtggctcatgtgtaatctcaacacttggaggcgtgaaggtaaaaagattacttgagcctaggaccagccagggcaacataggccccatctctacaaacaaacaaaatgtagccaggcgtggtggggcgcacctgtagtcccagctacttgggaggctgaggcaggaagattccttgagcccaagagttcaaggctagctatgatcacaccactgcatttcggcaggatgactgagtgagactctataaagtatttgcaacccagttttctgttttcccgtctgttttgtttccctgtgacattcttggttcattcagtgtgagcatggtagtaataatccatagtgaaaagtttcttatattcactgaccaaagttgattcgtcattataattactgtttagcgcttttgtttgtttgtttttgaaacagggtctcgctctgtcacccagcctggagtgcagtggcccgacctcggctcactgcaacctccacgttctgggttcaagtgattcttgtgcctcagcctcccacatagctgcgattacaggcatgcacctccccgcccagctaattttgtatttttaatagagaccagtttttgccatgttggccaggctattttggtttgttttttgagatggagtctgttgcccaggttggagtacagtggtaccatctcggcttgctgcaacctccgcctcccaggttcaagcgactctcctgcctcagcctccggagtagcttggattacaggcacctaccaccacacccagctgattttgtatttttagtagagatgtgatttcaccatgttggccaggctggtctcaaactcctgacctcaagtgatcttggcctcccaaagtgctaggatgacaggcatgagccaccgcacccagccgtttttatttgtttttaagagacagggtctcactcagtctcccagtctggagtgcagtggtgtgatcatagctcactgcagtctccaactcctggagtcaagcaatcctttcacctcagcatcctgagtagttgggatcataggcatgcaccaccgcacctggccaatttttaagaaaaaattggccaggtgcggtggcttatgcctgtaatcccagcactttgggaggccgaggtgggcggatcacgaggtcaggagatcaagaccatcctggctaacacggtgaaaccccgtctctactaaaaatacaaaaaattagccaggcatagttggcgggcgcctgtagtcccagctactcaggaggctgaggcaggagaatggcatgaacctgggaggcggagcttgcagtgagctgagatcgtgccactgcagtccagcctgggggcagagcaagactccatctcaaaaaaaaaaaaaagaaaaatcatttttgtaggcatggagtcttactttattacccaggctgatcttgaactcctggcttcaagcagtcctcccacctaggctcccagagtgagcgacaatacccagactgtttagagcttttatcacatctgtgagacagctctggtttggtgtaattcaggtgtctcctggaaccccttgagctctcgaggagattacctgaaggtccccctgtcccagtttattctctactgacagagttctcactgcaagtttgttcaaatgatctaaactcaaaacatctgttgtctgagatcctgaattccttgtcagacagaccagatgtgaaatagcctgctgatttcttccagtgctccagaagtactgtgaatggtatgggaagatggatggtggggacaggtgagactgaacaaacagctgtcagagggaacagtgatggaaatgctggtcacaccctctgagccttttgggtcctcaccctcttctgttacttcctggccgccattgtgctccagggcccacttttgatggtgatacacaaaaaagcccacttctttgacctcccaccttggtgcttcacctgcaggttaccatgtagctcacctatggggaaataggtgctttaagccttaacccatctctgcttaggccagatcagaacaggcaaaacaatgtagccttttgtgcatgtgtgtgaagaaattggttaaaattcctgaaagttacggtgtggttatagcttatgtggttgtgataggatggtcagttttcaccaaaagctatggacctctgagggccctgctagtgaaaaggaagagaattatgaccagaattatgggagggccagagtggggagctctgcagatattcctggattgattgagcctgtcttgagtggtgcagggaagctacttgggaggaggaggctcagagacagcagagtgggagggtaaaggatgtcctcaggaaggaggtgacatttgagtgggttctggaaagctgtgcaagaattggccaagtaaagaaagggagggacaggcactccaggcagggaagaagctctggttaaaggcatggaggggtcgatagagcaggcagaaaagaggattcctgaggttagggaggggtggggacattcctgtaattatccgtgaggggagattttgggtccaggacccatggctgctttcttggctccctcagtggggcccagaaaccacacaggtagctgtgggacatggaggtctgcttagcagtgcctagtaagaaagacttggtctgctacaggctgggcatggtggatcacaaggtcaggagttcgagaccagcctggccaacatggtgaaaccccgtttccactaaaaatacaaaaaaattagctaagcacagtggcgggtgcctgtaatcccagctactcgggaggctgaggcaggagaatcgcttgaacctgggaggcagaagttgtggtgagccgagatcattccactgcactcctgcctgagcaacagagtgagactccgtcttaaaaaaaaaaaaaaaaaaaaaagacttggctacaagggaaggagcctatacgaggacaaaggacattgtcaaagagaatggggtaaatattttcatttatttattattattattttgagacagagtcttgctctgtcgcccaggctggagtgcagtggatgcaatattggctcactgcaacctctgctgcccgggttcaagcgattctcctgcctcagcctcccgagtagctgggactacaggtgcatgccaccacgcccagctactttttgtgttattagtagagacggggtttcagcatcttggccaggctggtcttgaactcctgacctcgtgatccacgagaatggggtaaatattaaagagtcctaagtgtttgaaatgcttgttttctggtgctgtaaagaaatagcatttgaacgtaaattcaattttttttagcaaggccatatttatactttctgcagaaagggtacactcaccagttgttttgccatgagaatacattgaataaaggagacagggttatttataacttgatgtgtttactctgctgctgtatccagtttttattggctggaacaggacctcacattctgtatttgtcccaattggctagcaacttagaacttttttttttttttttttttggagacagagtctcactctgtcgcccaggctggagtgcagtggcatgatctcggggtcactgcaagctccacctcccgggttcacaccattctcctgccgcagcctcccaagtagctgggactacaggtgcccgccaccacgcctggctaattttttttgtattttttagtagagatggggtttctacgtgttagccaggatggtctcgatcttctgaccttgtgatccgcccgcctcagcctcccaaagtgctgggattacaggcatgcgccaccacacctggccagaacttttgaaaagaggcaaaggcagaggagaataaaggaaggaggaagtaacttgtggaatgctgaaaaaggtaaaaataacctttaaataaggaagaggaacaggctatgatctaatgcttgcttggactaatataagcatgccaaggtaaatatttaggctaaattgtgggagctaagaatataaagtacattgatttctttattatggctagcagatatttaagaatgttagtacaggtctttgaataaattttgcttttaagagaagttactatttatttctaattagatggggaggaaagtctttgaagaggaacctctactttactttttacataagcaacctggtggctgctggggaaacccttaaaacactgggcagtagaactccactgaggttagtgtcagctcccttgaggccaagagcagctgctcacttgggagttttggctgctgtcgcttggcctctgggccctcctggggctggttctgtgctccttagtccgtgggaagttactagacccagcttcatttccaaaacatctcaagctgccatttgataagagtagcattggaacacagaatcaggcttatccctgttgcctagcgagggcttggctggatggtgggtgttcctggatcttgtatgaatctctcctgcaatatctggtcctttcagagtttcctgggacagattgaccctagtaaggctaaggaattgggatagtagtagcatcttccgtctctgcgcagtactttacatacatgatctcatttagaccttataacagctctgcaaggctggtactggtgaggaacttgagacttagtagtgcagtacttgtcccaggttgtccagtgcaaaggatagcaggacagggcacagggagaagagcacggaaacaccagtgggaatacaaggtgacaggctctgttgggaagctcttttttttttgggggggggtgagatggagatttactcttgttgcccaggctggagtgcaatggcacaatctcggctcaccgcatcctccacctcccaggttcaagtgattctcctgcctcagcctcccgagtagctgggattacaggcatgtgccaccacgcccagctaattttgtatttttagtagagacgggtttcaccgtgttgcccaggctgatcttgaactcctgacctctggtgatccgcctgcctctgcctcccaaagtgctgggattacaggcctgagccactgcgcctggccagctctgtctcttgattaaggtggaggatattctcagcttgtcttttgggaccaggcagaccagaaatgctggagcatattggcaaaccagcagcctaaggatttggaagaaaggctggtcagagtgtcagttgcttatcaaccagctgagagcctgaactttccggaagacatggctcttgggtagccactgggaacaggcttaaaacagctttggttctttgagttctttgtggggagtgattgtctggtgtgaatcacagttgatagtgccctgaaaggttcaaggccacatttcccaggggaagataagctttccacaatgtatagaaactcagaaaactccaagttctttatgctaagaaacaaaaagggctcagaaaggctgaacacaaagtcaaggaagagaaattgataacttttggttaaagggaagagtttccagccttttggccagggcatccactaccaagtccaaatcctgacttggcctcaagcttttgtaaagggatgcatcgtgtcccttttgacctgctgatagtttttttgagatggagtctcacactgtcacccgggctagagtacagtgacgcgatctcgcctcactgcaacctctgcctcccaggttcaagtgattctcctgcctcagcctctggagtagctgggattacaggtgcctgccaccacgcccagctaacttttgtattttcagtagtgatgaggcttcaccatgttggccaggctgaccttgaactcctcacctcatgattcgcccacctcagcctccgaaagtgctgggattacaggtgtgagccaccatgcccagccgacctgctgatagtttgataaaacagaagttttactttctggaatttctactcattttatgttttggatggtttctctctccgtaagcattcagtattcttgaatctcaagttttgaaaggagccctaacttcaagtctactcgctggcttcttaatgaagtgaaccatttctattgcccatttagttcttcctgaaaccctgacattctggtgttcatgtgactcttctttcccccttgctactcagagaaagcgtcgtggtggagcaataaattctagacaagctcagaagcgaactcgggaagcaacctccacccccgagatctccttggaagcagaacccatagaactcgtggaaactggtaagattgccagggacactacaactgtggggtgttaaagtggagagagaacactgtaccagggtgagctagtagaaggtgctttcagtgtctttagaaggcctatgcagtctcacactcaccatgtacaactcaaagcttcacagattctgaaatagcttctcaactgggctaactgttcaactctggtaatgtgcagcagtggggtaggatccatttaaaaaaaaatctagcgcaaatgagatagcccaccttttctatctgaaactgcatccccaattgctggaccttgtaaagtacttcgctttcctcttctgtttttcattaggacatgaaatcacccaagaaggcaaacttgtccacagagctccctgtgttggagcttggtataggcagaggccagattggatttccccttctgcctgctcaagaagtggttgatggctggcctaagtccctttgctctgcatatattgtttttataactaggatacctgcaaactggcattttatttttacttatttatttttgagatagagtcttgctctgtcgcccaagctagagtgtagtggtgcagtctcggctcactgcaagctccacatcctgggttcacgccattctcctgcctcagcctcccaagtagctgggactataggcacccgccaccacacccggctaattttttgtatttttaatagagacagggtttcaccatgttagccaggatggtctcgatctcctgaccttgtgatccacccgtctcggcctcccaaagtgctggtattacaggcgtgagccactgcacccggccatgcaaactcgcgttttaaacagaagaaacttagtgcaagataaatttcatgggccccccaggagaaatgaagttctctatatggtctctgagtttcacttctacaaatgagttcttgaaagccttgacttgaggctaggatcctggctctagaccaaaaaggaacgaactgctttccgtcatggcacttgtcatcctctaggcagtcttacccctgtgtgtacttagggctgcccattagagcactgttttgtttttgtttctgtttgaggcagagtttcgttctgtcagccaggttggagtgcaatcgcgtgatctcggctcactgcaacctctgcctcccaggtttaagcaagtctcctgcctcagcttcccaagtagctgggatcataggcgcccaccaccacacccggctaaattttttttgtatttttagtagagacggggtttcaccatgtcagtcaggctgatctcgaactcctgacctcagattatccacctgccttggcctcccaaagtgctgggattacaggcctgagccacccgcctggcctagagcactgtttttgtaagagcccagaattgtgttcaccagaaagagaatggttcaataaattgttgtatatcagtatatggactgttggacagcccttctttttaataaagaatgcaataattttatataaattatattgtatatgtaagattatcacggtttttattcttgtgaaactttatgatacaagaaaataaaacaggccagccagattgcttgagcccaggagtaccagaccagcctggacaacatagtgagaccctgtctctataaataaaaaaattagccaagtgtgggaggctgaggtaggaggatcacttgagcctggaacattgaggctgcagtgagccgtgatcgtgccactgcactctagcctgggcaacagcaagaccccacctaaaaaataaataaaagaagttacgttgggttgggcgccatggctggctcctataatcccagcactttgggaggccgaggcgtgcagatcacctgaggtcaggagttcaagaccagcctggccaacatggcgaaaccccatctctactaaaaatgcaaaaattagacgggcgtggtggcgggcgcctgtaatcccagctacttgggaggttgatgcaggagaatcacttgcacctgggaggcagaggttgcagtgagccgagatcgtgccactgcactcctgcctggacgacagagcgagactctgtctcaaaaaaaaaaagttaaatgcattacaagacactttccccaaatattagaccaatactgtttcttaaaaaacttcatttagtgttttgttgttgttgttgtttgtttgtttttgagatggagttttgctcttgttgcccaggctggggtgcagtggcgtgatctttgcatcccggggttcaagcaattctcctgcctcagcctcccgagtagctgggattacaggcatgtgccaccacacctcgctaattttgtatttttagtagaaacggagtttctccatgttggtcaggctggtctcgaactctcaacctcaggtgatccgcccacctcagcctcccaaagtgctgggattacaggtgtgaaccactgtgcctggcccattccgtgctttttaatattaatattaatagtaatcagaaataaaaatggttgtgcgtcattttttactttatataaatggaagttgtacgttaactgtttggtccatgtccttctcacctttatcctgtgcacatgtagacatcacagtataccctaagggctgaaaggcaagcttcacaacagatgcaacccattttgtatgttgaggttctagctatcagtatatatcactgttattctccatccaactagggagacaaacttgagagataaatggaaattaaaagtttgtccttggccgggcacggtggctcacgcctgtaatcccaacactttggaagactgaagtgggtggatcacaaggtcaggagttcaagaccagcctggccaagatggtgaaaccccatctctactaaaaatacaaacaaaattagccaggcatgctgccaggcgcctgtaatcccaactactcgggaggctgagacagagaattgcttgaacccaggaggcggaggttgcagtgagccaagatcgcaccactgcactccagccttggcgacagagcgagactctgtctcaaaaaaaaaaaaaaaaaaaaagaatttgccctagattaaccgatgaagttactaagctaagcctgacttttggtccttgggccaagtgagagtggtcagcttcacctgctgggaggagcagaggtttcaggctagtccatcccaaagagaaaggcctggggctgggcatgcatggtgcgttctcccagatggggcacagaggcatagccgtgtggaagtgggatgccgtggaatagaggtatgcacatgcgcacacatacataaccccccaggtacatttgtaaaaaccatacctccccactcagagcagaattctggaagggtggttactggctttccctcctgagggaggtgttggtcctggtgctctttgcagtgtatacttcaggattgttttagtttggggtaagcctataacattagcagtcatactaaagtgtagagggatacaaccttactttcctcttaatcttaatgcttgttgaaatactttcttttgaagctggagatgaaattgtggacctcacttgtgaatctttagagcctgtggtggttgatctgactcacaatgactctgttgtggtaagtgttggagtgtgagagtcggctgtttcttgggtatgggtccctggccagtgccagcatctgacagccttggtcacagactccaagtcaaggttacagcttatgctaaagaagttcatgcatcttgtggaattgagcttttagaaagaaaataaacagtaacaataataataacaaagaagttcatgcattcagtgacgagagcccaaaatgaaaaatgtttctggaaaatcatttgttatagccttgtcgcctatggagtaggtctgtgtaacctgaccttgccacacctgggcacaaaagtggtttggggagaatctcaagacccccacatctgtcttcagtccctgattccacagtttacaccagctgtgtgaccttgggcatgtgacttagcctcattcactttccatgaaatggggacaggtcactcatgtcagcagggcatggtgtaagacatcttacaacagatgccgtgtttgagtgcctgacacctagaatggtgcccagtcactgtgagtgtatgccctcccaactgaaaggaaagggaacgttggctcagcactgcccatgggaaatctctcaagttccaaaagtgcctgctacttagcatggcctcaggggatgcaggctccctgcattgccacctgatgcctgctgcgtcctgatgccagggaggctggagcccaggaggctgcctgtgtccctgtctcatggcaccggttacagactgcaggggacgtgtgtatacgtgtcctgcctgccaggagggaggccttgtctggtcagaggacacacggagaagctatttctgatagacctgtttcatggtgcatgcaggtctgggaatctggtcagcatcttaagggcaagtttgcctctggaagatgccacttgagtgttttctgacagtgtgctcggaacacaggtcggggtgggggcacacttggcagcattggcagtggggtggtaagtgctgctgaggaggactgtggggtgtgggggctgctagtagctgagtcttcgccttggccctgggctcactggtgttggggttatcctgtttggctgatgcctgggtatctgaatagggacaccccataggtgttgcttcttagttgtgctgagaacttcagaatagggttatactgagaagtttcaagacttcaatgcaaagaaaaggacagggatggaaaaccatctgagataagcagcagtgggtttagttgtacgtggtccctgcttaggtctcattaacgtgttttctgaggtacatacacacatatgactttgcttatcatccctgtgtcctgcatggagttctggaaagataactaatttggtatattagctggcagctacagcacagtcactgatttttcccctctttctttttcccagctgacaccttggtttcaccagttgctcattaaagctggaaagtggtgtctgcagaagtttttttgttttttgttttttgtttttcttgaatactcagtgttcaccacagtcttcttggccttctctctgccagaccctgaggagagagctaggattttgactgcaggaagacaatgattgattggcttttgttggctgacaaaccaacatcatttcccctttcacacttgtgttttcttttgctttagaaacagggtctcaggctgggcgcggtggctcacgcctgtaatctcagcactttgggaggccgaggtgggcggaccacaaggtcaggagtttgacatcagcctggccaacatggtgaaaccctgtctctactaaaaatacaaaaattatgcggacgcctgtagtcccagctattcaggaggctaaggcaggagaatcgcttgaacccaggaatcagaggttgcagtgagccgagatcacgtcactgcactccagcccgggcaacagagtgagactccatctcaaaaaaaaaaaaaaatacaaaaattagccaggtgtgatgatgcatacctgtaatcccagctactcgggaggctaaggcaggagaattacttgaacccaggaggcggaggttgcagtgagccaagatcgcgccactgcactcaagcctgggcgacagagcaagactctgtctcaaaaaaaaaaaaaaagaaaagaaaagaaacagggtctcactctgttgcccaggctagagagcagtggcatgatcacaccttactgcagcctccaacccctgagcttaagtgattctcccacattatcctcctgagtagctgagactacaggtgcatgccaccatacactactaaatttgggtcgggtggtggtggtgattttttaatatttttgtagagacagggtctcactgtgatgcccaggctggtcttgaactcctgggctcaagcagtcacccacctcagcctcccaaagcactaggattacaggtgtgagccaccacactggccagctttgttttgttttgatgactaagctgctcttgctaaaagggcttcctctctgaacttccctacctttcttctgtttccctgggctagggctccatgttggcagtcctactcccaattaacctggggctgtctggttaacctttataagatctgcagtcattgggagacccggggaccaggaatattggtgttgagggagctaccctggaaagtggatgggtggccagagggagagctgataggtaaaagggagacgctcctggcttgggaagcaggagtcctaggttctggtctctcagatctactggtcagtttgatcagtggatttatctcacactgtcctcagtgttgtcagccacaaaataactgctttggacttgatagctcttgctaatcattctctacttatttttgattttaataagtccaagtgccagtttatgaatttacactgagacatatacttgagtttggaattctgcctctgagcagatctgtttgggaggcctctaatgctagtcactgaggataaggggcatctgtagatggatcgtgtgttcagggtgaccctaggctgcacctgcaggagagtataaaatggataaatgtattcattctggaagcggggtaaccttccttaccagttccgccaggacctgtcgaatagtttgagtgcactgctttagctccagtagctctgtacctgtaatataggaatccctggataccaggatccagaggtagccgtcagaacatcagggaaccctctaaactttgtgcctgtggtcccagctactgggaaggctgagcaaggaggatcacttgaactcaggagttcaaggcaagcctgggcaacatagtgagaccctgtcttcttcaaaaaagaaaaaaagactggaaactttgcatacaggtgtgcacattcttccaactttcgaaggaattcaaagcccctgaaaaatgaagggaaatgaaaaatgcggtaagatgcagtgagagactttgttcatctcatttgattagtttccctcaaaatgaactttcatttttggcattgcatagcctagaaaaggcatcactgctgtgtcccgaggtgtgagtgtctttgatttttactggataaatgccagacttttctaaagagggagcagttcacattcatgccagtgtttgaggttctccacatcctcatggccacttttaattttagccattctgatgcttgtccagtggtgtctcattgtggttttaatttgtgcttttttattacaaatgggatcaaacaccttttcatgtttatttttctcttttgtgaagtgcctgtttaaaacttctttgttttatagcttttatttatttatttatttatttatttatttatttatttattttgagacagagtcttgcactgttacccaggctggagtgcagtggcgtgatcttggctcactgtaagctctgcctcctgggttcacgccattctcctgcctcagcctccagagtagctgggactacaggcagccgccaccatgcccggctcattttttgtatttttttttttttttttttttgagacagagtctcactctgtcacccaggctggagtgcagtggcacgatctcagttcactcagttcacctccgcctcccgggttcaagcaattctcctgcctcagcctattgagtagctgggactacaggcacgcaccaccatgccaggctaattttttatatttttagtagagatggggtttcaccatgttgcccaggctgttcttgaactcctgacctcaggtgatccactcgccttggcctcccaaagtgctgggattataagcatgagccgctgcacctggctgttacatagcttttttttatgcaactttcgtatataaacttttttcatcataaataggacttttcactttagtacctagctcatcccagtagcttttccagaactgctgtcttcaccacaaagctccctacgttttcccaatgcaaacctgagtgtttttagcattttaactttcctcacagagaagacatcgtggagcggataaatagatttgcaggcatttctgtgtcttctccagtgctgtctggaataattttctccaccacttctttcaagttatttgtctgcatctctctttttttttttttttgagatggagtctcgctctgttgcccaagctggagtacagtggtgcgatcttggctcactgccagctccgcctcctgggttcacaccattctcctgcctcagcctccagagtagctgggactacaggtgcccgccaccacacccggctaattttttgtatttttagtagagacggggtttcaccatgttagccaggatggtctcgatctcctgacctcgtgatccgcccgcctcggcctcccaaagtgctgggattataggtgtgagccaccgcgcccggccttgggtcatgatttccatcatcttagacctgttggtgctgaggttttctttaaccattggtagtctagacatcaacatgagcttcaatcatggtctgccttttttttttttttttttttttttttttttgagacggtttctcactgtcactcaggctagaatgcagtagcgtgatctcagctcactgcagcctctgcctcctgggtagctgggactataggcatgcaccaccacgcccagctaatttttgtattttttgtagagacaggattttgccatgttgtccaggctggtctcgaactcctgacctcaagtgatccacccgggtggtctgccatttttaaatcacacaacacattttgtcatgggtaagacccacgcatggaagctaggcagtttttgccctgaacatcttgaacagtcagcttgagttttctgcaagtcagcaagccttcaaacataacccttgaggccatcagatacagttttggttccttgagtcctataaactttttaaatcgttgaaaaaattgaactagaacaaagcaaaccatttgttgttttctttttcccccctgagacagagtctcgctctgtcgcccacgctggagtgcagtggcacagtcttggctcactgcaacctccatctccagggtgccagcgattcccatgtctcagcctcctgagtagctgggattacaggtacacaccaccacggccagctaatttttgtatttttaggagagacggttttgccatgttgaccaggctggtcttgaactcctggcctcaagtgatatacctgactcagcctcccaaagtgctaggattacagacgtgagccaccatgtccggcctccttggttgctttttaacagcaaataatcttttttttttttccaagttgtgtgctttctccaaatttgttttttttcttcttcttcttctttttttttcccttgaaacagggtctcactttgttacccaggctggagtgcagtggtgccatcacggctcactgcagcctgtaccttctgggctcaattgagcttcctgcctcagcctcctaagtagctgggactataggggtatgtcaccatccctggctgattttttatatttttttggagagacaaggtcttaccgtattgcccagggtggtctcaaactcctgggctcaagtgatcctcccaccttggtttcccaaagtgctgggattgtagttgtgagccactgagcctgaccttgggtcacttttcatgagcattttcagtatgccagtctctgctctggctagaagcaatgcagtggtagaaaagagactggcaactctctttaaggaatcgagattctttaaggggaaggttattgaaaatgttacttaggctgtttttcttaaatttccaaagattgtctcttagtaaggttgatttttctggaatctttttttggtctgtttctataatgtatgaataagtcacactatgtgtgttttattctgtatcctgcctggttttccatttatgagactctgtagaaaggatgcttgataaaggcttttctggaaggaaggaaggaagagggagggagggagggaaggagggagggacagaaccctgtagatctctgggtgtaaaggacacaggaggcacactgttggaataagtgagccagcccaattccatagaaagaaagaagagctcagaaaagcccaaacatcatatccaggaattagccaagatgggttggctactcaactacaatgtgattgtccgcaccagtcttcccgactttcctgccagtgccgcaagtaacaggcatcagtaactgcatgatgtgtgtagctgttggacattgagtagccttttgtgtgcacagtgcttggagatggctgtttttccagtggagcaatgtgcagtgctgtgagctgtaaagttgtctaaagcaagtgtgtcttggtgcccttggctgggtgaacattcctagaaatgccaggggccagcctgagtgcacgggacccagtgattcctatacttgcttctttcatgcagaggtgttctgaggctcacctgtgcttttagaagcacaaaggggcttcgagtgaccaatcagatgtgcctgctgcaggtccactcgtctctaaatgctctgacctatggactgttgtccatagttgagaagaagctagagtaaaataaaatgtatgagtgagtgaatctttttctttttttttttcttttctctttttgagacagggtgttgctctgttgcccaggctggaaggcaggggcccgagctcagctcactgtagcctcaacctcccaggttgaagagatcctcctgcctcagccccaggagtactgggactacaggtacacactgccatgcccagcttattctttgtattgacgggatctcgccgtgttgcccaggatggtctcgacctcctgagctcaagtgattcatcccgccttggcctcccagggtgctgggattgcagatatgggacaccatgcccagccgaggaagtgtgaatttctgatcttgggctagcttaccacagtactaattaaactattcagttcaggggattagttaattgttgttatttcagttttggtttttcacttatcttaaaagcctctcaaatagattagaggccccagagcttgtgttacacctctatccatctctcaactcatctggtaggcatttatgaagcgctggtactcttccctctgcacctatcttctgtgctgggcaagtactgtgccacctgcagggccatagctgtgatttaggttcattacagagttcttgagatgtctgcagggattctggaatttgatgtgactcggccactgggtggagggaacaccagtaatcaatactgtattgtccaccagctgagaggccaggctgtggtcgttggttttgtttttttgtttgtttggtttttgttttgttttgttttgttttttgtttttgttttgttttgtttttgagacggaatttcactcttgttgcccaggctggagtgcagtggtgcaatctcggctcaccacaacctccacctcccaggttcaagtgagtctcctgcctcagcctcctgagtagctgggattacagacatgagccaccacatgcccggctaattttgtgtttttagtagaggcggggtttctccatgttggtcaggctggtctcaaactcccgacctcgggtgatctgcccgcctctgcctcccagagtgctgggattacaggcatgatccactgccccaggcctttttttttttttttttttttttttaattaaagacagtttcactattgtcgcctaggctggagtacaatggatctcagctcactgcagcctccacctcccgggctcaagtgattctcctgcctcagcatcccaagtagctgggattacaggtgcccaccaccacacccggctaatttttgtagttttagtagagacagggtttcaccatgttggccaggctggtctcaaactcccgacctcaggttttctgcccgcctctgcctcccaaaatgctgggattgcaggcatgagccaccgggcctgtgcttttctttttttctttttgagacagtttcgctattgttgtctaggctggagtgcaatggcgtgacctcggctcactgccccctccacctcctgggttcaagtgattctcctgcttcagcctcccaagtagttgggactacagccacgcgccaccacacccagctaatttttgtagttttagtagagacagggtttcaccatgttggtcaggctggtctcgaactcctgacctcgagtgatccgcccatctcggcctcccaaagtgctgagattccaggtgtgagccaccgcgcccagcctgtggtgttgttcttatactgaagactcatctggaagctgtttttctctcattaaaagcggggacagtcagaattgttaccagtgaggaaacactctggcgaccctgttcttatgcaccccagtagttgtgtgtgtatcacctgctgcttgccagcagcccctgggctcagtgctcaggacaggcctcagtttggtaccatccacaggcaagctgggtatgactcacaagagaccataaagactcagtacgcgcactgtcatggctggggcactgggagtgtcataccctttccaggtgtccacacctaattagtgggtcatcttggcagagggtgggggcatgttggagctgtagaaagctggggtcatttctagccacagaagaatttgcttttgctcccagctaaacccaaggctttccccaagggccagcactgttaccagagcctccttttctagatttcatgcggacagtacattgtgccggccctggtaagtttggtcctgatggtgaggttgactgattgtccccagatttcccttttcaccgtctgcagtctcctctaagaggaaaggggagcacgtttcagtggctccacgtatgtggattatattctcatcctcaaatcaaagacctttatactcagtcctgcattcttcctgcatggccgtttgtgtatgtcaggatgccatttgggaaacaaaatccactctaattattcctaagcttagtggattttaacatggaaggagaagcctaaatcagcagtgtctgggctgggtctccaggaataactcttgacctcgaagcattgacccacctagggagctgctgtgtctgctccatgaagaaggtctggaggcggcatccaccccctgcactcatatctttgggttcgtgtagacagtactgcagaccctttctagggaggagaggcctgggctcaagacatagcagcctctgccagaagtgtttcttcaggatgcagctgtgcctgccagtgccaacaccctcagcagctcaaatcggcctccatcccctgccctgccagtagcatgagtgtgtctgtttgagggaactcggttcacgtctaggatcctggctgcacgggagtcagagtagaggattagagcttcttgtcactgtagggcaggatgtcctgcccaggggacaggcagggtgaggtgagcagtagggctttggtggtgagaactttcctgaaacagcccctcctacgtgctcagcaagagggaaagggcgttccactggcccccctagatgggtaagagcacttggccagaaggtgggaggaaccacgtttgaaactgttggagcagaaattgtctagatgtaagttctgagctggcaggtgagaggcttgtcaggttcttaggcccccaggacagagaattggattgtgttcaatccttggtgtgtgtcacacgcattggtcatgcatagcctgcttttctctgttagttacttgtaacaacctactgagcaatgcaaatcctcctccacatgaaggctccaccttggcagtggcctacattggtcgcgtcagcttgagagagcatcatgcccctagtgctgtctaaatgttcactgcctcacgtaaccctcacaacagcacagtcagatgtgggctctggtgactctgcttcagaagagaaagctgcagcccccagatagtaagtaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggctgtgttcacgctccaggagactccactaaacacccagcagggagagacacagcacatcagctgggaggtggagtgacttgggaagtgggcttgactgactgggagaggtgcacagatcctctgtgggtgggaggagggtggggcctctgctgctcaccagagggttccacagagggtgtcacacgtcagaaaaaagaaatggcttcgtttatcacttatatcaaactgattgcttctttctcttttgtttttctccttctgtttacaagattgttgacggtgagtggtttcgtttcctttttcactgggtttggagaggaaactggcataggtgagagccgcggtgctgcaggtcttgccagaccatccccaagggcttggagcgctccaagcaggaagatgccttcgcagatgctgtggtcagacccacacagccagtcccccttgtgcctgctgaagaaacttcaccactatcattgagcactgagctatagtcctttcttgtggcctaccagattttggagaaggctggtagctcacagcaggggttggggggtttctcctgggaagataagatagtggcctccagagctgggcagaaccttctgggttatagctgagcatggcagcagtttgtctctgggggtcccaggcagggaaggaagagggtcttaagaggcgtcaggatgggagtggtgaggatggtaagagtagagagcctccaacctgaaaatgtgacctcttaccttagaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggtaccaacgtgcccccagctctgctgccgccatgctaggatgtggggccagggcatgggaatacttttcagcaaatctgtgagcccttggccctggaagggcttgcccaagcctctacccagcatctggatacagttggaactgggtccagaactgagtccagctattcccactgtaaccagaggatgccaagcgctgacacagtgtgtgcagacagtcccagtggccccagacagggatcctggggctggtaggggcctgggggagggcagggtgactcaggttgtgtgcaccttctcatgttcaccctcccacatgcccttggggcagttggctttcctgaaagtctctcggatgcccgcgctaaggcagagtcaggaggccagggacgggactcttgtaggggataggggccactcacgtgacagggtataataaaatgtttgcgttgactgagaaactaacgtgaagcactgtgctcttaggccctcaggtactgtcagttgtcccatctgcatggacggatactcagaggtaagtaaaccaagctgtatcttccaggcttctggtttctaaacttcactgaaagaattggatgagacaggatcttccccctcggtgggattggacacccctactcacagtcatgcctgggccgtcacttattgcagatctgcctgtgaggggagaatgtgccagtttctccttggaccctacaactttcaccttcagcccctatactcctgtatgccctgagcttccgggtgcaaatgcgtcctccttttttgtgccccatcctggctctaactgaaagctgctagtgtttactggggtccctcataaccctcttgggctgtcacactgttgagatgccatggcccctgcctcctgctctccagctgagagagaccacagcagacacagttagctctccagacccctccctgttgtagcctggcccttgctttcctttaattagtcatcttaggcataggtgggtgggattctctggccccatggctgctctgggacaagggcaaactcggaggctcttctttttaatgccttctagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctggggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaagaaatgtctttccttttttcaatgtacatagttcaactctttctttgttacatttaaactatatccatggatatcagtctgctttggactcctctgctagtgttacagatggaaataaaaccattaatttgaaccaaata

SEQ ID NO: 2579 - DNA, 46793 bp, Homo sapiens; identical to SEQ ID NO: 2577

SEQ ID NO: 2580 - DNA, 162111 bp, Homo sapiens
tttatcttttaaaaatacactttaatctaaccatggaatttcacaaacatttatatacaatcagagactaatttgaagtatgttttccattcatttcagccatgagaaaacacattgcagtaaaaattaaagatacccatccataaattacttttatttctcattaaatgagcacagagtcattagtatattaataacagatatgtttattattacatatccatcagtgcggctttcaataccacttgaaacatgcatatcatcctagagacgatcggttttccagtgcttcttatctgatacacattactgcaaagccattataaattactgaggaggtatttggttaaaaaaataaacaataaatcatactgtccatatgaatcaactcttgttactggacaagagtttaacagtatttatctggtaattcctatgttaactggaaaacatcatggatgtattgccatatttcctttttatgttggtgcaaccttctacattttttgcagttttataaagtcattattgtagcaggtagtttgatgcaaagattgtactcaatttatgaaagtccaacaaacctctaaatattttaaattaaaccaattatcaatgaaaaactcactgacacacataattttttgaaaatacattttttgaaatttctatacttactcatggcagtaaaataattatctcaaattaaggcactaaaaggacaatgcaacccccattgaaagtgttctaagaataatttacatttcaaacagtgcatacatttcttatatgtttgttaacttaatgtctttatcatttaaaaccacaaagaaatacattatacaattatagaaatgatgtaccccacaaaatgcttttaaacttggttcttttgtacagttagtttcctaatgtctctagtagtaaaataactcaatatggcttggcaaaaatgcatagattaaatgtaacttttttttgtcctctcccattccccaaacttgctgaaacatatacagtattttgtaaagcataatgaaagatatttaatttctccatcaagtccaacatgggcaatcaacagtaaggcttttaaattctacagtgagggcactgaagttcaagtgatatcactgctttcttaaaatagttttgtatagtcttgcaagagcacaaaaacttaagtcattaaaaaaaaaacaaaacttcagtttgtctcattttgagatattttctttactccttccatgagctgatcttgatagtgatggctgttccacttgaaagtgaaagtcccttcctcttactcatatgaggaaaactctgttctatcacgactgacaggcattttcttataaatccaaaaaggcagcaccttttaaaaaaaatatatctacctaagctttcccccaactgtacttgcattacatagtaataattaatctaatctacctgtaggcaaacccgcaataaaaaaaaccctcagtgtgttgtgccaaagcaaggacagaaaaacagcaatcttaaccctgaagcctgtgatatttgtgtcaaagaaacagcctgtctgctctgcatggttaaagaagcctggtttatcaggtagcatcccacacgattccacagggcactcagtcacatggttaactgttgagggagggggaaaaaactaatttaagaaatgcactcagtttaaaaatacaagaaacaaacattaggaggaaaggtaaatatacattatctttacataaaataattaacaattacacaaaatttggaaaacaaggaataggaaaaatatacttagtattctctcctctttgtttctacacattttcttactcagctataatctcatttcaaatcattttagatccagtttacaacctatgctcaggagaaggctgacatagcattctacagaattaagttagcagtaaggtgataatacctggcatagtatggtggctgagaaaggaaaggatataagtcatttcaaagaattaggcctggttactgacaatagggcatgaacaaaagggatgaattcaagatggctttaagcctgcttggaagatgtaggtgacattggcagcgaggcaaatcagtgttaggtctcagcttctaattcgagtggccctattaatctagggagtacactctagggaaggtggtatgtggtagaatagaggctttggaattggacaacataggctttagaattggacagaaatggtttccaatccattggctgtgtgattgagcaaactgcttaatttctctgagccttatttactaatgtgtaaaatgagaacttaatgagatgagatttcattatttctctccaagaaagagttaactgcctggtgcggtggctcatgcctgtaatcgcagcactttgggaggcccaggaaggtgcatcacctgaggtcaggagttcaagaccagcctggccaacatgttaaactccatctctactaaaaatacaaaaattagcaggccgtggtggcatgtgcctgtaattccagctactcaggaggctgaggtgggagaatagcttgaacctgggaggcagaggttgcagtgagctgagattgcgccactgcactctggcctgggtgacagagcgagactctgtctcaaaatgaatgaatgaatgaatgaatgaatgaatgaatgaatggttatgccttataattgtttatcatggcataaaacatatttttggaaaaaagtccatcaaaaatagttaaacagccaggcatggtggctcacgcctgtaatcccagcactttgggaggctggggcatgcagatcatttgaggtcaggagtttgagatcagcctggccaacatgatgaaaccctctctctactaaaaatacaaaaattagccaggcgtggcatgcgtctgtaatccccgctacttgggaggctgaggctggagaattgcttgaacttgggaggtggaggttgcagtgagctgagatagcgccaccactgcactccagcctgggtgacagagtgagactctgtctcaaaaaacaaaaaaaaaaagggggtcatgagttcacatcctttgaagggacatggatgaagctggaaaccatcattctcagcaaactaacacaggaatagaaaaccaaacaccacaggttctcactcgtaagtgggagttgaacaatgagaaaacatggacacagggaggggaacgtcacgcaccagggcctgtcgagggatggggggctagggcagggatagcattaggagaaatacctaatgtagatgatgggttgatgggtgcagcaaaccaccatggcacgtgtatacccatgtaacaaacctgcatgttctgcacatatatcccagaacttaaagtataataattaaaaaaacatagtcactgataataccaaataattttgtatgttgggatagtatgggaagttaacaaaaaagggaaaaacaattttggtttttgtagaaaaactatgccaacacagttaaaaaacagaaaagatgatgaaaagttttatatgaatttctgcattaaaaaaattaagttggttaaagcattaagggctaaaactatgccatgtacagcaacttatgacaataaaattagacacagaactaaataaatataatattgcatgtattattattattaaactctaacaagaataagttaaactaatttataaagtcactgcaattcacatacaaatacctaaaaatgatgccctctgtggtgaaaagcacaattagatttctgattttaatagctgttatccaatcattttcacattgttaaaaacgttagcatttcaaatccttacctagtttttccagatgtatttttgaccactttccggaaagactgatttgcagtggatcttgtagaaagcgttcgaggggaagcacgaacaaaaccagatggtggattcttagggattttctttactaaatgagttacccattttttttgttcatcctgagaacatgctaacagcagcatatctcttgctgatgttacatcataacttactatgttaaggaggaaaaaaaaagcataattaaagccatatagttttttaaaatccaacctatcaaatgcatagtttttcaagttcttaaggttttaaaagttttaatatgcttaattaagcatgaacaatatctcattctccttaagttaaataaggctgaaattaaaaaaaaaaattagtcaaactaataaagtaaaatcagaaatataacaaaatgtaaaacaaataaatgtatttaaagaacataagcttcttatctgaaaatagctatggtctgtattctttccctcaagctacctctgtaaaactagaagatattctgtgatacagcatgcatgctgatccaggcagtgaatgccagacaaaaagaagaggaaaaactcaagggaggaatagagtggaactcacctgttgctcttctctccaacttggaataatttcttagcagcatgtttgtttgtttttgtttgtttacaagggggtgattctctttaaaaacactgttggccgggcgtgcaatggctcacacctgtaatcccagcactttgggaggccgaggtgggtggatcacctgatgtcaggagttcgaaaccagcctggacaacatggtgaaactccatctctactaaaaatacaaaattagccgggtgtggtggcacacgcctatagtcccagctactcaggaggctgagataggagaatcacttgaacctgggaggcagaggctgcagtgagctgagatcacgccactgcactccagcctgggcgagacagagtgagaatccatctcaatcaatcagtcaatcaataaaaataaataaaaacatttttaaaagctaaatctgtaaatagctgcatattgccccaccagtgtcaaaataatactttctataatctcttttcaacttggtatagaaatcactacacataagttagttcattgagacttaaaattaaatttgttataagttgtaacaataattaccatgccttacctttacatggacaaattaagtcctctttcttatctaagtgatctctgtggcacttaacatggcatcttcgacactctagggcagggggtggcttaaaaacatgccagagaggtttggcacaggcatcacaattggcaggaaagtggtagagtgtaggaataaactcatggcctttgtgattttggaaattagttttttcagcttgttgtactggttccatctctacatcttttctacattcaccttcatttgcatatagtatctacattcaggaatggtgaaaggaaaagattttaaaaatcttaagcattggtatattttacatttacttcacaaaaacgcttaggacttagattctttaaaattataacttcagatttttacctggaatattttaggaatttcttcagtttcagctctatacacatctccttgggttacaggtctaacgtgaaacagtttactaaaatgaaaataaatacaggccatttacaaaaactcatttattgtaaaagacatttcactaaagaggacatatgggtgataaataagcacacaaaaagatattcaacatcatcagtcattagagaaatgcaaattaaaaccacaataagtgtcactacacatctatcagagttaaaaaaaataaaaacagtagtaacatcaaatgcttgtgagaatgcagagaaagtaaatcactcatatactgctgatggaaacataaaattacacagccactctggaaaaagaatatggcaatttcttagaaaactaaacatatgcttaccatataacccagcaaattgcactgttgggcctttaatttcaagaaacaaaaattcatataacattttatatctatttaaaaaaacctgcacatagatgttcataggagctttattcataataaccaaaacctagaaacaacccaaataaatgggtaagcaaactgtgatacatctatactatggaatactactcaacaagaaaaaaacaaattatacttggattgatcttaagggaattatactgaatgggaaaaaaagctgatcagaaaagattacacattatttgattccattcatataacactcttgaagagacaaaattatggagatggagaacagattaatgttgctatggattagggagaggtggaggaaggaagctgccttttgactacaaaaggagtagcacagggacacttgtgatggaattgttctgtattttgagtgtggtggtggtcatacaaatctatacacgtgagaaaggcatacagattggaaagaaaggagtaaaactctttatttggcgatgacatgattgtatgcagttgtctcgtggtatctgtggcagattggtcccaggacccaggaggattttgaagagagagagtgaaagagaaagagagagaaagagagggaaggagggaagagacaggaaaaaaagaaaagataagaaatggtgtagtatttgtatataacctaagtacaccttcctgtatatttaaaattgtctctagataatatctaatataatgtaaatgctatggaaattgttattatattatattgtttagagaaaaacaaaactgtacatattaagtacagacacaaccacaataggcctaactacattttcaatccatgtttggatgaatatacagatgcagaacccatggatacagagggctgactgtgtgtagaaaagctctgtggaattgatcccaaaaccccacaaccctataaaactgttaagtgcaaagcaagattaaatgattcaaggtcaacatataaaaacaaatactgttggaacaaccagatacctatgtggggggaaaaaagccaacctgacctaaacatccacctcttaccaaacacagaccacaaaaggcagaaaacattttaaaaattggtacactgatcctcattaaaagacaccattaacaaaatcaacaggtaagcaacagattgggaaatatttgcattacatatttctaacataggattcttattcagaatatatctagaactcttaaaaaccaatcttaaaaacataagcaacccaatttaaaaacgggcaaaagacttgaaaaaagaaaagatatacaatggctaataacgacatgaaagattcttggtattattagttatgaggagaatgcaaattaaaataacaatgaaataacatttaacatccactagaaaagctaaaatcaaaggttgatatcaccaaatgttggtgaggatgtggagcaactgaaactcatactgttggtgaatataaaatagtgtgacataataatttttgagaattgtttggtagatttttaaaaagttaaacacagatctactttataacccaggattccaatcctgggtatttacccatgagaaatgaaaacataagttaaaaaaaggaatgctcataagtcttatttacgatagccccaaattggaagcaacccaaatgtcaatcaacacaaaaatggataaacaaattcatgcaatgttatactattcagcaatacaaagaacaatcaatacagacaccaccacaggtgcaggctgagtgaaagatgctaggcacaaaagtgtacattactgtttaattccatttatataaagttctagaacaggcaaaactaatcttggcaatagaaatcagatcatgggaagaggcacaagtgagctttcctttttctttttttttttttgagatggagtctcgctctgtcacccgggctgcagtgcagtggcgcaatcttggctcaccgcaacctcagcctcctgggttcaagcgattctcctgcctcagcctcccgagtagctgggattacaggcacctgccaccacgcccagctaattttttgtatttttagtagagacagggtttcaccatgttggccagactggtctcgaatgaactcctgacctcgtgatcctcccacctcagccttccaaagtgctgggattacaggtgtgagccaccacaactggcccaagtgagctttcttcataaattaaaaaaaaaaaaaaaaattcttttttcagagacagggtctcgctatgttgcccaggctggtctcaaattgaactcaggccaaccgcccaccttggtctcccaaagtgctgggattagaggcataaccactgtgcccagccacaagtgagttttctaaagaaatacgatttttttaaatcttgtattgagtgattatatgaatgtttacaactgtaaaaagttactgaagagaacacttaagatctatgaactttattgtgggaaattataccttaataaagagaggaaagaaatctctcatcaatctaaaaagtatttaacttagttgaaagatagtatctttcatactagtgtttatgtattatttcgcttaagctgataatttaaattttgacaactaaagctgtttattaaaaaaacagaaaataaagaaagagtattctctagaacttgcttaattcttttcacattctaactataaccagctccacaaatacttaattccaaagggatgataatactttattttatatatatatttcttttaaaaagcagttaccagacttgactttgaatatatattttgttgaatatgttttgccttttctcctgctagtcggtaaggtccttaatgatggaatttactcatctttatacatactacataatctatgataatataagcagcaataattaagaaaagattttagaatgaatataagaaaaaatactatattataggcctctttgacctatcattacaaaagaacagatatatttatatttccccttaataatgaccaaagaatcctacacagttgttcttttatatccacagggaactgattccaggaactccaaaaatatcaaagtccaagtatgctcaaggctcttatataaaatggtgtggtatttgcatataacctaggcacatcctcctgtatgctttaaaatcatctctgtattactcataagacataatacagtataaatgcgatgtaaacagttgttatactgtattttttaaagaaatttctattattaatagttataaaatatatatattatatatataaatatatatatttatttatatatatatattttatatattttatatatatattatataaaaaataatatatatattttatataatatatataatatatatattttataaaaaataatatatatattttatataatatatataatatatatattttatataatatataatatatatattatattttatattatataatatatatattttatataatatatatattatatatatattatataatatatatattatatatattatataaaatatatatattatatattatataatatatataatattatatataatatatataatacatataatatatatattttttttttgagacagagtttcgctcttgtggcccaggctggagtgcagtggcgcaatctaggctcactgcaacctctgcctcccaggttcaagtgattctcctgcctcagccttctgagtagctgggactacaggcgcctgccaccacgcccagctaatttttggatttttagtagagatggggtttcaccatgttggtcaggctggtcttgaattcctgacctcaggtgatccacctgcctcgacctcccaaagtgctggggttacaggtgtgagtcaccgcacccggccctctttcaaatattttctatccacagttgtggatatggaacccactgatacacagctgactatactttttgaaatgctctctgaactcaaactactaaacacttgaactaaaaaagttgtcttccaaatacatgaaataagtatatacatttttccttctcacattttgctgaagatttaatataatgtcaacatttatgcttaagaaaaacagaaaagtaggtaacagtgctgaagtaacacaaaatataaaataaattttaagtctaaaaataattatcaaaagttagctctcaacccctttaaaattcaatcaaaggcaacttactctatgtccaataccatagatggattggattgctccttatcttgttcgtcattatagaacaaaatttttttgctgcttaccacaacatactgaaataagaaaaaggggggaagagttacaagagcaacattaacttggtttaaagtgataagcataatatttgccactaatatctagattatactgtattaatgtaaaataaatgctagtaaaaaaaagtagctaatataagttctatgctccaaagtaaaatatagaacaaaataccagttagaaaataattaggtatatggtacctgtttcttccagccatatcgtttgatatttcctctatttggtactgaaagccaaccttcaattcttgactctaggagaaaaagaatatatgtattagtcagtcttaaattgtaacaaaagaaaaactattaaaagttgtctgacagcatgcagcaacaagcaattgaacacaactaaatgaataagtgctataatttgctcttccatgcttcaatcacacaaatcaactttaatggccatacaaatattgcagaaaaaaattccaagccacttttcccatacaatttaacatttagtaatcaattacaaaagtatgaagtaacaatacccttaagagccaggcaagactggaatggattgcagcttaaatgggatatgatgtagaagactttatcatttaacattcatataaaaataatcagcaaaaaaaaagaaagaaaaaaataatgcagcaagtggaacaaatcagagccatgatttacacaagaaagagcaagcaaaagtatagaagtgtcctattactcacagaagacaagaatagaagataaataaataaggaatgcaggcagaatcaactagatataaagaataagagacaagtattttatttgttttctcagtacaatattctgattaagctttttggtaaaacaacttcaatttgaatttgtaactatttcaataaaattgcccaaatttggttgaggggagcacttaactctagtgctaagttcaattgcaattctactcaaactaaagagttttaaagcctcttaagtttctgatatcacaatttgatcaacagtaaaaacaacacagaatccatttggtctactgccattatttcaactagtacgtgcataccaggaattccttgactatttgatcaaggcattttataataattattactattgtttaaatataactaatgtctactagaaatatctgggggataaagacaactccattagaaatagttattttagatcaggttggaaataagaaaatccattcaatttaactattttccgtatctaccttatatttgaaacacaaaagaatagaaaaataaccaatttcaaagtatgacactaaaatatgagattatactatcattcaaatggtaatcctaaggcaatatattgtccgccttcatataatttaaaagctataaactcagtcttacagtaacagttaacaataggtaacatttactgatttatttattcataaatttactatttgccacatgctttataatatctcatatttaacctatgtataagtccatgaatacaggatattatattccgaggaattcggaaaaggttctactgtcatctttcacttacaaaagaagagactaaggcttagcagggtaaacggacttgggcaaggcaactctatcagtatctatcaaagctctatggtttcaaaccccggcagtctaatttctgagcttatgtttctagagcacaacactattctgttcgcaaacaagctctgcagttgactgaattgtgggaaatatttttttcccctactcccaccaggtacgtaatgtctccacacctttgcttgtgttattcctcttcatataaattgttaaaatggaggaaatggtgaggtaactttagttcaaaatgatccctctcttctcccaacatttttctttttcctttttttttttttttttttttgacatgaagtcttgttacgttgtccaggctggcctcaaactcctgagcctcagcttcctaagcagtggcatgtaccacagcacctggctttaattgctgcaatttagttcatgaagtaattattttgttgcttaggtagttccttggtaagttttgtgagagcaaggaccatatcttaacacttgattttatatatcccatggcaaatgacacaacgaggtggtacttgacagatatttgttgattattttgtaattctgcatttttctgaattagccaattaaagtcatcctttgtaaatagtggttccagtttaaaaaccaaacaggcagttttatactaaatagcatgcagaagactgttgatcacatattgatcattcaccaatattttatcttataaaagcaaaaaagttattgccagaaattttcccattagtgtggtagaaattgcagctctggttttaaagtgtagtttggaaaacattaagatgaacattagtgagaatgaaaaggagtcttaatatctgataatacaaagttgtttagtattagtaattcctcaccaaaaacaaagatataaaagcctttgaattcttgacatttacacaaaatttgtatgccaaaataccctatactttcacattatttctttgtgacaatcaatgtcaaaaatatttatgctttctggctctagatgtgggttaacctgccagttttaatatatcttcaataagttgttatatggtatggctttatctgtcatttcagtgttccttagaaattttatatatcaagggaatcttatgagtcaaataagccagaattctacatttgctcatatttaaattaaatgaagagggtcagggagaaaataaattaaatgaagaaatctggaatgcaaataaaggtgtcaagaatatgtgaaggtttttgccaatttacaacaatgtcatgggagaaaattttagtttttccatctggtgaattccctcagagaagcaactgaactaagctcaataataacagataaaaaaatacatactagcttctcctgcgtttcctttccttacgcctaccatagttgcaagataatatacttaccagtttttaaaatatataaagacctcctctaaaatcgggaccacctgtaacttaagtggtgatctggaggtataacgctgtaaattccatcttttatatcacaagcacagaaaacagcttctccagataactaaatgaaactcccactgagagaacctctaagtctggattatccttaataatattctacatatgtacaaaaacaacttggctctaaattttatacaatatatttgtagaacaattttaacttataagaagttagatgtatattactgcaatatcagcgatttctttacccaaataagagacaatctaactacatgtacatcaatactcgatatagccaattcaaacatcagagctaacctctgaagactacctaatttatttagctataccacaaacatactgcttaagaaacagggctaaagaaccatttcaaaacactttaattaaattcaaaagtgatataaaaaagaaaattaattaatactcaacaagtcagatacaccaacttcaaatcactagatttgggcaaggtcagaaacattcatatattcaaatattgggaaacacaccaagagatccaccattttcaggtttaagttacataacctaaggtcaagctggatggaaaagggtatgatacaaataatccataagagataatgaatattactggagtatcaataccaagttttcctaatccatcatctatttctacattctcttcagatgtctaggttaacagttccaaaagaaggaaagagaaagaatgaggaaaagaaacagttatcacattaaagttttttgtcatctaggcaacaggcacccataaccgtaagggtaatctttatgtttgtattgtgtgctaggtcacaacctgctacagaaccaaagagaagataaagacataaaagaattaagagaatgaaggtgacttcaagaacttcaaagagttataagtcagagaaggagtaacattttttaaataaagtttttagaattgggaattttagaagggagatttaatatttaagctagttaataacaaaatggccactaaggattcatagaggctgcgttctagatgtgcaagataattaaattataatctttatactgaatgatgaaatataagagaaataataaaagttgcagtgtcagtttatccatccaactacttaaaaaaaaactgaaaaatgtgacccatatttcaaaaagccatcattttaacttggagtaaacttaatctattcaaagccctctcctttttagtacgtatattcatttacttattttctaaactgaagtaaaaattaatcattagccattaccttcaagaaattttttagacacttgaatgatatgtaactatctaatattaagaatgaatatcaacattctttaacaattcttcctagatatgaatgcaaaaccttaactttatttgccagggaccatttttgagcatctagtaaatggtggatttaatacagattttcaatttactagcaaaatatctgacccacagagaggtaaataatattgacaaagactatccattaatttctacttccaatatgaaagtcaaggttcagcactgttgagattttataaagtctcaaaattaagaacacagtaataggaaaagaggtattaactggcctcttctagcaagggagaatggctaccagtactccccgccccacttggtttggactttgataaccttaaaaacaaaattcctgaaagtacactaatattctaagaaatatactgaaaatggagctagtagaaacatttaaaaatctctttgctcaataagtcaatttattaggtcaggattctgaaacctaaatggattcccagcctaagtctgccaatgaagccagctgatggcactatgagcttagcctttctgaatcagccacgatggtgggtaaaattaatcactttcctcattagcagtcccaccagctcacctttcaactcaaatcttctaactagcattcaccaataatgtgtccatttctgacatatttaacccaatactaagaacactaaggtgcatataaggcattataaatagttaaagggaaatgggtggaataaaaataaaattggtcaggatttcgaactgacactaaatagagcaaggtcggccaggcgggtggctcatgcctgtaatctcagcactttggaaggccaaggcaggcagatagcttgagctcaggagttcaaaaccagcctgggcaatatggtgaaatcccgtctctacaaaaaattaaaaaaattagccgggtgtggtgatgtgcacctgtagtcccagctactcaggaggttggggcaggaggatcgcttgagcccaggaggcaggatcatgaaccaagatcacgccactgcactctagcctgggcaacagagtgagactgtttcatacatacatacatacatatatacatacatacatacatacatacatacatacatacatatatacatagagtaagaatgtatacatacatacatacatagagtaagaatccctatactaaataactccagaagtatctcagggttaatgaagtgggaatctaacctaccaattcagttcaacaattgaaagaatgtagccaaacacttctaaaagtcatattcttagtgatgattaagtctaactttagaaagatgttcaaacaataactaaagctacaggttcttattaaattcaaagtgatcctacaataatgaatcgtgtgtacctgcaagtttctcaagaggtaggcagtttcagagagccaaaaataggtaaacagaggagttccttgaccactaaaataagaaatatttcttcgctgcctttccattcccagatacctgattttgacctagcaaagccacacaagaatgaggccagggatcacatagcatacagagaggagctgaattcatttcccactttgagtcccactttcttgaccaagaaagatactataaaattttctgagtgactcctctagttccttatatcaaattcacaataacaagtaatatctgttaaaacagaatcccaatatcaaacatgctgcttcataaatatcttcctatttatgtattattcagaaaatacactaattaaaatctattttcaagtgtattatcatgtatacaaaacttccaagactctgaactaagactctgtgtatatgtaaatgcatgttttaataatgataacctactcattttatttctaaattgaacttatagtatgtgtatttctcatctctgtaaagtacataaaggtattatagtttacatgacgattaaaccaagaatgaggttgtgtttatttttaaattgattctccactgggaaaaagaagacacagaaaaaagtctcaaatcttagccactcattcctgcctttatttgacacccccggcctcttactgcactgcccaacccattttatctatttccccaaacttaaaacttagcaaagtctgactgaagttgatcactactccactagatagggttctatatgtagctgctgtggttctgatgataaagtacagttcttagttttagcacaagaatacataaaatgttaaagagctattactcacaaaaatgtacaacttttaaaaaatagtgagatgtgtagtagcagctttgactctcactgtggacttaggctgctcaaaataggttcataaacctcttatggtttttattcaggtaaagcttcttaggtctatttaaatagcctaagattgcttacaactgctctactccacaaaatacaccaagtgtataatcatcatcaggccttggctatcagaaataagaattccttcttaggaatccatggacaaaatgacaaggaggtagaaaaccaaatgaaagaaatatacactaatttccatgacatttatacatgtttgaatgatacagaattattcttacctgggaggttaccatcagtttcatcagcactaggaaaactagcaacacttgtagaatccgagaggtccaaaagtttagcacgcaattgctcaatatcactctctttgctggccaactgcatctgaagctcattcctatgtgcacattcttctaccaattgctaattttgaaaagtatcaagataatataatcaagctaaaacaatttccaacattactaattgaaatatgataatttaaattgctaatactaaaaatgtacagtaaacttcatgaatgtttgctaccacagattttgatacactacagaaatgtcaagttctttctcagtaatacaatgctcggacaaattccttttctccttgccttaaaaagagtttttgtttttgttttcaaacataagccatcaaaacaaaaaagttacaacaaaagaaaatgcttttctggctccaaatgaagtagctttaaaggtatagaaaacttcagaaaaccataactgatggagctaaaaagcttagatctaagtgcccgagaccaggttctcaattttgttctattaacaagccaaggggtatcaaaaaattaagcttgttattttgatttcaaaaaagtgagtcttgactagagaaaataaataagctacaatacttcaaaacctctaccccaattatagttaatattataacagccatatcccaatttcagtctgaaaccaaacaggcagaacccttgattgttcccaatctaaacaagataaatagataacaagtatatacagaaataatttaagaaaataatccttcacactcatatccatacacacacagaaaccttaccgcttgcatgtcattcagttccttctgatgtttcactaccatctggttgaatttctctctttcttggttgagttccagttgcagctttcgattttccttttctttctttctcaaatcttgtgtattagctttctttctatcaattttaaaatcttttcgattcattatttctgccaatttgttaacagcctattaaaatattattaataaagatcaatagtgtagtcatccaatttaatactaaaatgtatttttttcttcaaaatcaggaagcaggactttctgtgtgtatgaaaattaggacaacttcatgatggttgagacatgataactggtagcacaagtaactaacactgacttatcacactacttaaatgtaagaaccaggagcctttctttggttaactttacaacccagtactgaatcaagagtatgctaatcctactctgatgttgggtactagcaaataaagcttctatgccttggccacatactcttatcttctacaactatacaatattactaggcaagttagctttcttaactgaaatcctatttctttttttttttttgagactgggtcttgctctgtcgcccaggctggcatgcagtggcatgatctttgctcactgcaacctctgcctcctgggttcaagcaattctcgtgcctcagccacctgactagctggtattactggagcgcaccaccacgcccggctaatttttgtatttttagtagagactggggtttcgatgtcagccaggctgctctcgaactcctggccttaagtgttctgctggcctcagcctcctaaagtgttgggattacaggcatgagccaccgcgcctggccttgaaattctatttcacaaataagttttttatagttagcggggagagaatttatttgttctgatgaaaagcttgaaccttataagccttggttttaggaaaaagtgcataaagagcaatgattaactcaaaaatgaacatgtggaaaagatcgaaagcatgtatacctgtgttttaagggttcgttcagtgttgatattcttttcaaaggcagccttaagattactgatctcctcctccttctccagtttatattctgtcaacaaattatattaaatgttattgtatggtattaatttaatttctgcatttcaaactaacaatgtctttaattattcaaataagtatacattacatagtaactttcagtaacttcattaagataattcttaaggctacagaagttacttaatatatgaaaacaggtatcttagaaacctaacacaacataggtaaagataaatcactgaatttgatttaacatgatgattttttaaaaattctacataccttcctctgccttcttcattttctctgttagctcttcattctctcttcttaatatttcaatatctttggttagcatgctgtttgcttcttcaagctaaacaaagcacacaaaagtttaagctccagcctctttgctattctcgtatttcaggcagtaacctttaaatatactgctagataaagacaggtcagacactgctgaactacagcaaatgtctggtttccagcttaaaatatgtaattacatcaaaaatatttaaaagtagttaacagcatccaaaaattatttcattgtatgcatatagatatatgtatgaacaaaaggggggcatatgtaatggcaagataactagattgcaaactaagaaatttgtatttagttctagctctgcgattaacctagtatgtgaccccgagcaagtcatactttttctggacttcaatatctttatctgaatattgatgatgaaaacgataataaaaacatttatttatagattacttttagtaatatataatcattacttgttatatgttatattaatcattctatgtctactgtcttatttaatcctcataacaatcatgtggaagagatattactatttctattttatagatgagaaatctgaggcttagagaagttaaagccaactttgccaagaccatataacttcttaggggcaaaactggaacccagagtgactgatagtggctttacaagaaaaatctaactcctctttttagtcgcatgattctatatagattacagtataaacctcaggaataggtaattgtttggagtattggttttcttataatggatttatatattatcccaagaattcctcattcccaaatggtttctctatatttcacagaattctggcccataaaatcagttgcaatgtattaagagaacaacaaatgaatttaagctaagccattacttcatatgaaatataactaataagatctacagccagaaaaacagcccaatattgcattggttctgtgcctatacaaacaaaagcccaatatcttgaacaagaatttcaataattaacaaatgtttggtattatacaaactattttatacatgagtacagaatgaccactatgtattaacatagaagtaaatacacttgcacacacacttaccctaatattttaagatgtgacctattgtgatttaaataaattttatataacttacctgactatcacacttacccgactaacagtgtgatctttatctgtaatctcttgtctatttcttgaagcagctttcttgctttcttgcgtcaattcaaaatactgttcttccagaaggcctcgcgccaactgctcagactcagcttttgtttctgctagatccaactgagtagcaagagtttctctgcaacaattttttaagagaaactgatgtaaacaaattcagttcatccttccaacttaatcatattcttaaaaacacaattaactttaaatgataaaaagaattattttattgcttaaaataaatttaaatccattgcaaactttctataaaagtaatgaatttaacctctcacatgttgaaaaattataaaagaactatttagttttctatcccatattgtgcttaactaaaaaaggtcataaagcaatagcaaatagtctgcttttgaaaagaaatttcttgcagatttggaatggaaggcagcgtggcatagtggaaaagtcattgacttgttaatcagcaggctagacccagaactttatctctgttttatcattaactaattgagtagagacactgggcaagtcccttacacttcctgcagttcagtttcatcaaatctgtaaaatgagatggttaaactagtcccttccagctctgaaattaaatgagattatgaaaacttataagagatttgcaaatcactacaaactaatctgagaatgctccctggaaatgatactaaaacatttcagaactgacattcagaccaagacaactccagtttgcctactcttctcaaagagcctctcttggataagctctcttagtcactactgtattccctgaacagagtaggtgctcaataaatatgttctgaatgagtaacttccacctcctattttctagtgagtattacaattcaaattttctgcctgaagcctcaagagggagacatatagtaaacatacacacacacacacacacacacacacacacacacacacatacacacagaaaattcattaattcacccaacagctatttacttgaaggtttactaagtactacactatgtttactatgcatcacgctgttctaggaattaagagatacagcaggccggaagcagtggctcacccccataatcccagccctttgggaggctgaggcgggcagatcatgaggtcaggagttggagaccagtctgccaacgtagtggaaccccatctctactaaaaatacaaaaaattagccaggtgtggtggtgtgtgcctgtaatcccggctacttgggaggctgaggtgacagtgcaagactccgtctcaaaaataaataaataaataaataaataaataaataaataaataaataaataaataaagagacacagcagtaacaaagttcctgccctcagggagcatgcattagtggggccgtacaggcaatttaaaaaatgaacaagtgctatatagtatgccacagagaataatacaagataaaatatggaaagttatgaatatgatcacttttattacaggttgatcaaggaggcctctctgctaagacaacagtagaagaaaagtagggggaagagaacaacagatactgtaaggctttccaaggcaatacaaggactttgacttttattctggtactctggtgttttagaaagatcattctggctgctgtattaagatcagacagtagggggacaatggcagaagctgggataccagttaggagactactgaaataatcaagattggagatgatggcagtttggaccaggtcagtaaatggtacaagtggtgagaagtgattagagtctatacataatttttagttaacactgggaaaatttgttggtggactgcatttagagtgtaagaaaaaaagaagagtctaggatgactctaaatttttcacttaaacaactaggaataacagaattgttcaggactgaaatgaggaagacaggaaggagcagttcgcaaggtcagggaatcaggaagtttttctggacacgttaaatgtggggtgcttaacactcaagcagagatgtcaattagacagctggatacgtaagtctggaattcaagggaggatgtacttggactctgacaccatttaaagccacaaggctggatgagaacaagtagggagtaatcccttgagcactccaaacttttaacggtctcagcaattagaatggaaaaaggaacaaaggaggctgagaaagagtagccagttcaataaggaaaatacagcatgtggtgtcacagaagccaaatgaagacattttctcaagagagtaatcaactaagtcaaatcctgctatgaaataaggtgagaactgagaagtcactattaggaagaccccactgaccttgagaagagttgttctgttagcatgatgaatgcaaaagtatgactggagtgagctcaagagagaatgaaagaagacggtggaagatacctggtatgtcacttttcaagtaagttggctataaaaaaaagaaaagtgggatggtggctaccatgtagataatgtagttaaaagacgcagtttcgctcttgttgcccaggctggagcgcaatggtgtgatcttggctcactgcaaactccgcctcctgggttgaagcaattcccctgcctcagcctcccgagtagttgggattacaggcatgtgccaccacgcccagctaattttgtatttttagtacagatggggtttctccatgttggtcaggctggtcttgaactcccgacctcagggaatccacccgccttggcctcccaaagtgctgggattacaggcgtgagccaccacgcccggtgtaagagggttgtttttagaggagatatctaaatatgtttacataacaatgataatgactacaaaaaggtaaaaattgatgtagaaaagataagagaattgttggaatcataattttttttggagactcagtctctgtcgcccaggctggagtgcaatggcgcaatctcggcacactgcaatcttcgcctcccaggttcaagcgattctcctgcctcagccttccaagcagctgggactacaggcatgtgccaccatgcccggctaatttttgcatttttagtagagacggggtttcaccgtgttagccaggctggtagcgaactcttgacccaagtgatccacccacctgggcctcccaaattgctgggattacgggcatgagtcaccacacccgaccaagtcatattcttaagtaggcaggaagagataggatcgagggactagcattagataagagcgttagctcatgatgtccatttacatcatcagaaggaaggcagggtttataggtactattctctacttagaagctattctcaccaagataatgagtagccttcaaaataaatacaatggacaatttatgacttttttgtgacctttctcaatatttggcactttttttttttttttgagatggagtcttgctctgtcacccaggctggagtgcagtggtgtgatctcggctcctcccgggttcacgccattctcctgcctcagcctcccgagtagctgggactacaggcgcccgcccgtaattttttgtatttttagtagagacggggtttctccatgttagccagaatggtctcgatctcctgacctcgtgatccccccgcctcagcctcccaaagtgctgggattacaggcgtgagccaccgtgcccagcaatatttggcacttttaatcactttctctttcttgaaatatcctcctcccccagtttttgtgatactctactctgatgcagacaagttagtagctatggtggtgaaagagaatagatgttctcttctgatttttaggaagcaaggccattagctaagtacaagaataaggaaaagctggagatctgagtagagacgagatgtgaaataattttcttaggagagtagtagagttagtactttaggaaaagaaaggatatgctgccaatgccaaatctaagaatattgggagtggttctgctagctactataatacagggcttcaggttcacgacatgttcttatctggagtttctgctttgtgttaagataaaagtatctgggttatactttaagacaccagaaaacctatttaatccagaatatatttctatccctggttatgctactgtgcaagagaaaaagcaagaaagaattagatggttcagggtaaaattacctgcatctatacattcatccagacttcctttacaactctccataatgaaagactgtctttactaatatttaaggtcaatctctcacccttattctcctacctcttaaaagaattcaataatcaataattccatattcttctggattataagattataaagaatggctttgttcttgtttacaggtatatttcaaatgcctagaaaattctctggcccatagaatgcgctcagaaattttatttatttgaatgaatagatgtggggctgttcctactctgatctccttcccatgctccatttaaatatgctcaagtttacactactgttaaaaagaaagtgctctccttcacactctcctctagctactgctacatccccttgccataacagccaagtctcctgaattgtttaatttaacaaacacttgctgagcatcacaatgctgcagttacaattgtaggtgctagacatacagcaatgaattgaacctaagaatgaaatatctgaaaattcctcctaccatagagctttgtttctagcggaaaaacaaaaacaataaatacaacaggtaagaaaattatatattaggagggaataagtgctgcagagaaaaataaaatagggaaggatgaactgggcaccacggtagtggggtggggatgtttgcaatttaaaaagcatattcagggaaggccttgtcaaatgatgtggacctggagaagggccaaggagcaagccatgtagatacttggaggaaactgttccaggcagagagaagagcaatgtacatacctggaagtaggagagtgactaattggtttgttgaatagaaataaggctaatcaggctgttagatatactctgtctcttgttttaccctttccattcagtctcaatctactttaatacctattctcatctctatttagaagctgttctcaccaagataatgaataaccttcaatataaataaatggacaatttatgactgtttttcttgacctttgtgggtatgtggcactttttaaaatttaatttaatttttatttatttattctttttttgagacagtctcactctgttgcccaggatggagtgccgtggcaccatctaggctcactgcaagctccgcctcccaggttcacgccattctcctgcctcagcctcccgagtagctgggactacaggcacctgccaccacgcccggctaatttttttgtattttcagtagagacggggtttcaccctgttagccaggatggtctcaatctcctgatattgtgatccgcctgcctcggcctcccaaagtgctgggattacaggcgtgagccaccatgcccggccaatatgtggcacttttaatcactttctctttctggaaatattctcttaccccagcttttgtgatatcctgctctgatcttctcttacactgttggtagcttattggtttcccttcctctgcccattccttaaaagtctaggagctagtagtctttcctcagcctttgtgtcttctgatcctacactatggattacaatttgctacctgagaggaccaaatgagcctacaacagtgccccctgcatctatatattcatccagacttcctttacaactctccataatgaaagactgtctttaataatatttaaggtcaatctctcacccttattctcctacctcttaaaagaattcaataatcaataattccatattcttctggattataagattataaagagtggctttgttcttgttcacacaggtatatttcaaatgcctagaaaattgtctggagggatccagacacacatacacaaacatacacctaaaagagttttgggtcaaccttttacataaaaattcagattcttggtttctcttgaaaaatcagaagatcctgacatactgggccagtgttatcatgtggtaacaaatggctggaactgagaaggcgagatcttcagtttgttacaatccttacaacttacattaacgaatatatctgcacttagaccccactaattacagcctagttacacctatggcatcataggctcatgagtttataaactctgagatacacaatcaccttaacagatctctatattagtggtttctgtatgcaaagactatcaaatcagcttcaagttcttatcttttatctgcattctaaagcaataagcccaaatacagtggtatccatttctgtttggacatcccataggcacctcaaactcaataggcctgaaattaaaataatcttctctcctctcatctcacaattttggcattccttagctcagggaccagcactaccatcaactcaacagctctggtcagaaacttgggagtcagcctgaaaattatcctaacctttacccctatgcctccaaatctacaaatcctacttcttttacttcctacttcgttttatgcacttgcctcctactgccaacttccactataattttacatctaagttttgccagcggttatataattgggctccctgcatccacccagctttcccttacttcaattcattctccactccttagagtgagttttctaaaatacttatcagtcactagcttaggattttcatttattcattcaatatttattgaatacttattctctgaaagtccctgattggagtgctgggaatagacaatagacaacaatagaagaaacaaaagtccccacttttcaatattttaaactcttcagcatgatacacaaggtcctttgtaatctgactcagttttctctctccagccttatctgtcacgaactaaccatttgctgttcctcagatcacagattggcttctgcctatattgtcccttgttccccacatcccattccctggctaattctactttccatcggttgtgatctctgttaggaaatgttctctgaatcccacatggtaagatgaggtatcctttggcatagccactataccttgattatatctctcctaacttgattctgaagcacctgaagaatcataacttactaataattggatagctgcacaaagcacagtacttatagcacaatactggtgatccatatatttgtcttgaatagatgaaaaagggaaaatatatcaactctgaaacaatatagtatggattgaatatttggcacttttaatcactttctctttctgttcctcagatcactgattggcttctgcctaaactgtccccttcacagtgaatgcatacacctgggattgcatattgcactgtgaataccacacaaatggtaggtaacagactagattctacaatatgactatatcagagaataaccaggaaatgcagctttgtgtctaccttagcttccagttaattaggttatctaactatgatacttggccaccgaattagtatgtttatacccgctgtgatgctaaaatttaagataatatacagctctgcaacaaactattgtcaattttggaccttaaatattttaatcaatataatcaactcgattaaggcaacttaattgcaaaaagatgcaattatacttaattgtaatcaagtcaacaaagttaaacaacaaaaagtctaagtttatttataaaactagtgaaaataaaagttatgtattccaacaaaaaaaaaaaaaaatgaagaatgataaaagtgagtatctccagtttgcaacacctaatgtattaaggatctaacattgaatgccatagtggttaacaacagaaataggcaaccagaaagtacaaggctatatatgaattagtcttcttcctcctaaaaatcagatttgaatctgattaagcttctaaatcagaaatgtccaataaaactttccaggatgtcagaaatgttctatatctgtaccatctattataatatggtagacactaactgcatgtgactactgagcacctgaaatacgactagtacatctgaggaactaagttttaattttacgtaattgaatttaaatttaagtaactacatgtggctactggccaccatattgggcagaggagctctagatacaactactgacttccaggaaacataagggaaatggggaatgttcaaccaactacagaaatgcaatcaataaaatcgcaactgagggaacatctacaggacaaaaaaatccagtttcttcaacaaattagttttaggatggtgattactcttgaggtggggaggaaagaaggcataattaggaggtgggatatagtgggcttctgaagtggatagcaaggttctctttcatggatgatgatggttataatgacatttgtcatagttcataagaactgtattagttttgctgttttctgtaattgtttgtttcaacaacagtctttcaaaggtgattaaatgtaaagagaatataacaatgttggaaaactagttctagtgtctgttctgacattacctagctatgagatactccgcaggagttactatcttgttgcgcctgtcagctgaattctaaaatgaagctgttacacttgaaatagctttataaggttttctccttggagatggggtctcattatgttgcccaggctggtcttgaactcttgggctcaagtgatcctctcaccttagcctcccaaaatgctggtattacaggcatgagccaccatgcccggccataacctgcatagtaatcctaagaagaccttaaatacctttatctaacttaaaataatgatttgcaaagacagcatgatttatatataaatagatcttttaaaattgatactagcccaggcgtggtggctaatgcctataatcccagcactttgggaggccaaggtggacggaatatgaggtcaggagtttgagaccaacctgaccaacatggtgaaaccctgtctctactaaaaatacaaaaattagcggagcgtggtggcgcacgcctgtaatcccagctactcaggaggctgaggcaggagaatcgcttgaacccgggaggtggaagttgcagtgagccgagatcatgccactgcactccagcctgagtgacagagcaagactccatctcaaaaaaaaaaaattaaaaaaataaaaattgcaatacccctgaaaacaattgtcaaaccaactttttgtcagtttaatgaatctctgcaattggtacagtgttgatttatagcactgtttttttcaccataaaggcaaatttcagcctaatctgatttgttctgaattagcccaataaactgtgttctataccattcccaccagaataatggcacatctattcactaacttaaaacttaagaatgcctgttgcagtactgattcttgttctaaagtaaaatggacatacttttcattttgtagttcctgtattttctttaaattttctctgtttttttcttcaatttcttctttaagttcctttacctgggttttataaagtgtctgcaaaacaagtgacaaggagaaataagtgtttatggtgggttaaaaacaatttggcagtttcttataaatttaaaaaattaacatatgatccaacaattccactctcaagtatttacccatgacaaatgcaaatatatgtcaacacctagtcttacacatgaatttcccttatggttttatttataacagctccaaactggaaatgacccagacatccatcaatacatgggttaaaaaaaaaacaaaaaacaaaactgtggttaattcatattactcagcaataaaaaggaatgaactactgatacatacaacatgtaaatctaagaaatctaaaaaatatgctgagtgaaagaaaccacgtgttaaagagtgtatactgtgactccatgtagatgaaattctaggacaggtgaaaataatcaataatcatggaaaaacagtcattgtctgtgtatagaggtgggtggggaaaatgtagagtgaagggccataagggaactttttgcagtgaaaaaaaaatgttccacatgttgactgtggtggtggtcacacagatgtacatatttgtcaaaatttactaaccagtacacttaaaatgggtatattatatagaaattatagcttaatggccaggtgcggtggctcacgcctgtaatcccagcactttgggaggccaaggcgggcagatcacaaggtcaggagattgagagcatcctggctaacacagtgaaacctcgtttctactaaaaatacaaaaaattagctgggcgtggtggcatgctactgtaatcccagctactcaggaggctgaggcaggagaatcgcttgaacccaggagtgggaggttgcagtgagccaagatcatgccactactctccagcctgggcgacagagtgagattccatctcaaaaaaaaaaaaaaaaaagacattatagcttaataaagtgtattatagatttgggaagacgttataaagaaatttaacacatattactaatttaaaggttagatcaattcttgactaatgttagaaaaatcacttctgttttgaggggtgggatgtactgggtagttgagagacaggtaaagaaatatccacaaaagggccgggcgcagtggctcacgcctgtaattccagcactttgggaggccgaggcgggcagatcatggggtcaggagatcgaaaccatcctggttaacatggtgaaaccccgtctctactaaaagtacaaaaaattagctaggcatggtggcgggcgcctgtagttccagctactcgggatgctgaggcaggagaatggcgtgaacccgggaggcagagcttgcagtgagccaagatcgtgccacttgctctccagcctgggcaagagggtgaaactccgtctcaaaaaaaaaagaaatatccacaaataagatttatcaagtattctgctaacatatctataatatatgcttatttcagaacaatggctcttacaaaattcactaagcttttgccaacgccagtgaaaaatatttaacacatcagactcatattgtgttagttgctgaagttacagagtgaacttccagttctgatgtctatttctttttaactaccctcttcattttaaaagaaaaagagaagggaaagaaatagcaagggccaggaaacagctgtggagaactacttttaacacttatttattacactaagaaacagcactttcctaggcaaaaaaatacataaatgtccatgggaatgcaaatgaaaaaagaataagggcttactctaggttaagtatttataatttctaaaattaatctatttggcctttaggactcagattcttatctctctgacttcaaatactgaaattcaaataagtaaatcaatgaagggataaaaagaaaaataatctgatttgaaaacccagaaaaaagacaaatcttaaaatttggttcataacagcttattgaattgaatgctatttaatccaatgcccacaagcaatggaataaatcagaactgagatagggtcaggttttgtactattttctagaagcaaaatcaaaaatccacaagaatcaccacaagtcatttgacacccatccaaacatttggaggcactggatgactgctctgtggaagcatatggcaagaaagcatatgggatgctaccgatcactttgcagaagttagcagtagatactttgaataattacgtttagcaaacactcagggaaagagttttcaacaatatttaaaagtctttcattttgtttatgagacagagtcttgctgtcacccaggctgcagcacagatgaccttggcttattataatgtccaactactggactcaagcaattctcctgcctcagcctcctgagtagctgcgactacaggtgcctgccaccacaatcggctaatttttgtatttgtagtagagacggggtttcaccatgttggccaggctggtcttgaactcctgacctcaagtgatccactcgcctcggcctcccaaagtgctgggatgacaggtgtgagccaccgcacctggcctgaaaagtttttacaatttaaaaacatataccaatgatagcctaatatgccaagaaacaaatggacaaacaaaaagcagaaaagtcacaatgtttattagaagatgaagagtcatttgaaaaagaattacagttcacataaaagaatctaaataccttgttttaagtcaggttttgaaacagtgtgtatgttaaaaatgattctcacttaccgagaaatattgctcagcttcaagctgatcttgtagctcccgcatctgtccttcatttcctctatactgtcttcagatgaaaagaaaaacaagtgaacaaacgctcctacttatactagacttcattttttcttagtttgttaaagttgctaatataaaaaagtttactaaaacaatctttattttttaaaaacatacttcattattcattattttactaattaacttggtcaggccacaccggttctatcttgctccttataaaatgacgctatgcaaaagtagtgagaacccttttctactgatgatcactttttggagaatattaattgtggatctatccaaaatgaaaaaataaaattgataccatatttttggtaaatttttacagagaaaagcagtcatagggaagaaaatgtcttgtacagtaaataaaaaaagaggggggcatgaaaaatttaataataattcagtgctacatatcatagtactatatttaataagtaataattcagtactgcatactagatattatggccaattaagcacaagaaaggggctggtggaaatgaaccatcaggtaagaagggaaagcaagaacaacaaactgacaaacaaggaggaacgcagatagacaactgcatgtatataatacatacataaacacaactcacataggagcagagtccaaaagatggaaacccaatgtaacccaaagacacagattttcaataattatttactgtataatatgaaagcctagcagctaggcttgaaaatctagcggctagactttcatattagacagtaatagctttgtattctcagtatctcaaaaggcatgtggctgacagaaagtctacaccaatctccactgaatgctgagcgagagtatttttggagaaaaaaaatataaaacacacttttgcgaaaacggtggccctaaaagaggaaaagaatttcaccaatataaatccaattttatgaaaactgacaatttaatccaagaatcacttttgtaaatgaagctagcaagtgatgatatgataaaataaacgtggaggaaataaaaacacaagacttggcataagatatatccacttttgatattaaacttgtgaagcatattcttcgacaaattgtgaaagcgttcctgatcttgcttgttctccatttcaaataaggaggcatatcacatcccaagagtaacagaaaaagaaaaaagacatttttgcattttgagatgaaccaaagacacaaaacaaaacgaacaaagtgtcatgtctaattctagcctctgaaataaaccttgaacatctcctacaaggcaccgtgatttttgtaattctaacctgaagaaatgtgatgacttttgtggacatgaaaatcagatgagaaaactgtggtctttccaaagcctgaactcccctgaaaacctttgcaagtaaattcttttacttctaaatactttttttctgtctttcacaaactctaagtacataatctgtacatatgtaaaatgtcaaacacacaagtcaatgatgaacacaaaaaagaaagaaatcacaatgttattttaaagacttacttcgtaagctgagctaactcaaattctaataatctctttgcttccaataaagtatttatttcctgtttcatctgcttttctaaaccttttaaattgtctgcctcaaatgcttgagtcttcaattcattttgtaacaacagccgcttatttgattcctgctccagttgcagggttagattcttaacctatgaatgagaaaaataattgggatcttaaatctcttaaataatttattagacattatttgaaagactactaaccaaatcaagtacattataattcatggtactagtagaaaatattagtattttaaagagtcttcattgttccacgtgtttattacagtagatttactattaagtcaaattaattcccaaatttcagacatgagatcttgtggagggaaaaaaattctggttcctttctaccccaatcagcatgaaaattctgtagtacaaggtgattataaaactcacttctgggccaggcacagtggtttatgtctgtaatcccagcactttgggaggctgaggcaggtggattgcttgaacccagagtttgagaccagcctggtcaacatggtgaaaccctgtctctacaaaaaaatacaaaaattggccaggcatggtggtacactcctgtagtcccagctacatgggaggatcacttgagcctacgagtcagaggttgcagtgagccgagatcacgccactgcactccagcctgagtgacagtgagactctgtctccaaaaaaaaaaaagccattcctgggggaacatttgaatggagtacttaaatttacctgtctacgtgctctactctacaacccttcaaagcttaaccaaacaaactgaacgtatgttttattcaactcaacaaatatttctgaagtgtttattaggtgttgggaccaatgaactcaaaattcatacagtggtttacaatggccttcatgatctgttctaattctattcctatcattggccattctctacaatccaatcatattcttcagatcctcaaatgcaacaaattctccctcacctcacatttcttgtacgcactactcctgttttatcctccttcatttattcattcttcagctctcaaatgtcatactcttagcaaggccttctgtaactcccaaatgtgattagtaatacacccctatagcattccgtactttctttctaattatttgcaatgcttgtagttactattttaatatctgtttttccctcctggctgtaagttccaacacagtcaggaccatacctatatcttattcacttcggtaacccccaattcctagcacagagccaaataggtagtcaaaaattatgttttttaaatgactgaatattatctttcaaattttgaacatacattcctcctgcatgctagctttaataggtatctctaatttctcttctttctagtccattctatataccactaccagattgatttttctaaaagtgctttcacctatagctcccatgcaagttttattttttattttttagagatagggtctcactctgatgtccaggctgagtgccatggagcaatcttggctcactgcagcctcgacctcctgaggtgcaaggaatcctcccacctcagcctcctgagtagctggaactataggcatgcgacaccacacctagctgatttttgtatttgagatggggtttcaccatgttgcctaggctggtttcaaactcctgagcttaagcaatgtgcccatctgcccacctcagcctcccgaagtgctgggattacaggtgtcagccaacgtgcctggccacccatggaagttttaaagagtatcgatactttggcctacaaatttctcccatgactactcaacatgtcttcgtttttccttcaaaaagttaaagttctatcaagttcctttttatgccttccttatgcatcttcttatccagccggtactcactttattatccatctctttactgataatattccctctagcaagtaaagccctgactccaaaactattaccttttgaagtcttactcaacctttaaaatctaggtaacatgttacatcttcttgaaaaggctttcctactttcagtcttagaaataatttctaaagtacatatagtaaccaccaggacatactgtcattttatctgtttattaactgctttataaaatgtataccctgtgctatcaatctaagccaggaaagactgcagttaaacacttttattgaaatctaagagcaatgctcttttctttggggatataagatgcattataataaagactttttttttctttaaagcagatggtcagttttttcagggaaggaactatgacatttcaatatagttgtactgtcatagtgaaaaatggcatagatcacacagagtgaatgttcaataactatttgaagaggaaaattctaggtgctggggtgaccatacagcagtgaacacagacccatgtcaattatttcattcaaatctccttcatggtgtttaaattatagataactccagtcataacttatataaccgtttctcttttaatagatgaacaaagtcagtactatttttcttacttcatcctccatcctttctttatttccagtcaaatgttctagtttctgctgagattgcttcagatcaacgtctagcatggaacactgtttctcaatctgaacaacccgattttcagccttctctcgagcttctctttcttctttcagctttttttccatctctgggaaagcaaaaagttacaaacatacatttaaagaaagagtactttaacacatttcactttatatgggctgtaaactggtttcaaatgtctctattgtttttattctgggacttgaatagagctagtaattatagaaattctcacattatgtaaactatttatatagcagaaatctctaaagaaaaggagttataaaatataatacagtaataaaatcttctaaacccagctcttgcccagtgatgagagattaatcggtaccactttcagacaagaaggtgaagagtatagctagaaaggaagtgaattaacaaagaacaatgaacatacatcaagcaaaagcagaaaaataaggctgtggttattaatttataccctgcattgttccagaaaaggttgaagaggcttaaggctatggtaggaactccaatttatacaattcagatgaataagattccacagtagtatacctcttttaattattactggaatatattagtctacactgaggctccttttttgaaatataactaagcttctgagaggttaacttttccatgttcatgtaactagtaagttgccccataaggattcaagtttatttaaagtgtgctttcccactcttggagaccaccctctaggtgacaaaatataaactattaaataaatataaataaactattccttatctttccccccaaacttacaaacttagctgcaccaataaaactgtcacctcttaagacccttctgtttaatcaaacacaaatccatccactatgttcttctgactcttggtatctctctcctgagctccagacttagataccaattgactatttaacatctccacctagatatctaataatcttattaaagttaacatatccacaatagatgcctttacttctggcctatccccaaaccactccaaccccagttagactcagtcttttttttttctttttttgagatggtgtctcgctctgttgcccaggatggaatacagtggtgcaatctcgattcactgcaacttccgcctcctggattctaagaatactcctgcctcagtctcctgagtagctgagattacaggtacgcaccactacacgcagctaatttttgtatttttcagtagagatgggggtttcaccatgttgcccaggctggtctcaaactcctgacctcaaataatctgcctgccttgccctcccaaagtgctagcattacaggtgtgggtccccgcacccggcctctttctatccaattcatcactcttctcctctatacctcgacttctttccctctctactactaccagtgtttacagcgtatagctttctaactgatctccctttttatcactgttctcactcttgaaagcattccccacagagcagcgggaatgatcttttaaaaatataaattacacatcccagaagcttaaaatgtgctagtggcttaatacaaatcttagaataagaatactgaacttactatcacttctgcctgtaatgcactttctccagctcatttaacaggtggttcattttgactttcagttcttacctcaaatattactagctcagaaagccttcctcagaacccccatccagggcagtgccaagtcaaaacaatcatattaatatgtatttccttcccattaataattacaagctgtatgtattttcatttatgtattattatttttttttgtctatattcactatctgaatgtaatctccgggcttcctgtcagttttattctctgcgatattcccagctgtgccttgtctgtaggcagtcaataattaacttaagtgaaggaaataaaagaagctcaatatggctgaagcacagggtacacacaacaaagtgtagggtagtaagattgtaaagacaggcaggtgtcaacttaaagattctatatatacaaggagtttgaaaggtaccctgcaaacaatgaaaagccactaaaggattttaaggacaaccaaaatacgatttgactaaaaaggaaaattgttctaacctaagtgagaatgactgatgagtagaacaactcttggcaagatgatgatgtgatgttcagtagccaagataatagctactgaaaactttctatgcacaggcactttacatgcatttttcatctaacttagaatagttacagagcaacattgatctgtctgattccaaagccttagctcataaagaccatatggccattaactaggttagtgagaataaagaataagagcaggtttgatggatgagattatgagctttcttttgagcaaaaataatttaagatgccaacacatccagactgtagtaggttaagaataagcagaaggtgaggaaaagacttttagaagtttggatattttttaatttttttctataaagaatctgacaccattgaagtttgactattttattaatttatttgaaataaaacagtagtaattagtaaggatgacagattgctgcatggatttgtctctgttttaagatgggagacttgttcatgtttacagtaagaagataatggaggtaaaaaggttgatatagaaaagaaaaagagaaaagaagttaagatgagatgagaggagcttaccctcctttaagataacagtgaagataatgaagacaggtaaagaataggatagattgacaagaaaactagattttgaggagttcacacctatgctttcattatttacttgtgaaataagaataaaattcacctaaaactggagtgataaagaaacggcacaggaaacttaagataaataaaaatctgggagaagaaacttatgaccgatatgttcaaaaaaaattgacagccaagcatggtggctcatgcctgtaatcccagcactttgggaggccgaggtggaaggatcccttgagcccaggagctcaagaccagcctggacaacatagtgagactctttctctaccaaaaataaataatttttaaaaattgaaaaaaaattgacaactcaggttgcagataatgcattggactaacactcaactgcctgaagaaagtggctggctggtctgaactagggttgtgtttggaggcataacacagtggaagtacaaagaaatgagaaaactgagggtacaaagcaagatagcagatgaattagcagatgatgaggtccagagtggatcataaagaaaatcaaggaaagggctactaaaaaacagagaaaagacagattccactaacttttataggaaacagagtagtaaactgagggaactagaaggtgaaattgtgatcttaaaaaatggaaagcattgccaggcatggtgtttcatgcctgtaatcccagcactttgggaggccgaagtcaggagttcgagaccagcctgtccaacatagtgaaacgctgtctctactaaaaatacaaaaattagccgggcatggtgtcgggtgcctgtaatcccagctactcgggaggctgaggcaggagaattgcttgaacctggaggcagagactgcattgagccaagatcacaccattgcactccagcatgggagacaagagcaaaacttcgtctcaaaaaaaaaaaaaaaaaaaaaaaaaaaggaaagtatcaaaaggaaggcatcctcttcttgattataatttataatttctttctctgagacacagtctcactctgttgcccaggctggagaacagtgacaccatctcggctcactgcaacctctgcctcctgggttcaagcgattctcctgcctcagcctccccagtagctgggattacaggcgtgcgacacacacctggctaatttttttatttttagtagagacggggtttcaccacattggccaggctggtctcaaactcccggcctcaagtgacccattggcttcagcctcccaaagtgatgggattacaggcatgagccactgtgccaggcctataatttatattatactttctacgagttaaagagtacaaaattttgaccaaaaccaaattttttctagtcactatttaaagtcaattttgtaaaaatattaaaactgacacttaccacacattgccacagactttgcctcttcaatagattgatgtttgtcagttaaacgagctttggttactttgtgttcatttacctcttgttctaaccgttgttgtaatgatttaagtttgtagtttaaatctatctctaaattattcttttcctgtaaaatgggagtaggagtcatgtaataaactgtgcagaaggcatgcatgttagtaaatcttacatttaatattctggaagagatatgatgccttattttaaaaatcacaataaacacatataattaaaagcaaaagataatcttttctttaccccctcccttcccatttgaatcattaatcatggcggagggcagaacaaggctgtgctggtggttatgttcaggacagttcattgctaagatcggaaatgaataagacaaattttcagtttatttaaaaatttctgataccatctttttttttcttttcttttttttttaaagagatgaggtctcactctgtcacccaggctggagtgcagtggcaccttctcagctcactgcagccttgaactcctgggctcaagctatcctccagccttagcctctggagtggctagtattacaggcatatgccaccacacctggctaatttttaagcatttttttgtagagatggggtctcgctccactgcccaggctattctcaaattcctgggctcaagcaatcctcctgtgtcagcctcccaaagtgttgggtctacaggcatgagccaccttgcctggcctgctaccactttaaaaaaatatattaaatcatctttatctacatttgcatctatatccacatttactttgctttcacaaaaaaacaaaaacaaaaaacaaacaaaaaaaccccacaaagtatcctgtggcaagtcattgatatagaaaggaaaaatgagtcaaaatatattccatttctgtttgggtacccttttctactcttcaagcttcttttatcctatgtccacatttacaccagcttggccatcaaaaactattctaattgtgacaaaacatgtccaaaggacaagataagtagtggcttttctgataatttacctgaggttctattgaacctccaacatttcagaggctttgaaaaagtgacagctgtatctctatatcatctatttaactcttagctaggtatataacagagaataaccaatgaaatttttattgttaagaaaattctaaatgcaaaggccaatcactttatgctcttttctattttgctaactgtaaaacaacagaacaggtactcatcatctaccacgtactgatctgttgttttccttcttcataagccctcacagcacattcatcttactcatgtacaaagaaaataggaaaacatactttataaaaaggtatttccaaaccaaaggaatctgtgatgatctgttaacatgaaacatctaatgctctctagggtaaaaacaaaaataacaaataacaaaaccctaaataagacatacatacagccccacatacaaccaatcaaacataaaaacttttagaaatgtaactatataaacattaagaataaatgctattttataaaaccacctagtagtctatgataatcagtaattactattttataataattggtatatgttaaatcatttaccttttctgagtgattaagcatgtcttgagcctcttttctttctccttccactttttcgagattatgtttgagatgcttcacctcctcttgtaaagatgtaattcgagctatcaagtgagaaaaaagttcaagtctgtagtcattgaaagaagtctttttgttcagtattgacaatttagtttttaaaaaatgtttttttaatgtattaagtttcctgatccgataagattttattaagtgttttcacaataaacacaagatatggaataaaaatattaatgctaattggatataatctagtgcatattccttatttacaagtagccaaagagatgaagcctcagcttgagctagaaatcagatccaagtccttactgagtgctttttttttgagacggagtctcgctctgttgcccaggctggagtgcagtggcacaagctcagctcactgcaagctctgcctccaggttcacgccattctcctgcctcagcctcccgagtagctgggactacaggcgcctgccaccaggcccggctaatttttgtatatttagtagagacggggtttcaccttgttagccaggatggtctcaatcccctgacctcgtgatccgcctgcttcagcctccaaaagtgctgggattacaggtgtgagccaccgcgcccggcactgagtgctctttctaaccacattaaaggtgagagcctttagttaattaaggcaagtattaagtggtccatatgtgccagacactgcaaagtgtttaataaaattacttttaaacttaatggagccaaactctattttcacagaaaactaagtttttaaggaattcaagtactctaacaaagcttagttttaacttacctgatgttcgtgccttgcaatggtagtaactcatatatttagtaattgtctactcattaaaacatgctttaaccttacaggtatttaaggcataaatatttaataaacacacaaatttaacacatgtagtatctgacttaatatattgtctagcttaaaataaaaattatattttcatattttgtaattcaaagtggcctaggatttgacaaggaaaatagatgaagtaccagatgggccagtaaaacttctgtactactcaaagtacagtttgacttactgtacttgtcccactctcaaatgtactctagtcacctcccatatttcagggtttctaaagtagttatttaataaacaaataaatattaaatctttggcacctgataatgcatatctgctagattagttctagatctagaaaacaatgaaataaataattttatttacacactcaagatattttcatgttgcagtaagttcatgtaggagaaagaaacagctgccgctttctttcaaataattgaccaaaaatacagagtatatgtgtgtttgtgtggacagagataaagcaaatgtgctaagatgtttaaatgttgaagtgctatttagaaattataatttaaaaaataaatgatataattatctttaaaataggccaggtgtagtggttcatgcctgtaatctcagcactttgggaggctgaggcaggcagattgcctgagctcaggagtttgagatcagcttagccaacatggtgaaaccctgtctcaaatacaaaaatcagctgggtgtggtgacacaagtctatagtcccagctacttgggagactgaggtgggaggatcgcctgagcccaggagttctaggagaaaatctgttttaaaaatcattttaaaaaatctgtacaaagatagtaattcagattaatctttgaatttttcatgtagaagcagcttactgcaaaccaactcctaaggagacaagataataaactatatgggttgaatccacgcaagattcctagcaaccacatgaaagagacaaattaagtatagtttattttcctcatttactctgtctgaaaagaaatgtcggaaataaactagaacttacctgtgcaatacacgaaagcaaagaagctttatatacagaaaatataaaaacataatgggaggaataagggcccaaacactaggtatcataatctaagttgattaaaacaaaatttctaaaagctaatagaagatattatcttcataatctagtcaaagactttttcgataggccacactaaaaaccacactaacaataaagaaaaaactagatacactggactacatcaaatacaagaaattaagaccttttgcttatccaaaagcagcactgaagagtgaaaatgttcccaccatgcagtagactgactatagttaacaataacatactgcatatttcaaaatagctagaagagatgattttgaatgttctcaccatagagaaatgacaaatgtttgaggagatgtacatactaattaccctaatttgatcattacacattgcatatacgtaccaaaacatcccataagtatgtacaattattatgtgtcaattaaaaataaaacagggggaggcagagaagggccaaatagaagcctccaccgattgtcctctctgcaggaacaccaatttgaacaaccattcgcacagaaaagcaccttcataagaaccaacaatcagcttagtgatatatatcagcttggccatggtggggtacagcaccaagcaggctcttgggggtccccaattccaggtcctggttcttggatggcatttctggacctgctctgggccagagaggagcccactgccctgaagggagagtcccaagcctggcagcattgagacccagtgctgtgctggcttcaggtctgacccagcacagttccagtggtggtggctacaagggtgattgtgtaacccctccccaccctctccctggcagctcagcgcagagagactccatttgtttgggagaaagggaagagaacagagcctctgcattataatacagataattcttccacatcttacccaaaaccaccaacatggttcctctaagagtctgcaagagccacagtattactgggcttcggatgcctcctaatacagatatggctacagtgaccaaaaacttaaatcacaacacctaagtcccttcgaatacctggaaagcctttccaaaaatgacaggtacaaacaagcccagactgcaatgactacaataaatacctaactcttcaatgcccagacaccaacaaacaaccacaaacatcacgaccattcaggaaaacataatctcaccaaagaaactaaataaggccccagggaccaatcctggagagacagagatataagacctttcagacagagaatttaaaatagctgttttgaggaaaatcaaagaaattcaagataaaacaaagaaggaattcagaatcccatcagataaatttaacaaaaagactgaaataagtacaaagaatcaagctgaaattccggagttgaaaaatgcaaccgacatactgaagaatgcatcagggtctcttaccagcagaaatgttcaagcaaaagaaagtattagtgagcttgaagacagactatttgaaaatacagtcataggagacaaaaaagaattaaaaagaatggaacatgcatataagatctagaaaatagcctcaaaagagagtatctaagagttattagccttaaagagcaggcagaaagagagataggggtagaaagtttactcaaagggtaataatacagaacttcccaaatctagaaaaagataccaatattcaagcacaagaaggttctaagggttcagaggtctgactcagcacagttccagggtggtggccatagggtaatggtaagtacactgaaaaacactactgtaacactgcaattgcagtgtataaattattcatatcttgggtagagagactaaaagaactgatcaaaaataacaactataatactttccaagaggcagtaagattataaatagaagcaacgaaaagttaagatgcaggggactaagttaaagtgtagagtttgtattagttttctctttgcttgtttgttagtttgttaatgccatcactgttaagtcatcatcagtttaaaataacgggttagaggatattatttgcaagcctcatggtaacctcaaatcaaaagacatacaacagatagatacccaaaaaataagcagcaagaaattaaaacctatcaccagagaaaatcatgttcattaagcagaaacaggaaggaaagaaggaagagaagaccacaaaacaatcacaaaaaaataacaaaatggcaggagtatgtccctacttattaacaataacagtgaatgcagatgaactaaactgcccaatcgaaagacatggagtggctgaatggaccaaaaaacaaacaaataaaaaaacaaaaaaacagaacccaatgatctgttgactacaagaaacacacttcatgtataaaggtacacatagacatacacagaaaaaacaaggggatggaaacagatattccatgccaattaaaacaaaaacaaaaacaaaaaaagagcagtagcagttatacttgtatcagacaaaatagatttcaagacaaaaactataaaaaggcacagaaaaggtcataatgtaatgataaaggggtcaattcagcaagagaatataacaattgtaaatacagatgcacccaacactggagcaaccagatatataaagcagatattgttagagctaaagacagggatagaccccaatcctggagacttcaactcctcactttcagcactggacagatcacctagacagaaaatcaacaaagaaaaatcagatttaatctgcactatagaccaaatgggacctcataaatatttacagaacatttcatccaacagccacagaatatacattctccttagcatgaggatcattctcaaggacagaccatatgttactccacaaagcaagtcttgaaaaattcaaaaaaagtaaaattatatcatgtatctatcttctctgaccacaatgaaacaaaactagaaatcaacaacaagtggattttttttttttttttgagacgaagtttcgctcttgtaccccaggctggagtacaaatggcgtgatcttggctcactgcaacttccgactcccgggttcaagcgattctcctgcctcagcctcctaactagctgggactacaggtgcctgcaaccactcctggctaatttttgtatttttagtagagacagggtttcaccatgttggccaggctggtctcgaacttctgacctcaagtgatccacccgcctcggcctcccaaagtgctgggatgacaggcatgagccatcatgcctggccaaaaagcggaatttttgaaacgatacaaatacctggaaattaaagaatatgctcctgaatgaccagcggattgatgaagaaattaagaagaaaattaaaatatttcctgaaacaaatgataatgaaaacaaaacatacaaaagccaatgggatacagtgaaagcagtacaagaaagcttatagctctgagcatctacatcaaaaaggtagaaaaagtttcaataaacaacttaatgatacatcttaaagaactagaaaagccagagcaaatcaaacccaaaattagtagaagaaaataaataataaagatcagacacatgcaacctaccaagattaaaccatgaagaaatccaaaacctaaacagacaaataacaagtaatgagatctaagctgtaataaaaagtcttccagcaaataaaagcccaggactgaatgactttactgctaaattttaccaaactttttttttttttttttttttttttgagacaggatcttgctctgtcacccaggctggagtgcagtgatgcaatctcggctcactgccacctccgcctcccgggttcaagtgattctcctgcctcagcctcccgagtagctgggattatagacatgcaccaccatgcccagctaattttgtatttttagtacagatggggtttctccatgttggctaggccaggctggtctggaactccagacctcaagtgatccgcccaccttggcctctcaaagtgctgggattacaatcgtgagccaccgcatccggcccttaccaaacatttaaagatgaacaaataacaatcctactcaaactatttcaaagaatagaggaggagagaatgtttccaaactcattctacaaggccagtattaccttgataccaaaaccagatgaagacacattttaaaagacaaataaacaaaaaagctataagccaatattcacgaggagcacacatgcaaaaaccctcaacaagatgctagcaaaccaaattccacaatacattaaaaagttcattcatcatgacaaataccatttgctgaaatatcattgttttagcaaaaaactaatttaaatatgttaaaatgccaaaataaaatataaaatttacaaaaaggcataatctacaaaaaggcattgagtcccaccaagaacatacaaaaattaaaaataaattaatgggcaagatataagaagaaaatgcacattaagaaaaagcctcagagtcagatacatttaatatcatttataatacaaattttaatccacccagaagatacaggagtcaaaatcttacacaccaaaaaacactgcattaaaaatatgtaaagcaaggtattcatgaaatacccacagctaacatcatactcaatgaacaatccaaaaagaaaattgagaaaattccctttaagagcatcaaaaagaataaaatacccaggaagaaatttgtatatagaaaactaaaaacaaacacacaaatgaacaaaaacactgctgaaacacattttaaaagatctaaataaatgaaaatatatccttgttcatggattggaagacttaatattagttttggttttttttgagacaaggtctgcctctgtcagccaggctggagcactgggacaacaggcgtgcaccaccacacctggctgattttttattttttgtagagacaggcttcgccatgttgctcgggggggtctcaaactcctgtgctcaagtgatctgcctaccttggcttcccaaaatgctgagattacaggcttgagccactggcgcctggctggaagatttaatattgttaagatggcaatactacacaaagtaatctacagattcaaagaaattgctatcaaaattctaaaggtcttgtttgcagaaatagaaaagccaatcctcaaattcacatagaattgcaaagaaccctgaatacgtaaaacatactgaagaacaacaaacttggagggttcaaacttcctgatttcaaaacttgctacaaagctacagtgaacaaaacaaaacagtgtggtacatgctggcataaggacaaacacacagaccaatggaatagggttgagaatccagaatatcatagatgcatgatatctatagtcaattgattttcttttttttttttggagacagggtctcactgtgttcgcccatgctggagtgcaatggtgcaatcttggctcactgcaaccgctgcctcccaggctcaagtgatcctccggcctcagtcccccaagtagctgggactacaggcacgtgccatcatgcctggctaatttgtgtatttttagtagagacatggttttgccacgttgcccaggctggactcaaactcctgagcttaagcgatctgcccagcgcagcctcccaaagtgctgggattacaggtgtgagctactgcacctggctgccaatcgattttcaacaaagatgccaagaccatttacacaggaaagaatagtctcttcaaacaaatgttgctgggacaactggatattagatgctcaatatcattagtcattagggacaatgaaaatcaaaacaaacagcaatgggacaaccaccacatacccactagagtaactaactgaaaaaaaggaaaataccaagtgttggcagggatatggagaaactggaatcctgtacattgctgacaggaatgtaaaatggtgcagccattgcagaaaacagtttggaaattcctccaaagttacacatagaattacaagatgactcagaaattccactcctaaatatacacccctaaagaattaaaaacaggtactccaacaaatacttgtacacaaatgttgaaggagtgctatttacaatagccaaaaggtggaatcaatccacagtaatattctgttatatgtatatcatcaacagatgaatggctaagcaaaatgtggtaaatacatataacagaatattactcagccacaaatgaatgaactactgacacatgctacaatatagatgaacctgtaaaacattatgctaagtgaaaaaagcctgacacaaaaggtcacacattctatgatgccatttatacgaaatatccagaacgggtaaattcagagacagaaaggaaattggtggttgccaggagatagtggagcggagaatagggaggggcagcttaatggatcctattttgtagtttcaaaatgaaatgttttggaaccacatagaggaggtatttgtgaacattttgaatgtagtaaatgctgttgaattgtatatttttaaatggttagctttttgttacaagaatttcaccttaattaaaaaatatagacagcaaaagctgttagaaatacaagggaggctgccaggcatggtggctcacgcctgtaatcccagcactttgggaggctgaggcaggcagatcacgaggtcaagagatcaagacatcctggccaacatggtgaaaccctgtctctactaaaaatacaaaaattagctgggcatggtggcgcatgcctgtagtcccagctacttgggaggctgaggcaggagaaccacttgaacctgggaggcagaggttgcaatgagccgagatcatgccactgcactgtagcctgggtgacagagtgaggctccgtctcaaaaaaaaaaaaagaaaagaaatacatgggaggctatgagaaaaaacccacaatgatagtgaaaacttttaaaacacattttaaaatttgacagaacaaagggacaaagaataaatgcaatcttagaaaactgatggattacattagaaaacggatcaacttttcacccaaaaagatgtttcatacaaaaatcgacaattttcaaatgcccatgtaacagtgaaatgcaaaaatcatttataaactaagccagaaaaaaaatcattaaaagtagaaatcccaaagtagaaatcttttaatagttcctgatcacaataagaaattattaattacaaaaaaaattgtttcctacctctgtccattaaaatcacctacaaacattgaccaacccaacagtagtgagcacccatagaattcaggttatagaccccgaatgtcatatgctacaaaaggaaccggagttcctaggcaaatgggtgatttcaggtctgggacaaaaaataattctggaaaatctatgcatatcaaaaagcaaggatgtgatctaaaactactagggtagtgtctaaacttaaagaattcctactaaacttcatgtgagcatcattaagaataatgcaaagggctaacatatattaaatatattaaaattcatgagttcacaaatatattttaaaaattcactaatcatctttggaggatgcctgggaaataactcactgttccaaaaactgacaaagaattaagtatttaacctgactttcttttataagctgtacctcaaagtaactactatataattgatgaggaaatgttcatctctagagtagtattccaattaacaaatgaaggaagatggataaaaatagatgatcaccactgcaaattcctaaagaaacaaaggacctaggcaatgatcatcaatggctactaacaccacaaaaagatacagccagactttatgttttttcattcgtttgtttgttgttgtttttgagacagggtcttgttctgttgcccaggctgaagtacagtggcacgatttcagctcactgcaacctccatctcctgggctcaagcaatcctccacctgagcctcctaagtagctaggactacaggtgcatgccaccatacctcgctaattttttattttttgtagagatgaggtttcgtcatgttgttcaggctggcctcaaactcctgggctcaagagatccacccacctcagcctcccaaagtgttggttttacaggtgtgagccactgcacccagcccagattttatgtttatgtgtctcctggtacctaaatactacttacaagtattcttgacaaagtcctaccgaagtagatcacatctctagatctaacgtctagtttaaagtactacggcggacagagcaacatgctaaatgataccagcagatgaaatcagtaaaattctgaacaggagccactcacaggacgaaaaaaacatggtttctttaaccgaaaacaacagcaaaaagagattacaaagaacacaaaagggaggaggaaaatacagattaaaataaacttaagggacgtattaatgaaatgcaatgtccaaactttggatccaaattcaagcaaaataaatgcaataagaacaaattatgagactactagaggaacttaagcactaattagatattttataatattatataactgtcacctattttctacctttgataatggcattgtagttatgtttgtctttttaaaaaagagtccctatctttaagataatgaaatatttacaaattaggatgtatttacaaaaggacaatgtggtgcctgatatgagcttcaaaataattcagtgtcagaggattgggaaggggaggtggaggtacaaaatgaaacacgactggctaccaaatgaaggtttttgaagcttaatgagtacacaagaggtcactatagtacaggttaggcatccttaattggaaaatccaaaaatccaaaatgctccaaattctgaaactttttgagcactgacatgacattcaaggatttcagatttgggatactcaactggtaagtatacataatgcaaatattctcacaaaccacccaaaatccaaaatctgaagcacttctggttccaagcaaacaattaaaaaaaacagaaaaagacttttaaaaatggttaatttaaaaaaattgatttttgcctttcaatctgaagaatcagagataaacttactagatgaaagcttatcaattcagttaaaatttcaatcctccataacattttgatcactttcattaagcctctatagcctgaacttttggaaactttccctataatcaattgcagccttactgttgcactagtccaggtactggcaaacatcagggctgcagcctgtttctgtacagatgtcaagctaagaatggtttttatactttaaaaggttataaaaagtaaaaaataaaaaagactatgcaacagagatcatatatggaggacattcaattaatgaataacaatcaagactctgccagaagcccaccatcccaaactaaatttatacttgagagacctgaaagttcttaaagaccagaaaagactaatataagcattgtgatttttttaaaaacccacaatgcacttttatatgtatgttgaaactcacataagttgtgtgcattattttagtgtatgtgagcttttattcacgtttaagttccaaattaaactctgaaaaagaataaactaacaataaatcatgctataaattttccttaacttttactgatatctaaaaaatagattcagttaaaaaccactgttgatagtacatggatgatctctgcctctgaagcaaggagcttaaagctcagtcaaacacagatcacaaacttataagaattttagaattggaaggatttatagaggtaacctattcttatctccttggtttacagataaagaagggagatgaagagactttcaaacagctaataagctgtataaaaaggcctaggaaaacaatttaaggaagtctgtgactttcctattacatataaagtggttactttcttagttataatcagatctattttaagcctggtccctgagaaatatgattgcacaacactcctcagctaagaaccaacaggagattgtattttctgtttccttagtcacaaaaactgaccctgacctctctccactgaattatagctaatcatcaagccccaagggacctgaaactatgttcccatctctaactaaggttaaaaagaactcctccctccaattttttcctgagacatctggcaacttctatgcatatttgttttgattaggtagtatggatgctgctgctaacaggaatagaaaatagaaaaatatgtgagtaggtaaagccaggaatctttttgaaaacaaactgaattttattactatttaaaaactgttcatttattcacttagttatactcaatcttctgcctcttagattcacaaagactgtcaatatctccagttcaaacattcccaagtatctaacttttaatgtgtaatgggattttatttctgcaactgactttctattactaccaacgatgcatgaggaattcctaggttttaatagtgataatcctctttgcctggattagtctcactttgagtaaaacctttatgaattaggcaagtttttaaatgaagtttttggttaatttgtctgtaaaactgaaaaatatccacattacataccctgcaggagtacctgtgagggtgaagaaattacaatgtgatacaaatgtgggcattattctaaaagagaaagaatgctggcctggtgtggtgtctcacacccataatgccagcactttgggaggtcgaggtgggcggatcgcttgagctcaggagtttgagaccagcctgggcaaaatggtgaaaccccgtctctacaaaaaatgcaaaaattagctgggcatggtggcatgcacctgtagtcccagctactcaggaggttgaggtgggagaattgcttgacctcaggagttcaaggctgcagtgagctgtgatcatgccgctgcactccagcctgtgcaacagagcaagttcctatctcaaaaaaacgtaaacaataaaaaagaatgcaaccatttctggtttcaccaaagtcattttctttatgagggtaatatgatcataaatatattaacttagacttaaaaatggtcaagatggtaaattttatgttatatatttttaacaattaaaaataaaaattataaaatattccttccattgatagatgagtggatgaacaaaatgtggtatacacataccatggaatattactgagccctaaaaaggaaggaaaatctgacacacacaacatggataaaccttgaagacattgtgctaagtgaaaaaagccagacgcaaaaggacaaacactgtatgattccacttatatgatgatggttgcatacattgtgaactgcatttaatcccactgaactgtatatataaaaatggttaaaatgttataataaatttcatgttacgtatattttaccacaataagaaaaaatattaccttgaaggtctccaatcatctcagaatcatgacctctgtctcttcgttcagcttctaatatagcttgcagctggtaataatctttgtctgtttgtgacttagaattctctaaaattcgatttctctcttgcaactctctgttcagggactctaactgactaattgacttgctcatctctgtgtgactcttcctcaatcttacagctgtgtccgattctgtcctaagtaagtcattggcttcttctagctatttaaaaagaaagcaaaaaaataggtttctgaccaaagtacgatataatttaattatctacaatttttttaaaaaggaacctcatttgaaacacttacctgcttttgtaactgggacagcttctcattagcaagctgtgaattctgactgactttctttaagtcttccaactgatcctttaatgtagaaactagaaaatgaaagaataatatatagaaattacaacattttcataggggaaacatataaatccttttttaaaaaaagacatttagtcttaggccataatagtcagctacattaggtccactcccaaagccaaattccaatttggaagtacctgcattttaaattcattaaaaagtagaacattatcttctaatacagagtgcaaaaagatttcttcttactgttgtaaatctcaaactcctttattccctttataagatcactgatagtatacttataaagctagttttaatattatttatttttcaagagttcaattgcttgataattcaatatcttaataaaaatacaaaatttaaaaggtaccaaatggtagatagtatagaataagtcctcctttctccatttagtcatttttgccccttctgagtctcccttaactggctctcctccctaatatatatttaatttaagcatatatagacaagtactcttgttttaaacacaagcaatccgtttctgtcacttaaagatctgtcttagagactgttttataaccgtatttaaggagatgatttattattttttataagccacatagtattctaccatatagatgtactaaaatttattacagcattcattacctttatgtttcatatatgtattacattatgtttcatatacagcattgactgcattttttttgtcattttaaacaatgctacaatgaatagccttgtgtatatatcagtttgcagtaggagtatgtacgtgaaataacttatggaagtgaaattactgcatcaatgggagtagaaaggtattttaaatatatttgtaacacaagcattaaaacacaagaaattctggtttagaagttcttagacgcagctgcttgttagaagtacctagggggcttgtaaagaataatgatactcaggccacatatctagaccaattaaattagaatcgctgggatttaggcatcagtactctttaaagcttcccaggagattccagtatgcacaccatgatgacaatcactactctagttaaatgctacttactatttactttaatatgtaatttaatatttaatttaattactatttaatatgttataaatttaacctgagacctgggttatttagcttataaagtgtcttaggattgtagcttcatgtatgtatcatggacactaaattaaagacaacctcatgacagtgttagaaattctatcatttttcaaaagtagtgacaatttaccttcattttctacatttcttctcttctcattttcctgttcagcttttctttggtactcattaattctatgctgtagcaacattttctccttctcaatctgagacactgtagattctagatttcttctttgatttccctggaattataatgataaaagttaccactgtgattaatactctggtcattcattcaagtgagtattttgttcttaaaaacaaaaaacaagaaaaaaaaaaagacaaacacttaagatgaatgttctgtttcaaacgcaaatagtatctcctaatacaactttctaagtagcttgccttttaagaagacagtgggaatctgtcttctgtagctgggactacagggacgcaccactgcgtccagctaatttttctatttttggtagagacggcttttgccatgttggccaggctggttttgaactcttgacctcaggtgatccgcctgcctcagcctcccaaagtactgggataacaggcatgagctactgtgcccagcctaaaatacccaaattttcacaacttaaaaatgtacctttctgagttaccactatcagtaaatcttgtttttgatgcttcactttttaagactccacattaggaaacctgttttacagtgtttctgggctttctcatctttaagcagaaattggacataaatcattcaaggtctttctgattctaagagtttatcattctaacttttagttaatttttagataattatacattcaaagaaagttgcaaagatagtacagagaggtcccaagtgcccttccactcagcttcccccagtagagacattatatataacaatagtacaataacaaaatcagaaaattctcactggtataaggagtgtatgattctctcattttatcacatatgtaggttcatgtaagcaccaccacaacgaagatacagaactggtcatcacaacaatttctttccagtcactagttatagccacacccatccccgtcctcccaccacccatactcctggcaactaatggttctccatttctataattttgtctttttgagaatgttatataaatggaaccatgcaatatatgactttttgagacaggcttttttttttttttttttttgtatttttaatagagatggggtttcaccatgttggccaggatggtctcgatttcctgacctcgtgatccgcccgcctcagcctcccaaagtgctgggattacaggcgtgagtcaccgcgcctggccaagacaggttttttttttttttaactcaacataaagaccttaaaatccatctctgtattgtatgtatctacagtttattccttcttgtggctgagtattccatggtacaaatgtaccgaagtttgttcaaccattcacctactgtaggacattttgattgttttcagtttttggctattacaaatagagctgttataaacattagtatacaggtttttgtgagaatatacattttcatttttctggaatacatgcccaagaatacaattgctaggtcacatagtaggcacatgtttagtttttcaggaacacagccaattggttttccagaatgtctgtaccattttatatccccatctgcaatgtccaagtgatctagtttctccatatccttgccagtttgctattgacataattttaaaacttactttttttcatggttatggagtaatatttcatgatagttttaatttgcacttcccaaatgactaattatgtgaacctcttttcataggtttattttcatccatatatctaaaaagtttaaaaagtatggattcgctttccttaacacttatatagggctactgaaattacctatttcacactgtatgagttgtgatagtttgatttttgagaagttagtccctttcatctacatgtcttaattgtgtttagaactgttcataggatttccttatgattcttttgatacctatatggtctatagtatatgccctatttcattcctcatactggtaatttgtgtcctctctttttcctttatcagtcttgctagaggtttgttaattttgttgatcttttcacacagctttttgtttcactgattttctctattgtttttctgcttttaactgccttgttctctgctcttatcgttacttgtccttccttttgcttgttttgggtttatttcactcttcttattctagtttccagaagtaggagtttaaattattgattttagacttttcctcttttctaaggtaagcatttagtgctataaattaaccttcatcaccatgttaacagcatctcacaaattttgatgatgtattttcacttcattgttcaaatattttgtaaagataaagagccataacagttttatgagacataattaacattccaatgtatttttttcactgagacttcttctttgacctctgggttatttagaagtttattgtttgctttccatgtgtttgcagatttttctgttattctcatctgtacattttggtcaggaaactgtatgatttcagtgctttcaaatgtgtttgttttatagcttgggatgtggtctaccttggtgtgtgttccttaagcacttgaaaagaaggcatattgtgctgttaagcagagggttctgtaaatgttgaacaaattctgacagctgacagtgtagttgagttctcctatgtttggtgattcttacgggtgctgaagtctccaacaataattatggattggtctatttaaccttccagtcttatcaacttttgcttcacatactttgtagctctgttgtttggtgtacagttaggatttttatttatttttggtggattgactcttatcattatgtaatattcctctatgttcatggtaattttctttgctctgaagtctactttaattggtattaacattgccaatatgctgctttctttttaatatttgttatgttatctcttcacatcttccgatgttcaacttgcctatattgttatatttgaagagtttctgacagatatataaatgggggatttaaaaaaatctacccctaccacctcttttgattggtattccatttaatttccatttaatgtcattattggtagtatgttagggttaagtctgccgtttttgtttttttgtttgatctctgttatttctacattttctttcctgtctttctgtgggttacctgaacattattttagcattccttttgatttaactatggtgtttttgaatgtatctccttgtaaggccttttcagtggctgccctagatattacattgtatatgcatagcttaatatatagtacactccactggtattggcatcttaccagtttgagtaaagtataaacatcttccctttcttcttttaatttttatcttatttatttttgagaaagggtctcactctgtcacccaggctggagtacagtggtatgcttatggctcactgcagcctcaacttcctggactcaagcgatcctcccacctctgcctccctagtagctgggactacaggcgtgcactaccacacctggctaatttttgtattttttgtagagacagggtttcaccctgttgctcaggctggtcttgaactcctgggctcaagcaatccgctggccttggcctcccaaagtgctgggattacagacatgagccaccacacttgacctaaaaactttacctttctttatgacccattactctctgtttataatgtctaaaatattttttctcatacacagagaatcatattagacaatataatttctgcttcaactgcctactataaaaaataaagaggagaaaaaaatgtatttacccatcttttactgtttctttattcctggtaattcaaaattcctcctttttcttttggagacagagtcttgctgtgtcacccaggctggagtgcagtggtgcgcttggctcactccaacctccacctcccaggttcaagcagttctctagcctcagcctcagcctcctgagtagctaggattacaagtacacgctaccacacttggctaattttttttgtatttttagtaaagatggggttttgccatgttggccaggctggtcttaaacttctggcatcaagtgatctgctcgcctcagcctcccaaagtgttgggattacaggtgtgaaccaccctacctggccaagattccttcttttatcatttcctttctgtttagagaattttcttttgcaattcctttagggaaggtgtgctggtgacacattatcttagtttttcctcatctgagaatgttgtcattttctttttcatttgagaaggatgttttaattgaacacagaattctaggttgataggtttgtttttttgtttttttagcacctgaaaaagtcatgccacttcctcctggcctccatggtttctgataagaaatcagctgtcacttacactgttgtttcctttctaggtaaggtgtgtcctgtatttaagatttcttttttgtcattaattttcagaaatctgactattgtgtcttggtgtggatatctttgggtttacactttttgtggtttgctaagcttcttggtagttcatgtcttttgtcagttcaggtcttttgtcaaatttgttgaattttctgtcgtcatttcttcccacgccctttctcctctcctttagtaattcgagtgacacaaatgttagaattttattgttatagttctacaggtcccagaggctctgtcactttttttctgatcattttctctctgttgttcagactgcataatttctatttttctttgttgaaggtctctgattcgctcctctgcattgttcactctgctgctgacaccatctattgagacttttatttcagttattgtaatttttggttggctctattttatattgtctatgtctttctgagactatttttttgcttgtttgtatgtttacagttgctcactgaaacatatttatggtgattcctttaaatacttgtcagataactctaacatctgtgtcatctcagcattggtattagtttattattgtttctaattccagttaaaattttcctagttctgattatgatgagcagtttgctattcaaacctggacatcatcttacaacattctggatcttatttaaaatctcttttagaaggtctcctctgacactgttctggtgaaactaagggggtgctgcctcttttctgccaggtggagtttgcagaagtccaggttttccactcagcctctactgacacctcaggtagggaggggagcagatcctcatcactgctgggtggaagcaggagttctggcactctaccaggcctccattgagtgcaccatggctgctccttatgtggcccccacagatgacactgcattgtggaggggagcttgttattttcagtggaaagttctgactccctaccatgtctctttgataccaacccagaaggcagtgggaggggcacccccttactgccagctggaagtgtaagtgtagattccccacatggtcactgctacgctgtctggggagagaaagaaggtttgttactgcccacaggagatgaaaattcctttactggaccttctctgacactattctaattggaagttggggtgtgctacagcatagtggagatggaagtctagacttcccactcagcctttgctgttaagaatggggctacagttggctgggcgcggtggctcaggcctgtaatcccagcactttgggaggccaaggcgggtggatcaaggtcaggagattgagacaatcctggctaatacagtgaaaccccatctctactaaaaaaaatatataaaaaattagccaggcatggtggcgggcgcctgtggtcccagctactcgggaggctgaggcaggagaatagcgtgaacccgggaggcggagcttgcagtgagcagagatcgcgccactgcactccagcctgggaaaaagagcaagactctgtctcaaaaaaaaaaaaaaaaaaaaagaatgaggctaccgtttttctgtggtgtttggctgaaaagagcagtgatagtgtaagttttctgacttgctagcctgctccttttttggtctttaggctaaggaaattagctttttttggagctttgtctgcaactgttgatatttcgaggttgctggcttctccggcaccccgtctaggatacatgcagcaaaaagaaaaccctgaagactcattcatgtgttgtttctcaggacgcaagtaacccaggttggtctgccttctttccacctttcaaaatcttttcatgtttgttttatgtttaatgtttagggtttttagctgtacttactgggaggaatacagaaaaggtactcttactccatctttctagaagtgagactattttaatttcatacctcaaatttccctctctacttctaatttggaaaaatgaataacttaaatctagcacatctgaattttatctgtgttttaaaagttaaatataagtggaagatatgcaaaaaaggactccttaaacactcagagtcaaatatatactgctaaggttaagtacaaaggcaagttagtaaatgctctctaaatcttcatagatatccaaagctacccatgaaagcaagcaagccattgacagataccattctataagggaagaaaaaattaacacagcataaaaactatcagagattaaacctaaaaaaggacaaagtaagtaatgtattaggagaagactacagagagtgtatttcttttcatgggactcatagacacagtagaaatatacttagaagttgactaagaggaatggaaatgtattacatatttgcaaacaaacatctgaattatgaatgcttgttattgtttctctgataataaaaaattttgacaggtaaccatggaaaagatgaacattctaaaatcaatatattttccatttgattacatgagattatgtcagtgttaatcttttaaaaatattttaaactgtatttctctcttttccttatttgtctgtctctttctgacatagtttgagattcaatttctgatcgcttgcttctctggctcctttctcacatttcaaccatcgagaaccactgaactgaaatttacgtactaaaattaatacggctgtagaaaacaattgtacaaaggaaactaaattataatctaatctgtaccacttgaaactgcagttccaaggtgaggctttcatcacaattctctgctctgttttgtgtttcaaactacagaattcaaatacaattttctcaggaaacgaaacaatttgaaagagggaaaaatctcaaaaaggaaacttgattagaaaacaaaaagtacctcttcatccaattctttcattatcttgtctagttttatgtttgaggttctgtaaaaacaaaagcaatacagattagaaatatacgtatttcttattgcccagtgttaaacactaacattccttacttttccacttaactagagttttgtatcctttcttggtgccatggatctctttggcagtcaagtgaagcctatggccttttttcaaaatattttttgaagcacaaaaattatatatgattaaaagagacaattaggctgggtacagtggctcacacctgtaatcccagcactttgggaggctgaggcgggtggatcatctgaggtcaggagttcgagaccagcttggccaacatggtgaaaccccgtctctactaaaaattaaaaaaaaaaaaaattagcaaggcatggtggcgggcgcctgtaatcccagctatttgggaggccaaggcaggagaatcacttgaacctgggaggtggaggttgcagtgagccgagatcatgctactgtactccagcctgggtgatacagtgagactccatctcaaaaaaaaaaaagaagccaattatattgaaacacagtaataaactttaaaaaaatatgtgtaattcagtagtatatatgcttccttattaatatattaaatcacaacatctagtggcagtgatttcaaagtattgatgagcataaatgatatttagagatagctgtaacaactgtaataagaaaacatctataatttctattggtaataaaaattaacaactactgctaataactgaattgctgcctatgctcagaattgaaacaagtgctaaaattaagttataagttagagaaaacgttcaccttttgtcatccacgtttaaggacttcaaatttcatccatggactctttgggggaggtctatggatttcaggttaaggatccctaaactccgtcatgcaatacttgccactactcaaaaattagccatttatcctttaatacaggataaagtaaacaaagagaaaggtagtatatatcaaatcagtaaaggcaccatttggcaacactcaaagtgtattatcttcattaccatttgctttctttggttcaaaatgtaattctgagcttcaaaacctatatatgcaacattttcacgtggatgtctcattaaatacctcattcagcatctccaaaatagaacttactgcctctgttccacactcccaccccaataccaatttgcttctcttctagagtccctaagtaaatgacaacacctaggaatcatccttgactcatcctccctcactcccatttagctgaataaagtgccaagtgctgctaattaagcaggaacttcttttgaaaacagcaaatttaatatatattttttacttattagtttaatgacttttgatgtttttccattacacttaaattccaaatttcttagcccccccgcaaaaaaaaagagaaaaaaaaattctccccaatctagaccttgccatcctccccattctcatctcaggcttttccttccctcacatcttactggccagtcaaggtctcttacctcacggccttcacagatactcacctcctggaccctaacacttccttccactcttctcctaataatttccattgactcttctggtttagctttctctgatctctgacaaaacagtacaggcatctcctgatgtattcctgatattcctgtataattttattctctccccaattaacacataccacacttctttttttttttttttttttttttgagatgaaatctcgctctgttgcccatgctggagtgcagcagcgcaatctcagctcactgcaagctccgtctcccgggttcatgccattctcctgcctcagcctcccgagtagctgggactacaggcgcccgccaccgcgcccagctaattttttgtatttttagtagagatgtggtttcaccttgtgagccaggatgtcttgatctcctgaccttgtgatccgcctgcctcggcctcccaaagtgctgggattacaggcatgagccaccgcacctggcctaccacacttcttgataattacttacttgtttttcttgctaaattacaagctccttgtggagaggggccatgtcgtgatttattcagtactatattgttgacaagcacattatatgacactttaactgaaatttttattgaataaatgaatgtaactaaaatgatttgaatgcagagaatttgatttaaagaaatgcaagtggccgggcgtggtggctcacacctgtaatcccagcactttgggaggccgaggtgggcggatcaaaaggccaggagatcgagaccatcctggttaacacagtgaaaccccgtctctactaaagaattcaaaaaattagccaggcatggtggcgggcgcctgtagtcccagctactcgggaggctgaggcaggagaatgccatgaacccgggaggtggagcttgcagtgagctgagatcacggcactgcactccagcctgggtgacagagtgagactctgcctcaaaaaaaataaaaacaaaaaaaaaataaataaaataaagaaatgcaagtaaatatcactccacaatccctagcactaggtttttattttaaaaactatttaccaattcaatatataattttttaaagtttcatctcaattttatttccttgaggtgatactttcatatgattattagccaattcagccattcttattacttcctcaaactgatccctactcaccattactaccagtttgtcacttgtcttttaattttgtttaaaaatttttttgggccaggcacggtggctcacgcctgcaatcccaacacttcgggaggctgaggtgggtggatcacctgaggtcaggagctcgagaccagcctggtcaacatggtgaaatcccgtctctactaaaaataccaaaactagccaggcgtggtggcaggagcctgtaatcccagctactcgggggactgaggcaagagaatcacttgaacccgggaggcagaggttgcagtgagccgcgatcgcgccatcatactccagcctgggggacaagagtgagatttcgtctcaaaaaaaaaaaaaaaaaatttggatgtagagacttcccaacatttatataacagtatctacccagttcttccccttatttacatattttatacttagaaattctttccaaatcctggggtcagttaattatttgcttatattcaaatgcctttttaaaagaaatttgtattatacacttaaccacataatctatcaggaatggttaaaagtgagaattttatctgttttgtaccaaaccccccacctgctctgtcacaaaattaccagtgttcccaattttatttgttgaatacttttcgtgttacctttgcatttcatttattcaatactattcactaaaaacataaataattataaaaaattattgcttataattgataagtaattcagtattatgctaggtaatttaaaataaacgtgagcataactcaaagatattttttctgtgagtctaatgacaataacatgctgaaattagacccacagaaaaagatactctgagttactgctctggtgaaccacagtggaaattagaatggccacatcaaaaatttagtatattttaatcttcaacattttacatttcaaaaagcacctgatttaatgtaaactaatttcccctttatttatttttctttttgagacagagtcttgctctgtcgcccaggctggagtgcaacggtgtgatctcgacttcctgcaacctctccctcccgggttcaagcaattctcatgcctcagcctcccaagcagcagggactacaggggcacaccttcgtgcccagctaattttttgtattttcagtagagatgcggtttcgccatgttggcctggctggtcttgaactcctgccctcacgtgatccaccatgtgcagcctaatttgcccttttagttagctaattatgtaaagagaaaaaagcagtaagtcaggcaactaaatgaattagcattacagttttttaagaatacagactgttggccgggtgcggtggctcacacctgtaatcccagcacttttggaggccgaggcgggcagatcacgaggtcaggagatcgagaccatcctggctaacactgtgaaaccccgtctctactaaaaatacaaaaaaaaaaattagccaggtgtggtggcgggcgcctgtaggcccagctactcgggaggctgaggcaggagaatggcgtgaacccgggaggcggagcttgcagtgagccaagatcgtgccactgcactccagcctggacgacagagcgagactccatcttaaaaaaaaaaaaaaagaatactgctttactttctgatgactgtaatgaaaacacagttggaacatattacaaagtacacaatatattattttcatgaattaaaaaaaaaaaaaagaatacagactgccaggaacaaatgtactttaaatattctgaggaaaatacatctataactaagccaacataaatacaacttctcaattctagccgagacacatcatgaatgtattatcagtagtaatctttacatcctcattttctatttactttcagatgtttacagggtataagctttcaagtaagtatttggtatataaaacttttaatatgaaaaacttaaagtatattctcacctgcacttctgctccatttcatcttttaactgcatttcattatgcagctgttcttccagcttatagattgttttttgcaaactttcctgctttaatttaaaacaaaaacaaaaactcattctactaagaatatttagacatttaaaaatatcaagtctatgttaatattttaaacctttttagaaaataatttaatttaatcttacctctttctatctcaatttttttattattaatttaacaagcactttcttaacatttactaaacgttaggccattagaaatacaaaaattaaaaagatttggttcctgttctcatgaagcaaatagttacatagtgaggcaaagttaaattggaagagaaaaaagaagctacaatgtcccaaagacatatacacaaaatattacaatagactgtggtaaataataaaaaaattatctacggagtgttccaaaggagagaaaaggtcacttctaactctgccaagaatatataatccttgagttgaggcctaaaagataagaagaactgataatctgataaagcaaagaaggtggcacaagaaaggcattttagctagaatgaacaatgagcccaaaagtagaaaggcagaagaaaatatgatatatttgggaaatggaaagaaatcaagtactatagcagagcacagaatgtaataggaaaaacaactcacattaagcctaagaaggtaatgatccttgtatgcacaaactggagttggggactttaccccataagcattttaaatgagaaatgacataatactggcacctcagaaacatcactacaataataaggttaatgaacagcttagagggcagtgaagttctaagaagagcaaccagttaaaaagctatcaaagcagttcagacaagagaatatggatctgataaaaggcagaggctacaggaatgaagaggaagtaatggataaaggtatcaattggaaagcacaatgtatgaccaaaccgactggaagttagaatagatataataccattatgaaagacagccaacacactgctagggagggaatggggacaggaaaacagtgagtttagctctggcctagtttgatatgcctgagaagtatacagaagagagagaaagattcaggactggagctcagacaagcaagctggacatgaatgagattacctacagagaaagagcagagagccaagatcagaactttgggaaatgttaataattgaaagtgagcagaggaggaagatcctgaaaagaggattgaaaaataaataaaattcaaaaatatgggaggtaaaaaagagggaaacaataggaacatagaagatttagaaatgtttgaagttccaaagaagtaggaagcagtcagtgtcaaatacagcaaagaagaaaaataagatatgggctgaaaatcatccactgtatttggcaattgcaaagttgttcaatagcatctctgctaggttttcaaggaaaattaaattagttgattttgtacttagttctaggttgaaataattagtatatcccccctgatattattagagcaaaagataaaggtagcaaccactgataaacttatggtaatcaccactgaacaaaatcagcccaaagaaaacatgaatcctttgaatatttttgaaggccgaaggcacttctaactctacagtcaagtaacacagtgagagctgacttacagcaactccttattattacgtaggtcaaagatttttgagcccttgttagcaatacataacttgccaaacagctctactgggattaaaatttaagagaaagatgaacttaacaccaaatgagtactcatatagttccttcacctttttctcattttcccttttcaccgcatgttctcttatatttaagagtcaatatatcaaggagaaagaaaagaatcattatcagctttttaaaaatggctgctacctcttcctctcctctgttaaaaatatgtaggcttgcaatgtctctgtgcccccccacaaaaaaatgtaggctatagtagacaaaaagttcaaagaatgctctaggaatggacagataattactctggatatttttcagaaaattcctgttaacccaaaaggaccttctgaaatgtaagcaagtaagattttgttttacctctgtgtcagaacatgagctatataaacaacagaaagaactcaactaaaatgtattttctggagtaatatacttctcagtggacaaattaagatgatgctaactatactggttattctccatttcccccattcccttctaaccttgaaaattcatcctctgctcttctttgccttaaaatctacagattgcattgcctgtattactctgtagccctatgattttaaggttggtttcaacccacaggagacaccagcagaaatctgaaggtaaaagaaagaaatattcatttccctacaccctttgtgctttactgtggttttcacaatgctctacgttttatattcctcttctatgatgtcaggctttctctgagctacgataagattttctctctttgctccttcagtatagggcaatggcttcccactcttgttcatacatgggtgctttagtaccctttattgtttccctctactgatgttcacagcatgttaatcatcccttcattaaactcttgatttaataaatgcaaaaatatggtgtgtgtgtatatatgtgtgtgtgtgtgtatatatatgtatgcaatggaatattactcagccttaaacacgaaggaaattttaatatatactacaacatggatgaaccttgaagacattatgctacatgaaataagccagtcacatatggataaatattgtatgattccacctcatatgaggtacctggaataggcaaattcattgagacagaaagtagaacagtggttaccaggagctggggggagggtgaaatgaggagttactgtttaattggtatagatttttagtttgggatgatgaaaaggttctagagatggatggcagtgatggctgcacaactatgtgaaggtgcttaatgccaccgaactgcacacttaaaaatgattaaaacggtaaatttcatgttacgtatatttgccatacacacaaaactctctgtttaaatattttgaacatgtaatctgtttgcctgtcaagacccttaatgatacattgatatatcatagttcctgattccgaagattaaaaaagatgaccactgtcaatctgtgtaacaatttagtttactaactgcctccaaatatattattccatttgatatttgagcaaaaaatcagactgaaaaggagatgggagatgaaagtgccataaaaatctaagttcagctaaccacagcttcacaaacaatatataaatttactatcatacccacaaatatattatccacaaaacaattttaaaaacaattttcttaatactaagaaaatacctaccaagcttttatctgcattggagctagttctgttatcattaggatttgctgaagataagtatctgagggaaagaaaagtttaaaaagaaaagaaaacaaaaaactctgtaatatcccatgacaaccaataataaatactacacgcctattttatgttcagttatagtaactttgtttttaaaaattaagtataggttcataatttttataaacataattcagaaatgatacatatattaaataaaacacccagttaggtctaaaaatagtagcagcctgtaaacatatgacttaatattcctgcagcaaaacataagaatattcataccaagtaggataaataaaaaccatagtctcaagttagttcagattaggctttctggtcatgagagcaggttatgacaggtttttccaccaaacaaataacttaaaaacattcagttttcagagctttttgtatataagaattgggggtaagaaactgctgacttctgcagacatatgcataaccacctctcctgcacccaactatccttcagcaaagcataatattgcctcttcgggtcaaaaaagtttttgcctatgtgggtgaaataacagaaccaaagtttaggtgatgctgctaatcttttgggactcccagccttgcagagttctttaaattcagtgtaaagttagaattgtatataaataaagctattagtgaactaatttagaggtcttttttagatgtctcacaagattctcaaacaatctaaatagatcatatatgtaaacaattttttaagctaccaaatattatataaaggtaaggtactagtactgccagtgttgctcctactgccaccatgctacgactaccataatcactacttctaccatcaccaccactacagtcagcaccctgattaaccagtagagctattgcaaaaggagatcaaatagttacagtatacttcatagctattggaggcatgtgttaacacaccagatattaataatgttccaaaagaacagtttaagtaaattttaaaaattagtgaataacagaagataatcaagtatccattaagtatcaataaacatacacagtacaatggtactataaaagaaacagctagaaatatgccacttcctaggttttccttgaaaaattattcagatcaaatggagattcaaataactttaagacaataataggggctgtgtagcagctttatagaggaaaagtcccatataacaaatgacaaattctaggtgtggtgcaatttaattccattgactactaagcatctcagaaattcaatgtgagattctgcttatgtaatataaataaggcatatagcaatgccagtggcatctaaattagatgagactgtttcatctctaagatattttctaaacttaacatgctatgtgactgagactgacattttagtcttctgcaaaattagtaatataagcttgaatgcagcaaaggaaatgtaaggacatcacttgtatacatccattaattcttccaccttctgtcttttctctatcaaggtacatttgcatattatattggtgcttttacatagaatctggtcatttaggtaactttttacaaaacgggagttactatattaggaatatagcttaaggctattttaaaaatcatgtttaattcagctataattaagcaacaatgatttctgcccttggtattaaaagtatatctggatttcagggataagaatttcagaggttttctatttcatatctgtatattcaaaattatgcttacatattacaataaagctaatcaatattttgccagggccaggtgcagtggctcacacctgtaatccgctgggattactttgggaggccaaggtgggtggatcacttgaggccaggggtttgagaccagcctggccaacagcctggccaacatggcaaaaccccatctctaataaaaatacaaagattagccaggcatggtggtacgcacctgtaatcccagctactcagaggctgaggcacaagaatcacttgaacccaggaggcagagattgcagtgagccaagatcacaccaccgcactccagcctcagcgacagagtgagactcttgtttcaaaaatatatatatattttgttggttctttctttatgaacagcaaccgtacctttgcctgttcaggtagtaagtgattacttaaaaaatactatatttatttgtcaataggctgtgacagttaagaacacagtataatttctacttttaagaaacttaaaaattagtttgggccataaaacatgaatacgaagaaaagctagagaacataatcaagtgcatgataatgtaggacaaatagtataataaatgtttatttaactgaaggttaccattatacagagaaacctaaataaagttattaactgctggactctactacagaaaatacaaaaacattggcggttgtttatatcaacaacttgagtgtttcagaaaccaagtcaaagaataattgataaaaatacaaaaagttaacacttcagcaggctgggcacagtgggtgacacctgtaatcccagcactttgggaggccaaggtgggcggatcacctgaggtcgggagttcgagaccagcctgaccaacatggagaaaccctgtctctactaaaaatacaaaattagccgggcatggtggcacatgcctgtaatcccagctactcgggaggctgaggcaggagaatcgcttgaacccaggaagcggaggttgcagtgagccgagatcgtgccattgcactccagcctgggcaacaagagcaaaactctgtctcgaaaaaaaaaaaaaaaaaaaaaaaaagaatgcttcagcaaaaaccaccctgaagctcttctgtatatgtatgttaattgaatacagttataatattatactcacagagtgttagggaggaaaaaaagataagtgccagctatctcattgatgttgcaacaaaaagtattaagtactatcttacagtggattactgaagaagtttcaaaaagccggactaaattgtctttttgttttctaagattaacttgaatggctcttacactaaaatgacaagacccttcactttaaaataagattagttataatgacctcaaatgtaataatttactccaagccaatcagttatctgataccattccaaaggagtataatttgattagaagtacatatttttgaggtaattaaaagtagatttaacccacccagtaagtgttatcatatagttcaatgcattatactggtatagcactttgtttagatttctttttctttctttttttttttttttttgagacagagtctcgctccattgcccaggctggagtgcagtggcgtgatctaggctcactgtaacctccgccccccaggttgaagcgattctcctgcctcagtctcccaagtagctgggattacaggcatacgccacgacacctggctaatttttgtatttttagtagagacggggtttcaccacattggccaggctagtcacgaactcttgacctcaagtgacctgcccaccttggcttcccaaactgctgcgattacaggcgtgagccaccgtgcctggccgagatttctactatgtagttcttactaacctacattgcacaatttatgcatttctcaccaagatgtgagcatctcaagagaaggcactgtatcttattcatccttctccatgcaatttggtgctcagtatatacctgacaaataataagttatcaaagatatctgtggaatgaatgaatgctcagcacactaaaataatgttaaatgtttaacttaaatctcaagtacattagagtaaagctaacatgaactcatactaatggtaataatagttaacactgagtgcttacaccatgcaaagccctcttctaagtgctgtactgtgttttaatttacttaaaccttataacaatcctatgaggtaagtaggcaagcagtattattgttattatcatcatccctatttttgaggaaatggaggcataaaaggccaaagttatttgtccaaggtcacagtggaggtaatactacattttataacacatggtaaaatttggggaggaatcacttaatttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagatggggtttcaccgtgttagccaggatggtctcgatctcctgacctcgtgatccgcccgcctcggcctcccaaagtgctgggattacaggcgtgagccaccgcgcccggcccacttaatttttgaagagctaaaaattgatacagcatcaatatggtgatgataatgctagaaaagtctacatgctggccaggcacggtgggtcacgcctgtaatcccagcactttgggaggccgaggcaggcagatcatgaggtcaggagttcaagaccagcctggccaacatggtgaaaccacatctctactaaaaatacaaaaattagctgggtgtggtggcaggtacctgtaatcccagctactcgggaggctgaggcaggagaactgcttgaacccaggaggtggaggttgcagtgagcaaagattgtgccactgcactccagcctgggtgacagagcaagactccatcgtggaaaaaaacaaaacaaaacaaaacaaaaaaagtctacatgttgtttcaaaatgtattataaaccataagtctacagatcaaaatatcagtatttatggcattttttgacctattaattgttgtaacttgaggatatatagtatatcatttagcaaaaaaattttgaaaaacaatgtcctaaacatggatgagtccaagagaaattaaatatgaaatactggaaatatcatgcatcaatgaaaaattgcataataaggtgtatctttatatagcattaaatctactttaaaaatgatttttagatatttctaagaacaaaatcagcacttactcctataatcactgtttagcatacttacctacgattgctataatatgtaaatcctacaaaaggtagttgattgccaacgaaagctttaggaatagggaatgtttcttcctctcctttatcttcttccaagtcatcaaaattactagtatcaatgtcactacttaaatcgggtacaactggtgctacagctaaagacaaaacaaaattagttgttcacttcaaacttaaaatacaagtaaagtgaagcacattccataccaactactgatggtttctctcttataaaaccttgcaaaccacaaattccacctggcttgaatcctattacatcaagctttaccaggactaaaaatcaactgataattgatcattatgtaattctatgaaacaattatcttcaaagtcacctataattatctataccttgggtttaacttgactattacaaatcaagtattactaaggtttgttttagaatgtaccaaggtataaaatacacaaaagcattcgggactacagaaaagactttttagaaactaaagcataacaaactgtactcgaaaaaattgtttagctttaaatatagtattttttggttaatctgctgtatagtaaaccagaaattaaggttacttcttagcttcctggacatcataatttggtactgaaatatttttactcactcagaatccagatgatcaatactcctttctcccaccccaatatctccataagattaagccacaggagcaatggatttggaattgtattttcagactagctacctctagaatcaagtgattaagactaatgcagtgaggtatttatgatatcattgttaataaaaaagggcagtaatataaaaaatggatatgacatcttcaagaattataaatttgatgtggaccaagtcttccagatacttaataatataaaaccgtatgtgacaacgtttaaatattcataatataggagaaaattccatataaaactaatactactaacatctatttttggggcttgaatgttacaaggggtacatctaaaaataaattctaagaaaataaaattttaagaaaatttattttttagcttaaagatactgtagtataataaaacatccctgaattatgatcatcaaaatactaaaaaattattttaggtacaataacctcatgttcttttagggaaaaggaatcaattttcttttcaatcacctgggtatttcaggcaagaaatacctattcttgtgccatctgagacacagtaaattaatatttagggaacgaaacaacacatttagccaaatgaagctgtagtactaacagtaacacaagagggatattagggcttttccaccattccactttccttaatggccaacagaactgtctgattagacatggccagctttctaatatttgtaaaatgaggtgaaaacactaaacagttgccgcccttgggaaatacagaagttaattatggtcttggcatacattttatgttaaaagagtgatctcaatcagagacacttttgcctgctggaaggtgttcagcaatgtctgggtacatattctggttgtcattaatgggaaaaaaggtgttactagcacctaatgagtacagtcataggatgccactaaacatccttaagtttaggataatccccacaaaaagaatgatctgtcaactgctaaagctcagaaaacctgctttaaaattatatcagaaagagagaacagagtaagtgtgctgcattttctcttgctgtttctgatggacctactctttttataaatgacactatttcacagtagttctaaaatgacaaattctcacctgtttaaattctgagatacaagtggggaaaatattggaagagttataaaaataattatttctgcttctaaattaagatgcttaggctttatataatgccatttaatcacttcagaactaataagaataaagataactatggaataaacatcagtatatatttgtttaaaaatttgttttcattaaataactgttaatttagaaatcatgttccataaaaaagagtccagcagatgttgtcaaaaatggcagagtagggaactcaaagaaatcatacctccactgaagcaaccattgagttggcaaaaacgaccagagcaactttctgagaactctggaatctaataaaaaactaataacaagcaaggagtgtttaatgaagaaagaggctataaaaatttggcatttaaggaaatctctgtcactggctgagataatgaaatggagatttcagtgaatacacatgacaaggaatacagattttgcaaaattagtttggaaaagtcactaaatgaatgaatgactgcagcccacaacaagcaacaaccgcaagccctgggggaaagaggaagaatctgatttccagagttacaacactgtaatatccaaaatgtccctcttagaaggatacagctgctttaaaacaatgtccagtttacaacaaaaaattacaaagcatgtaaagaagcaagaaaatatgggccattcacagggaatatagaaaaatgttagaaaccaccaggcgtggtggctcacgcctgtaatcccagcactttgggaggctgaggcaggtggatcacaaggtcaggagatcgagaccatcctggctaacatggtgaaaccccgtctctactaaaaaatacaaaaaataagccaggtgtggtggcgggcacctgtagtcccagctacttgggaggctgaggcaggagaatggcgtgaacccaggaggcggagcttgcagtgagctaagatcgtgccactgcactccagcctgggcaacagagcgagactccatctcaaaaaaaaaaaaaaaaaaaaagaaaataatatagaaaccacctctgaggaaaccaagatattagatttactcaacaaaatcttaaactctcttaaatgtgttcaaaaagcaaatgaacactatggatgaagtaccaggaagatgatgacttaacaaagaaaaaatatcatgaaagagatcgaaaatagaaccaaatagaaattctagcactgaaaagtacaatagctgaagttaaaatttcactagaaggcttcaacagcagatctgaacaggcagaggaaaaaaaaccagtgaacttgaagataggacaaatgaaattatcaagtgtgaggaacagaaagaaaaaggatgaaaaagtgaacagagactaaggaaactgtggcatcaaccagaccaacatacacattatgggagttccagaaggagagaaaggggcagaaagactatttgaagaaataatggccaaacctttccaaatctggtaaaagatataaatctacacatccaagaagctgaatgccaactatgaaaaactccaaaagctccacatgaagacacatcataatcacatgccataatcaaactgtcttaactcaaagccatatgaagaagaaaaaggagtatcagtaaaggtaactatttagataaatgtaaacagaagcaggtttttaagctactcaaagtaaactggtatcaattcaacctagattgttttcaatttagaatgttaagtgtaattccacgttaactaataagaaaatgactaaaaaatatacagaaaaggaaaagaagaaggaatcaaaatagcatactaggggaaaaaactaaacacaaaagaaagcaataatgtattagctgaggaataaaaaggaaatatatgacatagaaaacaaataggaaagttttttttttttttttttgagacagagtctcaaaaacacccaggagtgcattgcactacactccagtgtagtggtgcaatctcagctcactataacctgtgcctcccgggttcaagtgattctctgcctcagcctctgatgtagctgggactataggagtgcaccaccatgcctggctatttttttttttttttttgtagagatgaggttttgccatgttgaccaggctgatctcgaactcctggcctcaagtgatccacctgccttggcctcccaaagtgttgggattacaggggtgagccaccacacccggcctacagtgacaaattagataacttagatgaaatagagacattcctagaaaacacaggctgacaaaatctattttaaaagaaataaagaatcaaaatagggccatagtggctcacacctgtaaccctagcactttggaaggccaagggagggtggcttaagaccaggagtttgaaaccagtctgggcaacatagcaagaccccagctctacagaaaattaaaagaaaattagccaggtgtggtgacacatgaccgtggtcctagctactcaggaggctgaggcaggaggatcccttgggtctgagagttcaaaaatacagtgagctaagatcatggcactgcattccagcctgggcaacagagcaagaccttatctctattaaaaaaataaaataaaatgaagaaaaaaaacccatatgatcatttcagttgtcatacaaaaagcatttgacaaacacaacaccccttcatgattgaaaacacctggccaacaaggactagagaggaacttcctcaatatgataaaggacattaatgaaaatcccacagctaacattatattcagcggtgaaagactaaaagcttccccctatgaccaggaacagacaaggtgcccacttctaccactgctattcaacactttactggaagctctagtctgagtaattaggcaagaatgataaataaaaggcatataaattggaaaagaagaagtaaaactatctctatttgcaggtgacatgatcctatcatagaaaaccctaaaggagctacaaaagaatatattagaggtaatagacaaattcaacaaaattgcaggttacaagatcagaaataaaagttctacttctatatactagcaataaacaatatgaaaagaaaattaagggaacaattccatttaaaataatgtcaaaggccaggcgcggtggctcacgcctgtaatcccagcactttgggaggcggaggtgggcagatcacgaggtcaggaaatcgagaccatcctggctaactcagtgaaaccccgtttctactaaaaaaaaaaaaaaaaaaaaaaaaaaaaaattagccgggtgtgctggcgggtgcctgtagtcccagctactcgggaggctgaggcaggagaatggcatgaaccctggaggcggagcttgccgtgagccgagatcgagccactgtactccagcctgggcgacagagcgagactccatctcaaaaaaaaaaaaaaaaatgaaaaaaaaagtcaaaaagaaatacctaggaacaaatttaaccaaggaggtgtaaggcttatgcaccaaaaacttaaaaacgttgctgaaattaaagaaggcttaaataaatggggacacatcctgtgttcatggactggaaaagataacattgttaagatgataatactacccaaagtaatttaaagattcaatgcaatctccatcaaaatccctatgtcctttttggcaaagacgtaaaaacccattataaaattcatatgaaatctcatgagatcccaaatagtcaaaacaattttgaaaaagaacgaagttgaaagactcacatttcctgatttcaaaacttactacagagctaccataatcatacagtgtggtaccaacataaaaacaaacttatacagatcaatggaatacaacaaaaaccccacaaataaaccctcatgtatatggtttaatgattgatacaaggtgccaacaactttcaatgcagggaaaggacagtcctttcaacacatagtgttaggaaaactggatatccacatacaaaaatgttaaattggacccttactatacactatataaaaattaattcacaatgggtcaaagacctaaacatactagctgaaactataaaattcaaagaaaacataggtaagacatttcatgacattggatttggcaatgatttcttaaatacgaagccaaagatacaagcaacaaaagaagaaataaaccagatctcatcaaaattaaaaattttgtgcttgaaagcactaataacagagtgcagagaatagaaaatatctgcaaaccatgtatctgataagagattaatatccaaaatttttaaagaactcctataactcaacaacaacaaaaaaaccaaaccaccaaattttaaaatgggcaaagaacttgaatagaaatctctcaagagaagatatacgaatggccaataagcaacatgacaagatgtttaccattcctggtcattagagaaatgctaatcaaagccacaatgagataccacttcacatccattaggatgactactatttaaacacaaaaaacaaacaaacaaaacagaaaagaacaaatgctggagatgtggagaaaccagacccatgtgcactgccgttgggaatgtgaaacggtgcaaacattgtggatactattatggcgtttcctcaaaaaaattaaacatatggctgagcgtggtggctcacgtctgcaatcccagcactttggtgcactgctgctgggaatgtgaaatggtgcaaatgttgtgaatgttatggcatttcctcaaaacattaaacatatggctgagcatggtggctcatgcctacaatccctgcactttgggaggctgaggcaggaggatctcttgagccctggagtttgagactagcctggtcaacacagcaagactctgtctctacaaaactaactaattatcatatgacttagccattccacttctaggtatatactcaaattaatagaaaacagggatattacagaatatccatatatataacattaatatggatataaaatatccgtaatataatatggaaagcagatatttgtattctactgtttgttattcacaatagctaaaagagatagcaatcttaagtgtctattaacggataaatggataaacaaaatatagtatatccatacaatggaatattatgatacatgctatgacatgaatgaaccttgaagacattgtgctaggtgaaataaaccagccacaaaaagacaaatattatagtaatctacttaaacgaaacaccctgagtagtagtctaattcatagagacagaaagaatagtgattactggacagggaaatggagagttactatttaagagtttagtttaggatgacgaaaaagttctggacacagtagaggtaatagttttaagacaatgtgaatgtacttaatgccactgaattgtacagttaaaaatgcccaacatggggaattttatcttatgcatactttatcacaatacaaagagataacttattttttaaaaatccattataatgttcagaacgtctaaactcctaagtaaaagagccctgaaacttgctaggccttcagttctttattcacaaagcccacattgataatctctcccgtgagaatgtaaaattcaaacagaaaggttactagtcttgattaactcacagaacctagaataatatatatgtgtgtacacaatgagttttgagccggcagaagtattaccactgttagcatcttgtgtgttgcccacaaactataggttgattaagtaacaccaatatcttatttcaaatgagataataatatatggcaaagtgttttgcaagttaccacatatttaatgtagtattattaatttttctaaagaaacagttattgttctgttgcccaggctggaatgcagtagcattatcatagctaaccgcacccttgaactcctgggctcaggtgattctcttacctcagcctcccaagtagttgaaacataggtgcatgccatcacacctggctaattttttatttttatttttatagagatagggtctcgcaacattacccaggttggtttcctggcctcaagaggtcctcccaccttggcctcccaaagtgctgagatgacaagcatgagccactgtataatactgtagaacactgtacaatagagccacctggccctattcattattaatattaatatgttaaatatgtggtaactagcaaaatcctttgccatttatttcatttgaaattattaatactatgttaaatactaaatataacagtattattaataatgtatgctaaatatgtaataaatgttattttttttcccccaaatttaactgccaacaattgtcaattccttccatttttgatctatataacactgaacaggtaacgatctttaaatcgtacatggtacttcaaagatcaaaggctttggagttaagagacttagatctgaattttgacattgttgtttgcttgcagttatgacctgtagtaagttatttaggtcttttcatttcttttgtccttctcctatctttgatcttactcatgttactccttcaattttatctcaaatgagtggaaaaatagtgttaaaatcttcatactttgtgaacaagatcaggaagctcatggaaattctgccaaaaatcaagctattttgtatcctgctcccacattaccaaggaacacaaggtgaagattaattgccattgcaatgtggagacatgttaagtggtaaaaataccaaaaaaaactattatttgtattagaaagcaattttgccacggaaaatggaaacccaaaaaaattaaaaggaattataactgttacataagttttaaaaatttagcaggtcaaagaggtcagttcagaataaaagaattcttggtattttaggggtgggaagtaaagaaggggtaggaagaggggaagggaagcaaagaacaataagttctacagatttcaatttttctttgttttttccaataaccacaaaacaggacctcttagaattaggaaaaactaccaaaattcttttaagtatgctaaatctaaccacgctagaataaaaccatagataatgcagatcttaagtagttttatgaaggaggtacagcaatataataaaatgccactgatctggactccctaattccataagactatgagctccagaagggagaaagaaaacttttggtggtttgatcactgctgttttcccagtgtctgaaattgaacagtgatcaatatacaacaggtgttcagtaaatagttgttgactaaattacctcctctttcaagtgatcggtttttcaatacataaaaggaaaaatatccttgttacttttgcggttgatttattgtgtggttattctataattatttatgcattgcttaactttgaaaaagaatttaaagcaatacaaaatattattttgtattttcttcagtccccttcaaagttttattcagatttataataatatttgtacgtcttcagccttcttaaactttactaagagaataacctgaataaaaacacaaaaagtgttttgatgtaaccatttctcactccctgatcatctctttgtcatgcaacaatttcacttgcagcatgaagataataattatgtcacatttaattctgaagaggaggaagttccttatttcctagtatataattgctaataaaattctcccaaagtcaagctgctcttacagcttctcagacagctggtcattcaatgatgttctttgttgtataatttcttaatttccagaggatttattttccctttctcctccttagacaattttatagctcagcacaatgtaagtactgtgctatagtacttgaaggcaatacaattgttcttttaaaatatttgataactagaatgcttcactaatattagcaaacctacatgatttatttcatcagaattaacaagatttccatctctctgcaaagtactatccttcactgtctcaactagataggcagtccttaagacaaataactactgtgtaactttctaaaataaggtagctgagttcatttccattgttactattcactgctattgctaaggcagcaagttagggactgagatacattatcctttctctgatagatgaacagggaaaaaaatcctaagatgtcagcaggggaaagatgaattctttacctcccaaatccacgaagatgatgagaacctttggtgtcatgataattttgattcagctatgttgtagagttttctgtgaatcatcttgtaattttaactttttttaaaaagtaagaaagtgttctaaactgactgaaaattagtttcttatacaatacatttttgtttctgaattgccagctgcaaaagcctgatggaatcaagtatatcacaatatcctataaactcataaataaaattaaattgaattctggaattaataatagaaccttcttatattttgggttttaataaaaacaagagaataacttgtcttctcacaaaaacatatattttaatctcattacttactacttattgaccacctccataataagataactaacgcctaaaatgaacaattcaacaaagatcaaatgtaaaattatgactggtgagcctaaatccattacatttatatttcatctgggtatcctgcgtgggacataagaggagtaacaatataatctgcccaatattatcaaattaataggttaggacaattcccatatagtatttgtggcttctgattttcatcagatacacacaaatatttagcaatgtagtttcaacaaactaccacaactactttcaaatattcactaaaatatgaaagaaaaaaaaaaacttactgtctcggagcgtttcccaagcccactggtcatttttgaagaagagatgtcgtttgatttcttctacaccatttcgccctaacctcacttccctgaataatgacagaaggagaaaagtaatcaatcatttaagatcttattataacctgtccaggtttatttgtgggcaggatattaaatcagtgtaggacgacaaatatagttctaaggtgaaattatattgtcagcatagtatcagcccaaatagaaaatatgttaaagattgagaacattaaagaatttttttaaaagaaaactaaagaaaggctggacatggtggctcatgcctataatcccagcactttgggaggctcaggtggggtggatcacctgaggtcaggagttcgagaccagcccagccaacactgtgaaaccccatctctactaaaaatataaaactagcgggtgtactggaacacgcctgtagtcccagctacttgggaggctgagacaggagaatcgcttgaacccgggaggcagaggctacagtgagctgagattgcgccaccgcactccagcctggatgaaacacagcgagactccgtctcaaaaaaaagaaaactaaagaataactacaaaaaacacccatgacttttctactgacaacaaaaatccagattaatcaccaccttacttcattagcaaaatgaataaagcaccatgcattttcttgacagttttttgtgtgtgtgtgttatttttttcttacaatggtaaagttaggcttttttttccccaaccaaaactttacttaggcagcaataccagatgctaccaaaaacctccagaaacacatttaaaattttgaacttccaatttataatctattaattatttctgaccattcaaaagccaatgactactaattcttgatactgccacagaattcagagctttcactggacaagttactgataccagcctcttttttggtgagcaaaaagtttttaaaaatgtgattttagctgaattggaaaaagaaagttagcaccttttttccctagtacagtgcttataaataaagaaaatactctaaattctaagtttttgcataagctaaaagataagttggcttagacatgtgacaatttttccaagaagctttcactaactctcaaactggattagaaaacctctccatggttctccggcacatggtacttatctcatggtaattagctgtgtgtactataaatgtctgatttgcttatctaattcccccaaaggactatgaggtatttgagaaaagtggctctgtatcttcctcactactatatccctagcacctaataaacagcataatacaatgctttatattaaaatgtaaaaattggccaggtgcggtggctcacacctgtaatcccagcactttgggaggccaacgcaggcagatcatgaggtcaggagttcaagaccagcctggccaacatagtgaaaccctctctatcaaaaatacaaaaattagccaggcatggtgacaggaacctgtagtcacagctacttgggaggctgaggcaggagaatcacttgaatccgggaggtggaggttgcagtgagccgagatcatgccactgcactccagcctgggcaacagagtgagactctgtctcaatcaatcaatcaatcaatgtaaaaattagccaggcatgggtggctcaggcctgtaatcccagcactttgggaagctgaagtgggaggatcacttgatcccaggagtttgaaaccagcctgggcaacagagcaaaaccctgtctctatttaaaaaaaaaaaaaaaaaaaaaaagtaaacatttgaaaaaccatacttcaagctctaaaggacataatgaagggagacaagttaaagcaaatctcaacttgaaacatatttaaaagtactaggtctccctaatatttaacaatatacaatcataaacattaaatataatcttactaatacatctggttcactttcaaatttcaaaagtaaaccacaaaggtatatataatatgccatttttctttcaaaaatgcagacagacattattattaaaatgcttgttggatctacaagatggaacaccaactattatgtctagaagaaaaaagatagtatacttttaaaaatggctttatactattgactctttcaacaaccatataccatacatcatcaaatctaaaatggtttaaagtataaggtgtatcaccgtttttataccactatgaaaaaggatgctcccaactcataccattgactgtgagatgtactctaatttcagagatgttatgttaaaaaatttttttagattcagtaaaatacacagtaatttttataattaaccaagttaaaaattgaacaataaaagaaaaaagtcatctagtttagccatcagccaagactgtattattatcacaatttcttaggtatgataagtgagttgagatctacaaaagacatctagaatatcataaaattacatcaggtttcactgtcatttatattctaacaatttacatgtagaagctcagatatggaccttaaaaatggagcagaagatgagaagtcctcagaattaatacaggctcagttttaaaattatttacctgtcagtaaggaaggcacaaataaggttttttgcttcttttgatatgtcattatcatcaggaaaggtaagtgaatttttatggttcataattttactgtaagttccaaccaaagaatctgcataaaaaggtgtatcacctgaaaaattgataaagaaaacaaaagcaaaatgaaatacatttttaaaaagtcagtttcaaaggaagagtcaaagttacccgtttaaaaagattattaggtatgtattaaactaaaaacatacacctaatatataaaagaacacatcacaaagttgctctaagcctctaaatgcttttaaaaacacatacgaagcaggtttggatcatgtttattacccacaaataaaatcaagattgcttaatataataaatatattagaaagagccaagtggcaagttttgagatgaacaactgtaatagagagacataaaatcttccttactcacctacaagcatttcgtataaaaataccccaaccgaccaccagtcacattctcttccataataaccatcaccaccttgggattttaatacttcaggggaaatataatcaggtgttccaaccgctgtatcacatcgtaccatgccttcctaaaaagcgcggcaggtcaaattttgaattaggatataaagtctcaattatttaaaatgactttcttattaatattacctatgggactccaaatctttgagctataaaatatcatatattaaaactgaatggaaacctgacaaaaattaacacagcttaatcatatatatacatactatatacacaccatatacatatataccatataatgtatgtatgtgtatacatgtgaatgcatatacacacacattatatgtgtattcacatatatacacacaccagtgattattttgtaataatgctcactagaaaaacatactgccacatttattattccccaagttgtgccaatatcatgaaaccatttaactgctgagaacaagtacacaggccagtgcaaatacactggggagttcataggatagggcattttacaacatattggtataaacactgacttcattattttctactaaaatagctatttaactatgtttgaaactacaaaagaaacatacaaaagctgactgtacaaatacaaactggggaagcatatgtatgggaaaagggcataatagtgtaaagcacactgaatgtctatttgatgtgaattttaactgccctcccccaacaaacctgagagacttgttagctgttacctatattcgctggtattaatgaaacagcattataactaaatgttcatacagaagttctcatgcagtgtttccttcactgtgtatatgaagtgaaggaataacatatacacagctccttcagctccttcagctgtgtatatgttatttattatataaataacatatttatttatgttatttattatatgtatatacatatacataatgtatatgtatatacatatacataatatgtatatacatatacagctgtgtatatgttatttattatataaacagtgaggataggtatcttttaagactcactcctaaaataagcagtaaaatcttttatatgttaactgaagtaaaacactaaaaaatacacacattactggaatccaatttttatgaaagtctaattttaacactggcataagtatttagtgacatttaagctaattccattcctagttaccagtagtgtatattagagttgttatgaaggatttagtaaatctggcaatccatatttaccctaaatagagaggaaaaaataaatcactaacaagttactaatacaacattgaaaccatggtatctagttcaacaaataaggtcatattaattctggacaagtccagctatggttagtaaattcttacaccattttctaaagaattcttaaaccattttctaaagaagcatctaccttgaattagcaaaaactaaattaaaatctagttaattaaccttattcatcttcatacaagtaccaaaatctgctaacttcaaatgtccagatttatccagcagcatgttatcaggcttcacatctctgcaggagggaaaaaatagtacagtattttctgaaacagattagacactgtaaaaattatatgaggcagttattttaggtcaagcatcctcaatctaggtaaggccatctttgatctgtatgtgttctctatccacatctataaattaaatttcatcaaagaaacttctttatatgttaatgcctcagaagaaaacatatatattccttttttaaaagtttcattctttcagagggaaaatcaaatcatttgagagagacagaccatcaaaaatacaacactcagacataaaaggtgattgaaacatattagataggtaagtacataaaaaaaccccacggcagggtctaagtcactttcatttttgatccctgacatgtaggcacagcaactgcacacaggattcaagcagtgtttgtacaacaaatgaaactattcgtctaatgaataaatacgacctattcactaattaaaagcaaattaagttacatatttaaaaaattaacatcaaagtgtttaactcctggcacataccttagaaaactagtttacaagttttacttttcagaacaccatttaaaggctatatgatcagattaagggatattaaagaatacatttatatcaacattaaattgaaatgctaaaattataaacttcaaagtttggagttctttttttccccccttcctgacatagaatctcactctgtcacccagtctgaagtgcagtgactagatctcagctcactgaaacctctgctcccaggctcaagcgatcctcccaccttagcctcccaaggagctgggaccacaggtgcatgccaccacacctgtgttttttttttttttttttgtagagatgggtttcaccatgttgtccaggctggtgtcaaactcctgagctcaagagatctgcctgcctcggcctcccaaagctctgggattacaggcgtgaggcagcgcctggccagagtcttgagttctgaaaggtcacttatgtcatacggaagaagaatgggtgaactgagagtaagaaatgttaaagttatttttagctatttccctcaacaaatgagaaaatttaaagcacttttatctttacctgtgaataaaacccatggaatggattgcatccaatgcaagaactacttctgcagtatagaatcgtgcccatttttcaggcacatcatagttgctcattaagtttacaagatctccaccaggcatgtattccatcaccatgtagagataacgatcatcttggaatgcataaaaaagctatacaaatagaaaaaacaaacaaaacacattcattaatgttaaacaaaattgtttcacttaaaaagtggcaaaaatgttaataaaagatttaagtaaaataatcaaattacagaagttgcaagtctagttttaaaaaaagacaaacataaatgccacaaagacccttgtatatgcaaaatgactataacataattattcagaagagttacatggagatatcctttcttcataattttctacactatttgaatttcttttactgagaatttttttaaactgtaatattttcagtaaatatacaaatctcctaggcaaagaaatactgtatttctaatttaacttgtgcatcagtggggtctactattaaatttatatcaatatcacaatgctcaagaagtctttgataaatttggcttacagtttcagctgtttttttttttttttttttttttttttttgagacggagtctcgctctgtcgcccaggctggagtgcagtggcgtgatgtcggctcactgcaagctccgcctcccaggttcacgccattctcctacctcagcctcccgaggagctgggactacaggcacccgctaccacgcccggctaattttttgcatttttagtagagatggggtttcaccgtgttagccaggatggtctcgatctcctgacctcgtgatccgcccaccctggcctcccaaaatgctgggattacaggcatgagccactgcgcccggcctcagctgtttcttattagctgtgtgactagtaatttgcttaacctacccgagtctatgagactataatctcttctaaaacactgtaaggactatacttcgtttaacttttatacctgctgcttagtcaagtatccagatgcctggcggttagcaattgcttaataaaggcttaatgaaccaaatcataaactaatccataaagtaacagtgcacctaacagattaactgtctttcagggttgagggttgttaaaaaagattactgaatatagaaagcacttagtgcaacagatgctcaacaaatgacagcagtcaggaggaggagcagtaatagctaacacagaagtaggaggaaggcagcagctagggttcaaatagtaacagcaaaatccactaatgtgaaattagcgaggatatcaggcataaatatattatgtgactggggatcaaataaaaagaagggcaaatttataaaataacattttaagtaaatacaagaagtttagaattaaactaaaaaaaacaagccctagagaagatgatctctaatttacccagatgtttgtcttaaaatcttcttaatgtttcatttttttcaactgtgtttaataattttagttatagattcagttactttgttttgattttttgtttttttgtagagattgggagccagtcttgaactcctgccctcaagtgatcttcctgtctcagcctctcaaagtgctcagattacaagcatgggggccaccacacccggcccagactcagttattttaatgtaaaaaatgtattttgggggaagagagaaggataagaaacaaagtggcatttcatgactatcccagattaaagtatataatttgtcatttgggccccataaagaaatactgttaatttggtgacagtttcaccctatttatagacaatatatccagagaaataaagctctgaatacctaaattgtaaatagccctgaaagtaacaattatgtcacatattttttcactaacagacactgaacgttcatgtatcagtggttgttaactagtggtgaaaacatttttggttgtcacaactgtgtgtgaggtgggaagagtcactactagcatcccctgtgtagaggccaggaatgctgccaaacatcctaaataaacacattagtaactgaaataatataaaggatagcccccaacaacaaagaattatctggcccaaaatgtcaatagtattaagcctgagaaactctgatctacatagttggtaaaaacatagacatttcaagtttaaaagtactatggtgaccgggcacggtggctcacacctgtaatcccagcactttgggaggccgaggcaggcggatcacgaggtcaggagatcgagaccatgctggctaacacagtgaaacccgtctctactaaaaatacaaaaaataatagccgggcgtggtggcaggcacctgtcgtcccagctactcgggaggctgaggcaggagaatggcgtgaactcagggggcagagcttgcttgcagtgagccgagatcgcaccattgcactccggcctgggcgacagagcgagactccgtctcaaaaaaaaaaaaaaagtgctatggcataaaccttcaacatttttcatatccttttaattccaattactggtatgctttttaaggacagacttcattatatattataaataaatcacaaaaacatgttagaaaattagaaatggtctagcccagtttaacttcccccgtatgacattttgcattaaggatcccaatacataagacagataaaacatgaagctgaactcataaaagcagagagaaaactcagaattataatctacccaaaaccccacttgaccccatgattttgcctaaggtacctccacaattgaacataaccaatcaaagacaactttcagacttatgaacaaggaaattgtggcccagagatgttaagtaacatggccacagcttcagagaaaggcctatggcaatcaagacgaggacctaaaactactgacttctagtttttctttccactgaaaaccgaaagacaagtattatttggtgacctagcttaacttggtttcctctcactttcccttcatttctcttattatctcctcttcacaaaataagagacagataaatgaggagacagctaaacaaaatgagagcctcatgtttggggaaaaaaattcaatattaactaaaagtatctatttaaattttaataatatacgacttccctcaaatctaagtagattaagttttctatatcttctgtatttaaaaatatctaatttaaaattctgtatttaaattttatatttattatttttatttttgagacagggtctcactctgttgcccaggctggagtgcagtgatgtgaacacggctcactatagcctcgacctcctggactcaagtaatcctcctgcttcagcctccccagtagctggaaccacaggcgtgtaccaccatgcctcaataatttttttaattttttgtagagataggtgtcactatgttgtccaggctggtctcaaacccctgggctcaagctatcctcccgccttgtcctcccaaagtattcagataacaggcatgagccatcacgcccagcacaaattctacatttaaattaaatttcctatatataaattctacagaagcatggttattttgttctagcctttcttgctagaaatgattcaatacaattaaattttaagatttaaaaggtaattagacaattttgtaactgccagtaaattctctactactattctaaaacacaaactaagcttctcagacatgtttagttacaaactaatgcagcaataatgaaagagtagcaaagtcatacctgaacaacccaaggactgttggcaaaagccatgatgtccctttcttcccagaaaaaagcagaatcagatctctttatcatttcaaatttgctgagaagcttcatagcatataccttcctggtggatttatgccttacctttaaaattgaaaagggaaaataatgaaccttttgttaacatttaaagctcaaggtttcacagaacaatttactaagtgcttttaatacttgctaaataatttagccttactgtttcagttatttttatttcttctcttctgccaaattattccaagtagctaatgtcaagactttaattatcagaagtaatgttttaaaaaaatttttatttcctatattacaagacactttcccccctccacacggctatgtaagctgcttcctgtttataaagcttactgttctacagcattttagtctaatattaggagcaaagatttatcttctgatgcctgacacttcttttctgccacagatacttggggaaaacacttcccactatggctagatttgacactaggcttccataccctcaggcaacaatgtctaaaggaacttaaagcaacaattctataaaaacagtattttcccaaataatatgttaaacacacaagtggattattttaatttaataaagtccttttgtattctcattaaaataacctaccaattgaacttctccaaatgcacctctaccaatcaccttcactacttcataatcttcagctttcattcgtaaatctctgattttatttattgtgtctttatctgtatgaaaagaaaagtttatcattttaaatcactaaagcattacaactagcactacttattttacattcgagttcttaagaaacacaatgaaaaacaacaaacttcatgaagaattatttgaaaatatggtgaaacttgaagctataaagtagctaaatgttcaatttgctaagattttttaaagtaaattccagaataacttcattacaactactaaaggtttttattaatcaaaatttgacttaacagaatgttttaaaaacaaatattacactacaaacaaaagctgaaaataattagctaattagttcctggtattttaagtacacatcaaatctgaatttaggaaacatgagtagatattttagattaatactggaataaatttttctttttataaggtcagttttagtgatcctttaaaaaaagatgtaatttaagatatcaaaggcaaacacactaaaaaaaaaaaaaacagtaaattttccaactggtaatctttaatacttatagcattacatttctctatttgaacctagattttaacttgaaacacacagtgaaaatcactgcaattatttatataaacttgtcatactacaaactacaataattcacaaatccccactggatagatattctaattcctaatttggtcatagattaaaatagggctattttaatccacatgggtcaacactggcatgagattacatggaaaagcttcacatttcagagttgtacaaaatacacagcagctattaaacttcagttccagttcctaataagagctgtattaatattcttgttttccttttcaaatgcatttaaactcaagtgtttgtgtactttatgaccaataaatacatgtaacagagagcaaatttctacaaagttataagtacctttaattttaggttacatatccactgcaagatgcaccagaaagatgaacaataatcaattaattcgctgcacaaatatttctatctaccatacatcaggctgtacagcactggagataaataaacataactttaaaatgtagttcctattctttaagagttcaaactctagcaaataaaacagaaacaatgaaaaaaagaattcaaaaaatgtaataaggaagataaacagttttttgagtactaaggaggacacctaactaaagcctgctgggtgagagatagctaggaagactttctgtaaatgatggtacctgaaaaaagtctaaactgaatagtagcggttagctagatgatagagaatgaaagaaagaacaggccaggtgtggtggctcatgcctgtaatcccaaaactttgggaagctgaggcaagcggaatgtatgagtccaggagttcaagaccagcctgggaaacatgatgaaaccctgtctctacaaaaaatatttttttaaaaattagctgggtgcagtggcagtttcctgtagtcccagctactcaggaggctgaggtgggaggatcacctaagcccaggacgtgaaggttgcagtgagccaagatcacaccagtgcactccagtctgggcgacagagcgaaactctgtctcaaaaaaaggaaagaacaagtgaacaatataagcagacaagcaatgtaaaccaagcacagaggaactgtatctaagttctatgttgctggagtatcaagtttgtagtaaggactgacagaagaggctggagagccccaggtaagttcaggagcttgaactttacctatcagccagtagttacagtaataaaactaatatttaagtaccgaaaaccgttttcacattaaagtttaaagtagctctctacatgaaatagatcaaagaaactgctctgttctaaatgaggttaaaggtgtcagagaagagacagagcctcatctacttcaggctcttccataatacagtccctgaggaatgctctggaatctgctgggaactgagaagcaccactactatgggcaggaagccatgaaaaggaattatgatggataaaacaacatagtcaaacttacatttcaggaaaactactctaggaaatacgtagaagatgagttcaataaagtcaagacaggaggtggggagaattttaagagtattgtaataccccagatgagagagaaagttctgaacctggataatataatagcctgttacgttgaaaaaaagattcttggctctagctatgagctagaataggctgtagagtcttgacaaagaccgcagacaagtcatttgaaatctaaaagatctttctatgttctactgccttggattctagcttgttctaatacaggtttacgtgctaacaagtgtaaatgcctctgttggatggctttcaatcaaactcagagattctatggttctacttttcctagttcatctcaccaagggtccaacctagaactaataaagaacttaatggtaaaattctaagcattggactttagtttcccaaacactcaggactatgtattcacacctacccaaatctcaggatcttaaacgaagcctatttattgtaaagtagtcatgtaagaaacccactcttggtctaggggtactatatagcctgaactttgtaggcttatggctccattgagacagaaaacaatgcatgcactagaacagggattcccaacccctgagccgtggacctgtaccggttcatggcctattaggaactgggccacacagcatgaggtgagcagtgggtaggcaagcattaccatctgagctccacctcctgtcagatcagcagcggcattagattctcacaggggcacaaaccctattgtgaactgcacatgcgagggatccaggttgcacattccttatgagaatctttttttaatgcctgatgatctgaggtggaatagtttcataaaaccatcccgtctgccaccccccaacccccatcctgtccatagaaacactgtcttccacaaaactggtccctggtgccaaaaagtttggggactgctgctctaaagaaaaataataagtacataaataaatatgtaacttaatttcacattgtgatacatattctaaagaaaataagaccaagctttcccaagtctgtaaggggagactatatacacaggctaattcttcagtcacttcaaactctgcactgattcctcaaataaacaagagtcaaggaaaacaactcaaaattggttattttttaattgactattgatgccactcccaatacccccaattctttgagcagctattcttgcccaaaggctaacagtcttaggcaagtttttctctctgtacacatttgtttggctgctgcaatcacacaccatcagtgaacagctttctctgctaggctagtgaataaaccactcatacacttacataacattgcagcctcttttttttttttggtcaagcctgcatgaacatttttctttatgaagaaattttactgggatgagatactctgttttaaattttctattttttctcactgttgctgtcctatgagtcaggaagatcatagtgagtgcttagtctgggaatgtccaaagtacactgtattcctttagcacagctatactgtcattgcataatttaaaaaaatgctttgccacctaacttgataaaaataatccattctccattatgcttcaaaaaggacaacatttgggctgggcatgatggctcacacctgtaatcccagtgctttgggacacagaggcaggaggattgctcaaggccaggagtttgaaaccagcctggacaacataccaagacttgtctttacaaaaaatttaaaaattagccaggcccatggtggcatgcacttgtagtcccagctacttgggaggctgaggcagaaggactgcttgagcctaggagttcaaggctgcagtgagctatgaatgtgccactgcactcctgcctgtgtgacagtcttttaggggagggaaaaaaaaagacaacatttcaagtatactcttctcttcttgctttgacacatgcgtatgtactggtaatagaaaacaaataaaatgttgtgatatggtgatacatatagcactcaaaactgtcaagctgtaacagcatcactgtgatttctactgtgctgagcagcagtgtgaagcaaggagagcatcacatatggtcgctgttgtagctactcagcttaggtgttgtagaacaaaagcagctatacacaatacattttttaaagtgtagcaacgtcccaagaaaactttatttatggacactgaaatctgaatttcctattatttcacattcatgatattgtttcattatttcaccatcatgatcatgatgggctttaaaaaccatctacatatcaacttccaaatttttatctctagtctagtctctcttaaacttcaaacttatatatgcaattgtatattctttaattatatattcttttgacttttttttcaatcatgaaaaaatacaaaaaacatgcttagttcatgagccacagtggtgggtgagatttggcctgtgggctgtagttcaccaactcctgctctaataaaacccagtggccttctgagggcactgcttccccacagctctcaagtggggacctttacttttccacatgccttagacaaccgaccctgaaagtgggagatcccccacatccccacccctaaatctgctagctttgattttcattatattaggttgtatttcccacctctcattgttgctgtaatctactgactctcagaggtcaccacgtctcatcgctagacagttttacttcctgatttactgaacttctctccaatattctcctgttttaattcttaataactttaatatacccacagataatacttacagtaccttggcctctcaacacctatacttctctccttcaatgatcttgtcctctaccttaccttggtcactcatttccatggtcatatactagaccttgtcattactcataattataatcttccaacaatttcaattagaaaacttacactctctaagcactctcttatagctttcctgcttagttcctctagcatcttaactccaacaaccccaaccccaccaggacctccaatccattgattctactacactcatactttccctcgttgcactgatagcctctttttcctacctagccagcttaaattacatggtcaattattataatcactcccttgcatatacctttaatgtcatgagctctcttctgcctcactttacttagtttggcaaaacgacaatcctattatagttaaatccaactctccaactactctatgtcagcacccatgcagttgaatatgtctcaataaatacataaaatcacaatgactgatcctattttaaaattcataatcacaaacatcaagctggcccttagttctacttggcaatcctaaatttctagtcactctcccactctcctagagacgtatttcaagttttcttctttcttcacacacacctcccacagctctcccactgatcctcgttcacagctaatgatcttgtttggctactaccctgaaacgaacgaaacaatcagaagaaaactaccactgacttaccaccacttacacacttaactatcagcatgtacaagcatatattttgtcttttcatattttactatgggagactacttctatcttaacttaaaccctccactcatgcactagatgtcatcctttttcattactgtagttcaaggacattgctcaagcaattctcccctttctcctctattactaagctttacccctcctaaccggatcccaccatgctgttttctctcccatcttagggaaacaaaaaaaaactcttgatctcatttctctcagcagctactgtcccattactcaactccccactgcagcaaaatttctcaaaagttgtctataatttctgtgactaaatctttcctactatttgctctaaaatccacttcaggtcggctcttacctttctttcaaaactacttgtcaaagtcacaaatgagcatcatgttgctaaatccaatgaccaattctcagccctcatcttgatatatcagtggctttaacacttcaatcactctctcctgatacactttctttacttgactttcaggacacaacattcttccaacaatactgaagattttacttttcaaccttagtagttttcagttgccttggctggttcctccccttctctcagatttcttaacactggagcattccaaggctcagccctcaatggtgacttcttctctatctacactcacttctctggtgggctttaaaaaccatctacatatcaacttccaaatttttatctctagtctacatgtctctcttaaacttcaaacttatctattcaattactttcaaaatatatcctcttttgaaaaacatctcaaatttaatgtgccaaaaactgaagaaatattctcacccaaaacttatacctatgtgtcccacactttggccgatggctcaattttgctcaggacaaaaacctagggggcattcttgactcctttttttcttacactccacatcctatctttcaggaaaatatgttggctctctctttgaaatatatctgtaatctgatagcttctcaccctctacattgctaccatgctagaccaagtcaccatcatctcttccttggattactgtgatagactcttaactgattgccctgtgtctattctcaacatagggtgatgttcttaaaacacaagtcagatcatgtcacttctctgctcaaaagtctctaatgtcttgccatctcacccagagcaaaagcccaagattttacaatggcctacaagactctacatgacctagcctccccatttccttacctctatgatatcatcctacaattctcccccttgcctaatcctctccagccacactggcttccttgatgttcttcaaacaggccaggtacactctcctcccttcaggcctttgcactagctgctcctctgtatgccactctcttccctcagacatccacatggctaactccctcaactacttcaactcttttttcaaatgtcaccttttaacaaggcctaccctggccaccttacctaaaacagcaaacttctcagaacttccgatccttcttaaactgttgtatcttttcctatggcagattttgacctctttgttattcacaaaattagttttatgcaaaataatatttgcaaaatcacaaatctggtaagtcttccttcattctaaaacctccaaataggatgttgtgaccatctagactcttttagcaatttctgattgtcaactatattgagtcaggtgatgctggcagaaagctaagattcagagaagtgaaatactactatgcaacatattcagcaagaaataaaatgagcaaattgagtcataaataggaaccacagtcttgacaaccactaactagctaatcattagagctagtcgtttagagttaatctttctccaaatgatcacaagttagcaaaagggccagtgcaaaaaggctaacttacagcttctgggttaccaaaaattcaaaagcatttcaatcatatataaactcttcaatctaattttcaagaaagcaaatggatgatttttcctaatactgttttaaaaattggccaggcgctgtgactcacgcctataatcccagcacttcaggaggccaaggcaggcggattgcttgaggtcaggagttcaagaccagcctggccaacatggcaaaaccccgtctctactaaaaacacaaaaattagccggcacggtggtgggcgcctgtaatcccagctaatcaggaggctgaggcataagaatcacttgaactcaagaggtggaggttgcagtaagccgagtttgggccactgcactccagcctgggtgactgaccgagactctgtatcaagaaaaaaattaaattaaattaaaaataaataaaaatcaactttatacccagtaaattttacttctaggaatttatcctaaggaaatgagatacaatgtgggaccaagatatctacaataaagtagtttttacaattttaaagagcaaataatttcatatacatagagtattaggtaacatttaaaattgtgttgaatatttaattacatagaattatgttcagcatataatgttgtgcaaagaaatagaacaaactgtatacagtatatgaacttgattttctaaaaacataattatatactgatacacagatatggatttttttaaaggccagaagaaaatatgccaaaacaataactgcagtcatctctgagtttggtgagactacagattattctgccacattttctatatattttaagttttttataatgaccctttgttgcttttctaatgaaaaaaacaaaagatgtattttgcctaccctaagatcctagattataaaacgtaccattactttatgtaccactagagattctaagatacattctaatttcaaaaatgttcaaagtttttttaaatgtcacaataggtaaaatatcataataaacattatgtaccttgtactgtttgaccagaatactgctactctgcctaaaaaagcccagtatacattgcatacttttagagtagtgaaagcagccctaaaaagctcaaaaattaaacttatttgaaaaattcacaagaatgttatattcaattccataaaaatctgatttttcttttctttttccttgagacagggtctcacgctgtcatgcaatctcagctcactgcaacctccacctcggagttcaagcgattctcccaccgcagcctcccaagtagccgggactataggcacacaacaccatgcacaactaatttttgtatttttgcagagacacagttttgccatgttgcccaggccgatctcgaactcctgggctcaagtgatctacctgcctcggcctccgaaagtgctgagattacagatgtgagccactgcaaccagcactgttttaattaagaaaattatttcatgtccaaatgttcaaataaaatcacactctaggaagatgtgctacattttgactgcataggcacataggcacgcatccacccacccacatacacacagagtaatccagtttgataaacagatcaacaaaaaataaatataaaaaatccagactcctaaattcaaactcctcaacatggcaaaaaaatatatatatatcattagtgactgtccagtcttatagttctagataagatactccccacaaccatgctctagcaatgcctagttatttgcaattatctatataagcccatactgcttcatctctctgtgcctttccagatgttatcactagcctaaaatgacttcccccaccaccttatctgaccaagttactattaaacaagatctaatcttttatctcctctttagacattcctgattccctctcaagcacaaggtatgactcccttctctgggacattatttccctatatttcacctaacaatctgaactggaattgtttctataggtctgtttcttctattacgttgtatgtccccacaatccttaaggatagagattatacttgtgctcgatgctactgaaatattaaaaacacttaatgacattatatacaaatggagataaacacatgctgcatttatctattcaggaacaacagaaaagccatatatatttactccaaagtaataaaagtatatatttaaaaatccatcttgagtttctcaaaatgttaaatatagaattaccatatgacccaccaattccacttctaggtatctacgcaagaacaataaaaacatatgtctacacaaaaacttctacacaaatgttcatagcagcattattcataaaagccaaaagagaatcaatacaaatgtccatcagctgataagcagataaacaaaatgtggtatatccatacaatggaatattactggcaattaaaaatgaaatactgacacatggtataacactatgaacaatgaaaacatgctaagccaaagaaggcagtcacaaaagaccattttattgatgattccttctataggaaatgtctctatagagtcggcaaatctatagagacagaaaatagattagtggttgtctagggctggaagcctggagagaaatggagactgactgttaatgggtatgaggttaccttacgaagtgatgaaaatgttgtaaaagcaactgtggtaatggttgcacaactctgaaaatacacatacacccaaaaagctcactgaattgtatacttcaaacgggtgaattttatagcatgtaaatgataacttaataaagttgctttaaaaaatcaatcttgagtttggcaatgatttttatatgacacaaaaagcacaatcaatgcagaaatataagttagatttcatcaaaattaaaatttttgctctatgaaagacattatgcaaatgaaaattgacagtagcaaatgcggcaaggatgcacaacaacagaaactctcattcattgttggtgggaatgtataataaaatggtatagccactttggaagacagtttggcagtttcttaagaagttaaacctgttcttagcaaacaacctagcaatgctacatctgtgtatttacatatctgcccaagtgaatttcaaactaaattcatggccggcacggtggctcacgcctgtaattccagcactttgggaggccgaggcagacagagcacctgaggtcgggaatttaagatcagcctgaccaacatggagaaaccctgtctctactaaaaatacaaaattagccgggcattgtggcgcatgcctgtaatcccatctactagggaggctgaggcaggagaactgcttgaacctgggaggtggaggttgccatgagctgagattgtgccattgcactccagcctgggcgagaagagcgaaactccatctcaaaaaaaaaaaaaaaaaaaaaacctaaattcatgcaaaaacttgtacacgaatatttacggcagctttattcataattgccccaaacaggaaataacgaatatgttcttcaacagaggaatgaacaaacaaaccaaggtatatccattcaatagaaggttgctctgcaatttaggggaaaaaaggaaaaagcaactacttcacacaacatggacaacatgaaggaatcttaaatgcttttatttttttttttttttcaaggcagagtcttgctctgtcacccaggctggagtgcaatggcgcaatcttggctcactgcaacctccacttcccaggtttaattgattctcctgcctcagcctcccaagtagctggaattataggcacctgccaccatacccggctaattttcgtattttttaatacagacggggttttgtcatgttggccaggctggtcttgaactcctgatctcaggtgatctgcccgcttcagcctcccaaggtgctgggcttacaggcaagagccactgtgcccagccttaaatgcatttttgctaagtgaaaaaaagacagaatcaaaaggctatacactgtatgattccatttaatgacattctggaaaaggtaaaactataggaacagaaaaagagatcagtgtttcccaggagtgggggtgatggaactgttccgaatggtattggggtgttgcagacaagactatgtgtttgttaagacccacagaactatacacactttatgcaaatttaaaaaatcaattgggattctgggggatctcaggatggaatccagattctaacaaatgaatctaaatgtatgactaacaagatgacatgccctcattgaaggtggtgagggaaaagaagctgaactacgtaatgctggaaaactgttttagctggaaactaaggctaaagacaaaaaaggaactgtacaaagatattgtgttccagttggtaaatccatttctcacagggtgtatggtttattttacatgaatattagggttgagtaagtaaataccaataatgggagccaggtttctcatcatcagagaaaaaaagttacaaacaggcaagggcaaaagctagaatgaatcttgtgatactagtttagagctggtaatatcagtctaaacacgtttaacatgtgtacaggtatagaattatagttatgtgtatagtcacaggctggtatacatgcatacatatatttcctagctatggcagctgagagggccttgaaacagtgatcaccagtagcaataagcacacctagcacccagatcttggtttctaaatatcattctccaataaaaggaaccagagctccttggaaaaaatggctgatttcagggctgagggaaaatataagatgagcctggagcatcgtgtaatgccagaaagtaaagaagtgttcctttttttaaaaaaagtaagaacatgtcaaagaacacaggagtaggagctgggtccaacctgaaggagctcccaaaaggcaaaaatgagaacaatttaagtaacaaagtattaggttggtgcaaaagcaattgagatttttgctaaaaatagtggcaaaaactgcaattacttttgcaccaacctaataaataacacactactggattacaacccaaagtatgaaataaatatatgcagtttatattatataaatcaatgactaaattaataaatgggggagaaaaggcaaatcttccctacagaattccaaataatacgtgtaaagtctcccctccaggagagtatggaaagggaatacgctcccctccacagcgtttggaaaaagaaaatggtaacttactagtggagaagcttgccagacactaccttaaaccaaatgataagcgttaacatcaccagtgatgtgcctagatttatgatggagttatgttccaatgaaaccctcataaagctggaaattttaaagtcagagaccacctggactttctagatcatctctaacaagtcagtatccaacgtctaatgcactgagctcatatataacaagtacttactatgctgtcaggtttggcagtaaaaacataaatgcccctgctctcatggcacttaaaatctagtgacaggagaaggagaaaaaggagaatggatactgtcttagtctgttttttgctgctataacagaataccacagaatgggtaatttataaaagaaaaaagggcatctggcaagggtcattcaatggtagacaagtggaagagtaagagcatacatgcacaagagctcacttttataaccccttcccacaataacagcattaatccattcatgggggtggaacccacatgacctaatcacttcttaacgtccccacctactagcactggcaattaaactttaatgagttttggtgggggcattcaaaccacagcaggtaccaattaaatagtcatacaaataaatataacctgtgataagtatacaagatgccatagaagtacatgctcagaaggtcagatccatgaagcctagataaccaagaggttagggaacaaaaatgaaggcttatttgaaatttaaaggatgactgctttgagttgggtgggttggaaagaattctagaaagagaaaaacaacatctgaaaagtcttatggaggtgtcatggtactttccaggaaataaatgtcagcgtgtagctgatgtgtaaggaaacaaggaggagaggtgtacagttaagaatgtaatttagaagcttagatagcatcaagtttagaaaatccaccaaaaagctgggaatggaatttgacttaaatttactattcaaaaagaatcctctggcagcaacgtaggtaactgtacataggcaaaagtagatgtattattgagactgaatggaagatttttgtgatcatttaaatgaaaatgaagaagcttaaacaatagttgtgttggaaaaagagggaaagtcaagcctctgtatgaagactgccactgttcagaaatctgcacttatcagtcttttctttggtttattataaccagaccatttacctatctttagttttttgggaactccatcattctccaaagtttctctaaagatcttcaatcacctcagcatgttaattcaataggtgtaaactgccttgatttagaggtatttaaaacactcaaactttctcctcttccttgaacttacttcaatttctttatctaagtttttaaaactcatgagaatttgaaaagaaaaaacaagcaactaagtaattttttttaatatccaacccattaacccaaaagccccagcctgccatttcagtctcatcccctgcagtccgtcctcccgaccctttctctctcattataaaccaagttcaatttacaccaaactcctggttcctcaaagatgtcatacttttggaagactctgtgatttaaatggtcctccctctcagaactgtccttcctccattgaaaaatctagcccatgttttaagactcaaatattactttcttttggaagcctttctttaccccattcaagatctgtgtatcattacattctctacaaacttctactattataaggtatatctgtgtgtgtttccatccatgagatggtaagagctacagtttctaagaaaaacagtcttgttcttcatgtctttagtaactggtcattcaaaaactatttcaagaatggtctcatgtagtgaaattatccttttctcacacatcttgaatcctaattctaaccaggaaggatgggagtagaagagagaatgacttgtaaagggcttaagagcttttcacaagttgtggctcattatagtcttctagcctaacacatttttaatagatttatactactcttttgtatttatccctggatatgtattcatacttctgatctggttcataaaactttataatctcagctgagaactccctgtggaagaaccttgctttctatggctgcaaccttctaatatttattgcttttgattacattttctaagcttggagcacgtgtctaactgcgcccactatttctttccttcatcaacataaagtcttaggcagttttgcctctcaagggatatttggcaatgtctagaaatatttctggtgatcacaactggggataggtgttaggatatgctactggcattaagaaggcagaggccaggggtgctgctaaacatcatacgatgcaaagaacagcctcccagcaaagagttatctgacctaaaatgtcattggtgccacttgagaaaccctggtctaaagtgaactgaatgctttgtctcaaggtctgtgtaacattctaaatgatcatcgcttttgatcactaactctgaatagtgattattcgcattactttctcagtaattgtactagtgccaaagcaaccaaaaatttaccaactgtactgtatgcttttatcactaccatagctattatgtcacttttgtaatctatattataaaagatatagtatatgacataaaatatcagttctgttttttttttaagccaaacaaatgagctctcttgcatttatacccggaggttcatgaattttcttcattcaatggtcttaccttctccattatcttcttttagactaagatttgtttgataaacatgtttttctattaacatataattatgaatcttgtaccctaaagtctctgtgacatccataatggtttataagcatatacaatcataatcactgttcccaaattttctctcccttcatcctcccaatgttctggctcccaacatgtgtcttcaaaactgtgactaactcccacaacaatcgcttaattttatcttggtatcatctctctaactcctatgaaaatgtcacctgaaatctttccttatcaggtatgtgaggctgataaacatcttctttgcagccttattatttaggtatcatacaccagagcccagaaaagtaaatctttatatttcactattcagtcaaatgttcacagattctcctttcccttttgtttccacacacttcttaacacaaagagataaaaattaacaggttgcaatataattaaacctgatgattaaaaattatatttgaggcttaatttaatatgacttaagctgaattttttaaagaaaaatattttatcccatattccaggtatattcttagatcactacatctgatatatgtcagcaaaaagcaattagaaacaaaacaaaaatttacctttaataaaataattttgatgtgcttgctgatgaaagctaaatctatataaaagaatttcagcggtatgtaaaatgctatcctatacaaatctattgctctgtgtgaaacataaaaacacaatgccagtaattgaaggagaatgttctaattatattgaaaaaataagtttgttatgtttatttacacttataacatgtttattcaccttgtttttgttcatgtctttaaattttattatgatttcatggtagccacatacattgttttccttaaaaaattaacttacatagaagtaattttttttcttgaagtaacatattggtttagaattaggctgattactaaatgagcattaaacttcatgttttttaaggttgagtttgttaatataactaataaacatagagtaaatgatgctttttgtatatagatttcaatgcatttctgactaacacatatactcatgtaatcatcaccacaaagaggttacagaattccaaggtttcttcatacccttttctaactcctgaagttttacctcaaccataggatttctagctcaaagttttgcatttccagcatgtcctacaaatggaatcatgcagtatgtagcctttttgtgtctggcttttttcacttaacagaatgcttctgagattgctggatattgcacatagcagtaattcattactttttattattcagtaatatcccactatgtggttgtaccacaatttatccattgatcagctgacgggcacttgagttgcttccagttttcagcaaacataaagttgccttaaacattttaatacagctctttgtgcagacatatgctttcatttcttttcagtaaatatctaggagcagaattcctggggtcatatagtaaagtgcatgtataactttataagaaacaaccaaactgttttccaaagtgccttaccatttaccagtcagcaatgtacagggttccagctgcaatgcattttcataaatacttgatattgtcagtttagaaagttttaatcattctaatagaggtgtactagtatcttattgtggccataatttgcaacttcctaatgactaaccaccatgaacagttctgcacatgtttactggccatttttacatcttctttggagaaatgtctattcaaatatttttcctacttttaaactgaactatttgtcttattattattgagttgttacacttgtttatatattctagataccagtcctttattggacatatgatttgctaatgttttcctattttgtaagttgtcttttcactctttttttttttttttttttttgagacaaagtcttgctctgtcgcccaggctggagtgcagtggtgcaatcttggctcactgcaacctccacctcctgggttcaagcaattctccttgcctcagcctctgaagtagctgggattacaggtgtctgccaacatgtctgctaatttttgcatttttagtagagatggggtttcgccatgttggccaggctggtctggaactcctggacagaactgatctgcccgcctcagcctcccaaagtgctgggattacaggcgtgagccaccatgcctggccttcactcttgatagtatctttgaagcataaataaaagttttttattttgatgatgtccagtttatctatttttcttttgttgcttgtgcttttggtattacgtctaagaaaccactgcttagtccgaggtcatgaagatttcaacctatgttttctcctaagagttttacatttttaacttttatattttcggttaatttttgtacatgatatgaggtaggagtccaaattcattcccttgcgtacggatatccagttgtctgaacaccactggttgaaaggactattctttcttcttttacatgctttgcaactattttttcccagcctttggcttatcttttcattttctgaacagtgtcttctgaagagaactattttaaatttcgataagtctaatttatcctttttcaaaaatggtttgtgttatttgtgtcctatctaagaaaaacttgcctaaggaaagtggcaaatatgttctatgttttcttctagaagtgttattgttttagctcttacatttacgttgatgatctattttgagttaatttttgtatacagtggaaactgaggcttgaacattgaattatcctgtcacctttgttgaaatcaattaaccatatacttgcatgcacaggtctatttctagatgctcttttctgttccactgaactatgtgtttattctttcatcaagactatactgtcttgatattgaccttaatcctccaacttgctcttacttttcgaaactgttttggctgttccaggtcctttacatttccatatgaattacagaattgctggtcaccttatacaaaaaactgtctgctaaggttctgagaatatacggactctatagatcaattaatttggggactgttaacattttaatattgaattgtacaatccatgaacattgaatatcttgttaggtcttccttaatttctgtctacaatgctgtatagttttcagtaaacaggtttacacatattttgtcaaatttactcctaaatttttcatgtttttgcttctattgtaaatggtgctgtatttgttataataaattaattcccaattgcttgttgttaataaatgtatgtgcaactgctttttggatattaatcttctaactttcaaccttgctgaatgtacttattagttcatgtagcttttttgcagaatcttgaggattttctatatggaaaatcatgctgtctaaattgggaaagttttacttcttccttttcaatctgtacggcttttctttattttacctgatggcactggctagaacttctaagacaatgttaaataaaagtggtaagagaggacagatttgccttttccaatcttaggggaaaagcattcgtcttaaacaagtagatacaatctaaactgtaggtttcttgtagattccctttattggggaaaggaagcttccttcacttcctagtttgcagacagatattttaaaattgtgaatggatattaaattttatcaaatgctttttctgcatctactaaatttcctttttaaaatatgttaatgtggtaaattaagctaactgatttttgaattttatactaacttagtaatcctggcataaactatccttggtcatgatttttacctactgctacatatgactgccctaaaattttgttatattattctctgcatttttctccaatttaaaaattaaaataaattgtacaggtttaccagttaaaacagtttactttagatttacacttttatttcacttatttctactaaagcattaatgtctctatttataaaatatacaagcatacttaacattatgaaagcaacaaagtagcacagtttaaggaagcatgaatttcattcttgctagccattactttaaaaaaaaccatgccccaccctctgcctttgtactaaggagcatttaccccttatctacaccatctctataaatgccagttaccattaagataaatagtcaagcctctccatctttttagttccttcactatgttgtcaggtagggaggtaagcaactgtaaatattaataaaattttactgctatgtccataggacatgagaaataattaaaacttttatacttaaaaacttctcagttcagaatctggcaccatattcaaaaacgaaaataaaacaataattttttaaaaattgaaaaactaaaagatcataaaattaaaaaattctaatacaagatttcaaagtatagaagtgatttaaaaaatcaaaaagatatgactatttagaaaaacaaaacctttgtaataaaacatatataaccaaaattgaaagataacaccaaaaccaatcaaacttacatgtatcaatatttatagttcagaaacagaaataaataaagtaaggaggactttatgatctaaatcttatcaattctttaagattaaaagtttgaaattataagttatttaatcaaatttttaaatgataaaatccaatctaaaaaggagccttcggaaaagaatatctgtaaaatttaaatataaaacagctttcatggagaaaaattctcatgtctcagcagttactcaaactcaatgtgcagttattcaaactcaatgcacagttttttgaatacttattttaactatttttcatccctttctcttcaaaatattttggttctcctaacaggcatccaaattgtttctttcacacttcctactaaattctatgtagaaatcattgatgaaatcaccaaaaagtaaatagaagaaaaaataagggcttgaatgacataagtgaaaatgtagttatatgaagtctgtcattaacctccacaaaaaattacttacatctgcttaaaaagttgtcaatatttttgttttttcttaaggcaggaaaatccaaatcatataccaaagcatccaatccatcctaaagaaacaaacaaacaatggttagttttttggatcacattatacagtctccttttttatgaaagaataaaatatacgctttaatatttaatttcccctaacacatcttgtgtacatttaacaccctctacaaggttagatgagtactgggagaaaagtggttttcatttcatatgcagttctttttaccttctaagtctgccaggcccaggggcaagaaaattaccacagattggctgcaagtgatttcaatccatgcacttttcccctcataaggacatgaaattttattttgcattacttctccttactactgcatttatctttatcttagacatcaaaaacctacatttgttactataaatattttataaggtaacagctaaataataataaaatgtgaggtttaatataaaataaatactgcataatcacaaatgcaagctatatacatttttaattataaaaatgtattagattgtcatgggtcttctttctttctttgaggcactttctagggaaagctagcagtaaaggacacacctgagcttttgcattttttctgctttttttttttttttttttgagggtcttgctctgttggccaggctggagtgcagtggtgcaatgttggctcaatgcaacctccacctcctgggctcaagccatcttcctgcctcagcctcttgagtagcggggactacaggctcacgctaccacacctggctaaatttcgtctttttatagacagagtttcaccatattgcccaggctggtcttgaactccagacctcaagcaattgctcctgtctcagagtcccaaagtgctgggattacaggtgtgagccaccacgcctggccgaacttttgcttttaagtggatatttaaatattatctaagcaagtgcatggcagtgtgaaggtataccaagcagtgttgaagtgggaaagcatctattcagactatatcctgctgcatggcaggaactggaagaacttcagataatcctaagcaatcttcactataaagtctcactctttagtaaatgttgtttgtataattgaatagcactatggaaaagaatggtttttgcgtgatgcttaataatgtaatcagttccagacaggtcaaaacattaaaaaaataaagaaccaggcaaaagcattttaaagaaaaaaatagtatatttacatgataccgttgggagaacaagtcacataacctttctgagcctcagttttcttttttgtaaaatgagggataatgattacaacacataacagatttgtgagaattaaatgagttaacatgtgaagtgtctggaccttaatagtctcacttctctctcttttatttctgttactgacatttgaaagctctgaatgttagtctccctattaacaggaatgacctacacagaaaacagacattttagtcacgtggtcataaaaccttaaaagtaaatcttaggtcatgatgttaaacccttccccaatgcagtaatccaaagtacttttgttgttgttacacatgggcatctgagttttgcgtgaccaagtatttgatcatgtgtttgttaatgaaaaatgagctgcctccactaattacatatagtcactaagtgtttggacctggtaccacacactttaattctacaataccatgggatagtctattacttttcagcatcacccataagcaaaacttgtgtgcctttattagggaaataaagttggcaagaatgtattcttctaacttaaccaaagcatataccaactgaggtttctaaggggagtcaagacactggggtgggagagagggatgcaggcttccattttaatgcagtggaaaagctgcacaatgcaaggaatgtgtatgtccaactataaatgaggcaggaaccttagcttttattcaatactctgaagttccataaaataatgcagataagacttccacacttcctaaaagtccaaattctagtaccaggactcggaatgttaacataacattcatccaagtgcaaaaacaattcacgaggaatgataatcaaaggatatacttccactgatccttcacttaattttatgatttaggcatgagcaaaactaccttctactttcacaacatgtccatcatatagcttaatcatcaatttaaaaatgtagaggaggccaggcacggtggttcactcctgtaatctcagcactttgggaggccgaggcaggcgtactgcctgagatcaggagttagagaccagcctggccaaaatggtgaaaccccatctctactaaaaatataaaaattagtcaggcatggtggtggtgggtacctgtaatcccagctactcgggaggttgagacaggacaatcgcttgaacccgggaggcagaggttgcggtgagccaaaatcatgcctccagcctgggtgaaagagactccgtctccaaaaaaaaaaaaaaaaaaaaaaaaaaaaaaaaaaaacaaaagtggaggagaaaatatgtaacagaggggccaatcaatgtcaaaaaattacagtaattaaattctttgctactaatagttgaacaagggtagtagaccagttgtagcagttacattttaaaagaaggtagttacataagagaagtattttcacatatacacacaaaggcaggcataatcaattaaaagtataacattttacagtgatctctaaagtaaaaacacttcacatttcctgagaagcactgatatggcagggggagcagggggaagaggaggtagaggtccattgtgttatgccacaacagagttcaagtgaaagcagaagcaaaagaaaattattcaacactactacaaactttagttttctggataaatctgaattaacaaatatgagtcaggtgtaaaacatcatttaggattaaatccattaaaagtaacacattataaggtatgagaatttaatggcactaggaaaggacagttacactattataagaaacattcatttttaggtaaattttcaaaacctaaatggttattattctaaacctaacagacatatttttggagaaacaccaccccaccctcaaaatccattgaaaactatggcagcaaaactggggcttctgaaaatcaaactacttctaaaatgggctgaccactggtactaaagactgctgaccaactttggtaagagaggatataccatttaaagaaaatgtttttggtatatgtagtagaatgttgttttaactaagtcccttaggccagatgctgtggctcacaactgcaatcccagcactttgggagatcgagacaggaggatcacttgaaaccaggagttcaagaccagcctagacaacatagcaagaccctatctctacaaaaataaaagtaaaaaaaatagctgggcgtggtgccgcatgcttgcagtcccagctacttgagaggctgaggcaggaagatcgcttgagcccaggagctcaaggctacagtaatctatgattttgccactgcactacagccctggtgacagagtgggaccctgtctctaaaaatcaatcagtctgtcaatctctcttcacttgataaagaaataattcatcaaaattaagcacagctatgaaaatgaaaacagaatttccttagggaattttaacaacctgatattaaatacagttaaaatctgtttaactggtgtgacattactatacccatgtcaatgctgcccaggacatttatagtcaataaataagtaaataatgttccaaattatctagtacaacaaacaatggctcttcccaatcagtctccaatcatacctttgtccagcctgtttctctacacatacatagctgggcttaggccacagtgtgctaccagccatttcccaaataagccaggctcactctaccctatggggcctttgcacctgctctattctcccgctggaatgtgaacattcttacattaagactgcctcaaatgtcccttactttgtgctgccttccccagtgccctgaggggaaatgttacataacctcctttgtgctattacagaaattatgtatttagctgttatactgtaattatttatttctaaatctgcctcctcttctgcaggaaagcagaaaaaaaatacttcctgtctctcagagttcagaagttagttagtaggtagaaaaagtaaatacaggatatcaagtgttataagtaggtactacataaatagagaaaaggctatttggggcttcacagagaagatgaaatttgagctgaaccttgaagaatagaattatgaaggaataagacagaagtggggcaaggcaatctagaggtgaaaagcaacgagaattcagagaatgaggatagaatgttctggactgggaaaggtgagaaggagatgaaggagaaggagtcaaagctgtgatgatcagggagagaatgttaaaggtataacataccaggagaagaatttaccttctgataatttggaaccacaggaatttctgcgggggagaaagtggcataactggtttttattttagtagtctggcaatgataaagatgataaattaaaagtagaagagacaggtggagatgaaagcaactaggaggatactgtggtaatacaagcataaaaggataaaagactgaaaaactgggtaaacaggaatggggcattagaggcaaaagaatctgatgaataattgaaagaggaacaggaagggttgaaaatgattatatgatcttcaagttgatgtgagtagacagtgacttcattaaccaaggcagataatataatttggagagatgataaatatttcagacacactacatctgaggtcctttgggatatcatttcatgaataactagatggcagctgaatataagtttgggtttaacagagagattgggactacaatacagatttgggagtcatgagagcacacttaaatccatgagaacatatgcaatcatccaacaagaataaacagggagagtagagaaagactgaagaatagaacactgggaaacactaacatttaacaggtacacagagcaggctgggcatggtggctcacacctgaaatcccagtactttgggaggccgaggctggtggatcacctgaggtcggagtttgagaccagcctgaccaacatggagaaaccccttctttactaaaatacaaaaaattagccgggtatggggatgcgcacctgtagtcccagctactcaggaggctgagacaggagaatcgcttgaacccgggaggcggaggttgcagtgagccgacatagcaccactgcactccagcctggtgacagagcaagactctgtctcaaaaaaaaaaaaaaaggaaagaaaaaaaagaggtacacagagcaaaaatggtggaggaggacacagagaagaaagacagaatagtaccaaggaagctgagaaggaacttaaaaagaagaaatgccttaagaatgaatttaaaacatctcaggaagtcaaacagaatagagaatgcaaaagaagccaaatcatttgccatttaaacatcactgatggtcgcacaacaacgtgaatgattaatgccacagaactatacatttagaatcagttaaatgggctaggtggctcatgcctgtaatcccagcactttgggaggccaaggcaggaggatcacttgaggtcaggagttcaagaccagcctggctaatacggtgaaaccccgtctctactaaaaatacaagaattagctgggcatggtggcaggcacctgtaatcccagctattcagaaggctgaggcaggagaatcacttgaacccaggaggtggagattgcagtgagccgagatcgtgccactgcactccagcctaggtgacagagggagagtctgtctcaaacaaaaaagaaacagttaaatgataagttttatgatacgtttgtgtgtgtgtacatatatatacacacataaaaatttttgtatttgtagtagagatggggtttcaccatgttggccaggttggactaaaatttctgacctcaagtgatcctcccctcttggtacatacacacacacacacacacacacacacacacacagagccataatttattttaagtcactatcagatgtcagcaaattggtggactaggaagctccaagctctccttcaccgacagaaacatcaaaagtaacaagctatctgaagcaggtctgcaatagttctggaaaatttaggtttatagcaaaaaacaagcaaatatccaatcaagtaaaagctatcccaaatggtaggaaagtgttatggcagtttacttgctcttgtcccaccccctgccagagaaaaggacagtctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccaccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaaggacagtcttaagtcttgagcaggtagcagactggttcctcctcttcctactcccccacaccttgaacccaagagggtagaataagaccatactgtgtatgttcattctatcttgtatgggagatacctgaaggactaaggcaagaacctaaactctgtttcacataattcagaacacaggcaggaaaagcagctggtgctgctcataaaggctacaaggaagctaactacaaaacctactgacacacctgaggtaaaagatgggggagtagggaggactaatggacacaacacatacaatagaccatctaggcccagaggagaagtggggcgagacttttttgggaaattagatgattcaaaagcagccatgtatacaggagaatataaaaagccgtgtgaagcccaggcaaaaaaagcatgctaaggaaaatcctgagaagatcctaagctctcatctcatgtgagtttcatcctgaaactcagaacaagcctagctaagtggtaaaggagtaccccagcagagggcaaatctgcaaagactgagaggtggttctctttttgttttctgaggcttttttggtatgtattggagcatctcacattcaaggaaatctctgtccaaacattagctgaatacaagctaaaggaaccaagacttcagtaatcactcacagtaaggaatagtctttgcaaaaacaatttggaaaagtctcaaaacaaatggactgcagtcatttgtactacagccatcagcaataaaaaacaaactggccaggcacagtggctcatgcctgtaatcccagcactttgggaggccaaggcaggcagatcatttgagcccaggagttcgagaccagcctggccaatatggcgaaaccccgtctctactaaaaatacaaaaattagccgggtgtggtggcgtgcgcctgtggtcccaaccgtttggggggctagggtgcgagaatcgtttgaacccgggaggcaggggctgcaatgagctgagatggcaccactgcactccagcctgggtgacagagcaagactctatctcaaaacacccacctacacacacacacacacacacacacacacacacagagagagagagagagagagagagagaacctagtgtggtaggagttattaagaaattattttaggcagatagagaggaaaaaaaagggtcctttggaaggtttttcgcagctcttgtctagcaggaaagcccggggcacctgtgctgtaatggcagtctgagtggatggagtttgagctctgggacccatcagtcctgctggaccatctgtgagactagttctgaacccagaacaaaagaccaaagcaggtctgtctccagtagtctccaccacaggctggacagggtcaaggtggctttgtcttgcttcctgggcattccttcttaaaatgccctgactgaccacattgataacagctagtggatgcaccttggggattcaggactttacaagcttgtaatgctgctactagagcctctgtttttctcttgtacttcctctccttttctcgggcctcctcccaatcccttttgtaaaagactgaagtggctattctcaggaggctttctagggtgctatctggttctactgcttgcttctgtagctttcttctaatattgggagctgcctgtgtaataaacttgtccttcaggatgagctgtccctcaactaaattggggtatagagaagtgtgctttattagtgcccctctcagcctttccataaaagctgtgggattcttgtctggtttttggtctatcatggacagtttggagtaattgagaggtttagctgtggtctttcgcaggccttctaatatacaccttaaaaagtgcttccttttccattcatctgctgagttattgggatcccagttagggttatttaccggaactgcttcccttccttgcaggagtgaagttttcacctcttcctcaccttccttttctcctctttttttccttggtctgctgtatggaggcatgttgctcacctccatatttttctgctgcctgcggaactgtctgcttttcagctgtagtgagggtttaacttagcagcaacataacatccctccacgtgagatcaaacacctgagttaaatttcagaaaatttctatatacctatcagggtcatcagaaaattgacctaagtctccctttgtttgcttaacgtcctgcaatgagaagggaacttgaacccttatggcaccattcccatcaggcatttcctggaggggtaagagtgaagaggggagagtaggacatactggagatggtggtgctgatggtacaactggagtggaaccggaagggttgggacttcagtagctgtcttagattgctcctctggagcccgctttagctctggggaactactccctgtgggtttgcctgccatggctactaaaagaactgggtcgattgtacagaacttgtaaaggtctgggttgtctcgcagagcaaagaaagcctgtacataggggacctcagtccatttgccctcctgtgtgcagaaaagttctaactgttggataatattaaaattaagtctccccaggccaggtttacgaagaggataggaaggccatgcccttgtgcagtagaatactgctttttcttcaaagttttagggtcgaaggagtcccagtgctttaaaatacactccaggggagtgcatgttgaagacgatctgttacccatctagaaagagaagtgagaacaaaagcgttctccttcctttcggtatgtgatccacgtgtgttcctgtagtttttttctaattcgactcgagacgaagaccctggtgttcccccactcatcaaagccatatcactagcaaaccctggagaatagagaaaatctaatttccaaaatcaccacattataacagttaaacggccaattttccataaagaaaccacaagatatacaaaggaacagaaaaacacggctgggaggaatgaaataaatgaacagaaaccatatccaagaagcccagacattggacttgataaagacattaaaaactgtcttaaatatgttcaaagagttgaaggaaaacacagaaaaggaactaaaggaaactaggaaaattatatatgaccaaaatgagaatgtcaacaaagagaaagaaactatattaagaaaccaaacaaattctggagctaaaaactaacactttaagtataaatggactaaactctccaatcaaactacagagactgacaaaatggattttaaaaaacaaacaaaaacaccatgatccaactatatgctgcccataaggaactcacttcaagtccaaagacaaatggttaaaagtgaaagatgggaaaaaatactccatgcaaatagtaaataaaaaaagcactgaggtgggtaggctaatatcagacaaaacagaccttaagttaaaaaaatggttaacagacaaaaaagacattacatattgataaaagagttaattcaccaaaaatatattatcataaatttatatgcgtcaaatatgtacatttggtatataaatatacaagccccatgatatgtgaagcaaacattgaaagaatttaagaaagaaatacatagttctacaaatagttggagatttcaataatccattttcagtaatgaatagaaccagacagaagattaataaaaaaacagaggacatgaacgacactataaaccaactggacctaacagattataaagagagagagagcactctatccagtaacaaaatacacatttttctcaagtacacatggaacattctcaagaatagacttattatgttatgccacaaaacaagttttaataacttttaaaagaccaaaatgacacaaagtatcttttccaatcacaatggaatgaaactactaaacaataataggggaaaactggaaaattacaaacgtggaaattagacaatgaactcttaaaactatgggtcaaagaaaaaatcattgggaaattagaaaatactttgagacaaatgaaaatgaaaatacaatgtaccaaacctagtaggatgctgaaaaatcagtgcaaaggaggaaatttatagctataaatgcttacattttaaaaagaaaaaaagcttttaaaatcaataaaaataacctaacttaatactataaggaactagaaaaagaaaagcaaatgaaacccaaagctgacagaaggaaagaataaagattaaagtgaagataaataaaacacagaataggaaaataacagagaaagccaatgtgacccaaagtaggtcttctgaaaagataaaattggcacatatttggttaagctgactaagggaaaaagagagaagactcaaattagtaatttcagaaataaaagtgacgacattcctatcaattctacaaataattgtaatagaatattatgaacatctgcacaccagaaaaaaagggtaacttacataaaatggacaaattcctagaagcatacaatctgccaaaaatgaaccataaagaaatggaaagtcagaatacaccaataactgtaacaagtaagaagacagaaatggtaataataaacctctcaagaaagaaaatccctgggccagatggctccactggtgaattctaacaaacatttatgtatttttatttgtttgttttttcctttttttgaggcagggtctcactctgttgcccagggtgaagtgtaggggcacagtctcagttcactgcaacctctgcttcctggacttcaagctatcctccagcctcagcctcctgagtagcttgtgtgagcaaccacacctggttaatttttttttttagggatggggttttaccatgctgcccaggctggtcttgaactcctgagctcaacgttatttgtttgccttggcctcccaaagtgctgggattacagattgtgagtaggcagtatgtccggcctctaccaaacgtttaaagaagaattaacacgaatccttttcaaactctttcaaaaaactgaagagaaggaaatatttcctaactcattctatgagtgcagcactgccctgatagcaaaactaaaaatatcacacaaaaattacatatcagagtttatgaaacatatgaatatagacataaaaatgcccaataaaataacagcaagtagaatatagcacatatgagaagaagtacacaccaggatcaagtgggatttatgccaggaatgcacagttgatttaacatacaaaaatattttaatgtaatctaccacattaatagaataaaggacaaaaaccacatcacctcattagatacagataaaatgttcaacaaaattcaacaccctctcataataaaaaacaatcaacaaacagggaatggaaagaaacttcctcagcatggtgaaggccacatatgaaaatcccacagctaacatcatactcaatgatgaaagactgaaagcttttctcctgagatcaggaacaagacaaagatgtcaccttttgtcacttctattcaactcattattggaagtttttgccagagcaattaggtaagaaaaagaaataaaaggcatccaaattggaaacaaagacataaaattatctattcacaggtgacatgatcctataggtggaaaactaaagattacacacacaccaaaacaaaacaaaacaaaaaaatccgtcagagcccataaccaaattcagccaagttacaggttagtcaatactcaaaaatcagttgcatttctatatactaacagtgaataatccaaacagaaacttaagagcagtttcatttataaaagcatcaaaacaaataatactgaagaataaatttaactgaggctaaagacatgtacactgaaaaccataaaacattgctgaaattatagaagacataaatgaaaagacatcctatgttcatggactggaaaaaatattttttttaatggcaatactactcaaagtaatatacagattaaatgtaatccctatcaaaatcccaatggtgttttttgcagaaatagaaaacctcatcctaaaattcaaatgtaatctcagatcacaaatagccaaaacaatcttgaaaaagaacaaagttagaggactcaaattcactgacttcaaaaatcactacaaagctacagtaaccaaaatggtgtactgctggcataaggacaagcacatacagctggtgctcaaacaacataagtttcaactgcatgagtccacttatacctccttccacctctgctacccatgaaacagcaagaccaactcctccttttccttctactcagcctactcaatgtgaagatggtgaatatgaagacctttatgatgatccacttccatttaatgaacagtaaatatattttctcttccttatgattttagtaatattttctttttgctggctaacattatgtaagaatacagtacatatatttacatataacatacaaaatacgtgttgttaatcaactggttttgctatcagtaaggctttcagtcaacagcaggctattagtagttaagttttggggaaattaaaaaagtatgtatttcatgtatttcaaatgtatggagagagggtagtggtcagtgcccctaatccccatgttgttcaagggtcaattgtgcagaaaaatggaatggcggggggaaaaggggcacaaacccacacatacatatggtcaattaatttcaacatgtgtgacataaccattcaataatggacagtctttttagcaaatggtgctggaaaaactgcatatccacatgcaagagaatcaagtgggagcccctacaatataccatataccaaaattaactcaaaagggatcaaagaccaaaacataaaagctagaactataaaatgcttagaagaaaacatagggggaagcttcaggacattgaatttgaccatgatctcttgtacatgagaccaagaacacaggcaacaaaaaaaaaacaaactaaacctcatcaaaattaaaaacttttgtgcatcaaagaacagtattaacagagtgaaatggcaatccacagaatgggagaaaatatttgcaaataatatatctgataagagattattacgcaaaatatgtagggcactcctaaaattcaaaacaactcaattttaaaatgggcaaaaacttgaataaaaacgtctccaaagacagaaatggccaataagcacatgaaaagatgctcaacatcataaatcattagggaaatacaaatcaaaaccacaatgaaacatcacttgacacccattaggatagttattattttaaaaaatcagaaaagaacaagtgttagaatgaaactggaatgaaacgtaatgaaactggaacccttggcaatgctggtgggaatgtaaaacagtgtagctgctgtgaaaaatagtgtatcagtttctcataaaattaccacctgatcagtaattccacttctgggtatacacccaaaggaaccgaaagaagggattcgaacagatatttgtacaccaatgttcacagcagcatattcaaaatagctcaaggtagaaacaacacaattgtacaccaacagatgaatggataaaaggtggtatgtacatacactgtagtattattcagccttaaaaaaggaaatgctgacacatactacaacatagataaaatctgtaaacattatgctaaatgaaataagccagacaaaaaaggaaaaatattgtatgattccacttatacacagtacctagaaatggcaaatttacagaaacagaaagtagaatggagattaccataggctggagggacagggaataaaagagttactgtttaatggatacagagtttgtttgagacagatgatatagtgcaaacagatactggtgaaaacacaaaattgtgaatgtgctttaacaccaccaaattgtactcaggaacagttaaaacggaggcggatgcagtggcatgcacctgtaatcccagctactcaggaaagtgaagtgggaggatcgcctgagcccaggaatttcagagcagcttggacaaccccatttcaaaaaaaaaaaaaaggcaaatttcatgttacgtatattttactgccaatttttaagggcattattaatcttaattagaatgcttcgttagaggagaaggtgcacataccagcttatggttggtagaaaaattaatggaaaatgaagaaatgagaaaaatggctaaataaatgagaaagactagaagtttgcatgatttaaaacttaaacttgatgaaacatttttaggtagaaaagatatttttatagaagatacatgatttaacaaggttccaaaagatgtaagggagaacaggcttaagataccaagttaagacattaaccttgtaaagtaagagaatacttctacagaaatggcatcctgtctcatattccaagctagaatatttagtagtcatgtgatcttgagcaagttatttaacccatcaccacctcaatgttctcatctgtaaaacaagatagtatcagtaacaaccacacaggactgttttttattttttaaagatttatccaaatgagtcacaaaaatatattcacggataatttcaaggaggatttcctccctactgccttaaagttttataggtatgggtgaacacaatcaaagttttctcctggcatgagtaactgaagaagttcagatggttcagactttggggagagagagtttgtcatttctcaaacgattcttttaagtatctaatttgttattttggggaaaaataaatacatgtcatacattctttggttagtagtagtatggaaataattttttttttttttttttgagactgagtctcactctgtcgcccaggctggagtgcagtggcgcaatctcggctcactgcaacctccacctcccaggttcaagctattctcctgcctcagcctcctgagtagctgggattacaggcatgcaccaccacacctggctaatttttgtatttttagtagagacaggatttcaccatgtgggacaggctggtctcgaactcccgacctcaagtgatccgcccacctaggcatcccaaagtgctgagattacaggcgtgagccaccgcgcccagcctgaaaataattttttaaaactcagctaattgttattttcttaaaattcttatacaaattatcatacaatcagaccttgatcatggaaaagaaaatgaagagaatcattcattttccatggaactataacaaaagatttaacatttgtatcactggatgcccagaagacaaacaagaaaaatagaatggggctaaaagggactaaaacaaatgatggctaaaaattccccaaatttggcaaaagacataaacctacaggttgaaggagctgaccaaacatcaaaacaggacacacccaaagaaacctaagccaattttttaaaatgtcaaaccgaaattctacatccactgaaaaaaaaaaaaaaaattaagacattctcagatgatgaaaaaccaagagatttgtcacaagcagacattctaaaataatggttaaaggaaattctctaaatagaagacgatgaaagaaataaatctggtatatcatatatcagaaaagaagaacaaaatgtaaaaatatgggaaaagataatacatttttcttgtcttgaaagttaaagcaaaaattataatgttgcttgtttctcaatgcatgtaagaagatattaaacatgaatatattacgaacaagggtaaaatgacaaaaaggaggaaaaatttctacctttcaattgaactagtaaaatatcaaaaccaatataatgtgatgttttctatgcctaatttaatacctagagtaaccaatttaaaaagctatacaaagacatatacacacaaaaacactttcagataagtcaaaagggaattacaataaatgttcaagtggcccaggaaggcaaaaaaggaacacagatacaaaaaacagggaggtaaaaacagaaaagaaagaatataacagcagatttaaaccctaacataacaatagttatatgaaatataaatggtctagacaacaattcaaattaagaaacagattggtagacctggatacataaacatgacccatccacagacaagaaattcacttaaaatgcaacaatacaggtaggttggaagtaaaagaatgggaaatgatttaccatgcaaatattaatcaaaagaaagtgggtgtggctatattagtgtcagacaaggcagacttcagagaaagaaaatggccaggcacagaatggaaaattatatgatcacaaaagagtcaatccaccaagaaggcacaataatctgaaccatgtacgctcagaacaacagaactgcaacacaagtgaagcaaaacctgacaaaaatgaaaagagaaatagacaaatctacaattttagtcggcaacttgaatacttctctcttaaaaattgatagaactgggcacaaaatcatcaagaactcaacacaattaatcaacaagatctaattgacatttatatcacattctaacccaaaatagcagaatacacatcctttacaagtgctcatggaactattaccaagacagaccaccacattgtgtgccataattcaaacctcagcaaattaaaaagaattaaaatcataacagaatgtgttctttgaccaaaatgtacaaactacaataaataagaaaaagatagtagggaaatctccaaacacttggaaactaaacaacagatttctaaataatttctgggtcaaagggaaagcctcaaaggaaataaaaatatacattgaactgaatgaaaatgagaacacaacactggaatttgtggaatacagctaaatcactgctaaaagaaaaatgtatagcattaaatgattagaaaagagtaatgatggccaggcgcagtggctcaggccaataatcctaatactttgggaggctgaggtggaaggatcacttgagctcaggagttcaaggcccatctgggtaacaatagaaagacctcgtctctacaaaaaaatttaaaaattagcggggcatcgaggcacacgcctgtggtcccagctactcaggagaggctgaggcagaaggatagcctgagcccctgaaaggtcaaggctagagtgagctatgatcacgtcactgcactccagtctgggtgacagagtgagaccctgtcttaaaataaattttttaagaaaagaaaaagaataataattttcaattaataatctaagttcctttctcaagaaactagaaagggatcatctgaacaaatttgctatggtctgaaagtgccaaaattcatttattggaaacttaatccccagagaaacagtgttaagaggtggggcctttgggaaggtgtaaaggtcatgagggcagagtccttataagtatattaatgccatgatgaacaggtttgattagggagtttggaccctttttgtccttttgccttctaccatgtgaggacatactgacccctcccttctggaggatgcagctttccaggcaccttcttggattcagagactagaccctcatcagagaaccaaacctgctggtgccttgatcttggtcttcccagactccagaactatgagaaaacaaatttccgttctttataaattacccagtcttggttctgttatagcagcagaaataaactaggacaggaatttaaaaaaaattcccattatatgttattataaataacatattttattaaaactttttttttttaagacggagtcttgctctgttgcccagactagagtgcagcggcgcaatctcagctcactgcaacctccactggttcaagaagttcccctggttcaagaaattcccctgcctcagcctccaagtagctgggattacaggggcacgccaccacattcggctaatttttttctatctttagtagagacggggtttcaccatgttggccagactggtcttgaactcctggcctcaggcaatccacccgccttggcctcccaaaatgctgggattacaggcgtgagccaccgcagccggcctaaaactttttttaattgggaagaagaatggcattatcttacatttttacaaatctctttagcatctagcttaatagaagacaactggacactcatatctgcgcctgcattcaatctatgacaatacattgccttggtttgaagcgtgaaaatctaacttcacacagatatggacagatgctcctagacttataatgggtggggtttacatcctgataaaccacttgtaagttgaaaatattgtaggttgaaaatgcatttaatacatctaatctgctaacatcatagattagtgtagcctaccttaaacatgttcagaacacttacatcagcctacagttgtgcaaaatcatctaacacaaagcctattttataacaaagtgtcaaatatctcatgtaatttattgaatactgtactgaaagtgaaaaacagaacggttgtatgggtactcaaagtacggtttctactgaatgcatatagctttacacacaccatcataaagtggaaaaatcataaagtgaaccattattaagtctgagattgtagttggaaaagggaagagtatgttaacagtcttttcagataactggaaattatttgctactacatcaaatttgacgaggggtgtttcttaaagattagtggcattgtagaatctgaaattatatcaatggtttctgaactttttgcacagtttgcaacattaaaatttattggtctatcttctactttgaatggatcttttattcatggatgattttataacatcatgcattgattggtcacttagaaaatactggttccttgaattatgcagccaaatgttgacacatttcatcacatctgtaaccccaacactttgggaggccaaggcgggaggatccctcgaacctaatagtttaagaccagcctgggcaacacagtgtgaccctgtctctattaaacattcaaaaactagccaggtaaaattagcatgcctgtaatctcagctactcaggaggctgaggtgggagaatcacttaagcccaggaggttgaggctgtagtgaatcatgatcccaccactgcatacagaagccaaataaagtgattccctttatttttgagactctgtatcaaaaaacacacacacaaaacaacacattattggcttttggtccttcattcaaaattcaagaggtactggggtggggagcagaatatctatattttcatacagacctcctgcagttttaaaatgttatcccccggataggtacagtttacatttaaacaaattatcaattatatcctattccctaacatgatgtcaaccatcttcagctcttgttacagaaacaaataagcaaaagatattttccagaaattcgacaacaacaaataaatgtttattgaaaacttataatgtgccaagcagggctctaagaaccagtgatacaacagtgaacaagacaatgagatacctgttctcacagagcttacatgtaagagcatcagtatctcaaagtacaatagatcagaagcataaaagctaagtaagcaaaatttattaccatttagggaaaaaaaattaatctcataggaacagtaaatttttaaacctttttaatctgtgaaaatatctgtttttctgtaacagttgacccttaaacaacatgagttggaactgcatagatctacttatatgtggattttttttttcaataaaatatacaccgagtatgcctctcttgcctccccttccatctcttttacctcttccctctctgccacccctgatacaaagaccaatctctcctcctcctcagctactcaacatgaagataacgaggatgaagacctttatgagatctacctccacttaatgaatagtaaatatattttctctcccttatgattttcctaatattttcttttctctagcttactttactgtaagaatacagtatataagatatataatagccaggaatggtggctcatgcctgtaatcccagcactctgggaggccgaggtgggtggatcacgaggtcaggagttcaagaccagcctggccaacatggtgaaaccccgtctctactaaaaatacaaaaatgagctaggtgtggtggcacgcacctgtagtcccagctactcgggaggcagagacaggagaatcacttgaacccaggaggcagaggttgcagtgagtcaagatcatgccactgcactccagcctgggtgacagagcgagattccatctcaaaaattaaataactatgtacatatatcacaaaatatgtgctagttgaatctttacattagtaaggctgttaattgttaaatctggggctgggcagagtggctcacacctgtaatcccagtactttgggaggccgaggcgagtggatcacttgagcccatgagtttgagaccaggctggcctacgtggtgaaacccgtctctactacaaacacaaaaattagcccagcgtggtgtcgtatgcctataatcccagctactctgaagactgaagcccaaggatcagttgaaccgggggtgggcggtggggcaaaggttgcagtgagccgagatcatgccactgcactccagcctgggcaacagagcgagacgctgtctcaaaaaataaataaaataaaaaactgttaaatttggggaggagtcaaagttacatgcagattttcaattattaggggagtcagcacctctaaccaccatgctgttcagggaccaattgtaaaactattattttatagcctcttcacattaaaataatgtcttcataaattactaaacagccaatcccttccttttgacaggtgaaggaacaaggtattggagagttacaatgatgattaagggaatctctttatttggcttctgtataaaatttgattttcccttccccactaaaaaaattggatcaaccaaacaaaataaaacaaaaccggccaggcactgcttgtaatcccagcactttggaaagccaaggtgggaggattgcttgagcccaggagttcaagaccaggctgggcaacatcgttaagacttcatctgtactaaaatgcaacaaagttagccagctgtgatggcacaggtctgtagtcccagctactcgggaggctgaggtgggaggactgcttcagcctgggaggtcaaggctgcagtgagccatgatcgcaccactgcactccagcctgggtaagcaagacctcatctttaaaaaaaaaaaaaaaaaaaaaaaaccaacacaacttctttttagcaagtgtcagaaaatgctcatcctcttcatatagcctggcattttttaaaccacattttttaaaagataaaataatttattaaatgggaaacaagactttttcttcaattctcatatggtggagctgtgatgaatcacaagaatctgtatttggttctaatgtgactggatccatcaacaggcatttggtaatcctcactatgacatatcatcaaggcaatgcagcacacaggtatccctctcttaaaggtccaagtgtatctcagttggtggtcttaagttgaggtttggcaaacggctggcaatatttattttaatgtcagataatttaataatggtaaatgaactccaatttccacccctccttcatgcaaccgtaatgtatcttggtataagctggctcttccccagttccaagactggagcacatgatgcagacctatgctcatcagcacaccattattttgactgagattgattcagatatgggtacattatatctaaattggtcagatcaattagagattctatttgaaggtaagaagaaaagactttttccactgtacctgaacaaatagtcttagaagctactggcactcgtcttgtaatcacaagttctctggtggacaacaccaaagaagccgatctggaaaaccagctgcagtcacatcatttgcaaaacctttggggccaggccaaataagcacagggcacgttgtgagagaccaaggtacagccacttatcaccaggttactctattgtttttgtgaagtttcaaatgctgctttctaaattatctcatttagtcctcctcagtaccccatgaaataaattattgttaattcaattttacagattgagaaaactgcactttagaagagtgtatatgacttctctaaggacaaagaggaaagaaagggtagcataatgtacacctacggcactgtctgccctgccctactgccctcattttcctgcaaactgcctccccattctcaaagttctcatgtgaccctacccgcctgatcacaattaattagtcaaggagccaggcacgatggcttacatctgtaatcccagcactctgggaggccgaggcaggcagatcaagacttggttaggagattgaaaccatcctggctaatatggtgaaaccccatctctactaaaaatacaaaaaattagccaggtgtggtggtgtgcacctgtagtcccagctactcgggaggctgaggcaggaggatcgcttgaacctgggaggtggaggttgcagtgagccgagatcatgccactgcactccagcttgggtgacagagcaagactcaatctcaaaaaaaaaaaaaaaattagtcaaggagtgggcacctggcaactgacctaaatgtaactaatgaatcttttcctccagagctctatactcaagactcaaagatctgaagtcaatggtcaaagctgaagctgttagatataaagttccagtgctgtaggcagccatattttccacatgtgactaaaaccagtctacaatctgagagaatgatgccaacacaaagaaaaacgtaagagaacacagagaatgagccttgcttgcatttaagcccaaattctagtttttactgaagttcaacttaatctttacctttaatgagactaggttttcctgaatccaaaattcttttttaaagaatcaacaaagtgaggaggcaacctaaagaatgggagaaaatatgtgcaaacaagggattaataactagaatatataaggagctcaaacaactcaggagaaaaaaagtctaataatccaatttttaaatgggcaaaggatctgaatagacatttctccaaagaagacgtctatcatgcctataatcccagcactttgggaggaggatcattaagccgaggagtttgagaccagcctgggcaacatggcaaaaccctgtctctacaaaaaaagaaaaaaaaatacaaacattggccgggcatggtggcacgcacctgtagtcccagctactcaagaggctgaggtgagagaatcatctgagccagagaggtcaatgctgcagtaagccatgaccccaccactgaactccagcctgggcaacaaaatgagatcctgtctcaaaaaaaaaaaaagatggccaggcgcggtggctcacacctgtaatcccagcactttgggaggccaaggtgggcagatcacctgaggtctggagttcgagaccagcctgaccaacatgaagaaaccccatctctactaaaaacaccaaaaaaattagccaggtgtggtggtgcatggctgtaatcccagctactcgggaagctgaagcaggagaatcgcttgaacctgggaggcaaaggttgcggtgagccaagactgcgccattgcactccagcctgggcaacaagagggaaactctgtctcaaaaaaaaaaaaaaaaaaaaagacatacaaatggcaaacaagtatatgaaaaggtactcagcaccactgatcatcagagaaatgcaaatcaaaactacaatgtggtatcatttcaccccagttaaagtagcttttttttttaatccaagaggcaataatgaatacaactgaggatgtggagaaacgggaactctcctacaatgttaacgggaatgtaaattagtacaaccactatggagaacagtttggcggttcttcaaagaactaatcaaactacccatagaatccagcaatcccacttctaggtacatatgcaaaagaaaagaaatcagtatagcgaagagatatctgcactcccatgtttatcataccactattcacaacacccaagatatggaagcaacctaagtgtccatgatcaatggacaaagaaaatacggtacatatacacaatgggatattattcaaccataaaaaagaataaaatcctatcatttgcacaacatagatagaactcaaggtcattacattaagtgaaataagccagacacagaaagataaatctcacatgttcccattcatttgtgggatctaaaactcaaaacaattcaactcatggagacagagataggaagggtagtaggggagaaagggactggggggatagttaatgggtacaagaaaaaaaaaaaactagctagaaaaaatgaataagatctagtatttgatagcacaacaggctaactatagtcaataataatttaatcatatatttttaaataactaatggagaataattggattgtaacacaaaggataaatgcttgagaggatggatacctcattttccatgatgtgattacacacagcatgcctgtatcaaaacatcccatgtaccccataatatatacacctactatgtatccacaaaaattgaaaattaaaaaaaaaaataagagtagaatcaaaacattcttaacacaaagaaatggcaagtgttgtaggtgatggatactccatttaccctgatgtgactattatacattgtatgcctatatcaaaacatcacatgtaccccataaatacatatatctactatgttcccataaaaatttaaaataaagcatttttaaaattattttttgtctacgaattttttttttttttgagatggagtctcactctgtcacacaggctgaagtgcagtggcacaatcttggctcactgcaacctctgcccccccgggttcaagcaattctcctgtctcagcctcccgagtggctgggattacaggcgcctgccactatgcccagctaacttttgtatttttagtagagacagggtttcaccacattggccaggctggtcttgaactcctgacctcaggtgatctgcctgcctcagcctcccaaagtgctgggattacaggcgtgagccaccatgcccagcctgtctacaaatatttatgttgggttctatcacttacaactgaaagagtcctaactaattcagagaaagaaagggaaagaacaagagaatggaaataggggagataatcattcacaataattaatgagcattattgaacatgatgtctagaattattatgtttagcccacaaggaattctcattaggtatgattaacaaacaagatagccctataccagataggtatgatcaactaattcagagaaagaaagggaaaaaacaaaggaatggggaaaggggagataatcattcacaccaatcaataagtaatactgaacactgatgtctagaattatgcttagccctcaaggaattctcattaggtaagattaacaaacaaaatagccctatacaagacaactatgatcaatttctaaatttcatgagactacaggagttcaaaaaagaaagtaacagtttaacacagttgtgatttatgtcagactataaagatgagaaaattgtgtgaggaggacatgggggagaactcaaggggagagaaaggtaggtcctggaaatacgacagcaaaagtaggaaagagtaggtgagatactatagaaagcaagaaaatccagtagagcgcagtctattttgggaaatgctgggaataaagactaagtaaataggtacactgagaccacatgacaaaaagcaccaaagttaagaaaagatgtagtatagattatattggaaagctgctacgctgtcccacaaatccaagaatgttgggatgaaaatttggatttgggtagtgcagcagtaacaaaaagtaaagatcagattcagggaacatttcaaataaagtatcacactctactttacccccaagtagtatttttgcctatactggaaccttcatccaacctatactataaaagtaaacaaaggaaaagaattaactactaatacttgtatgtaaccatggcaccacctataaattatttcatttaatcctcctaattaagcctatgacgtattatcatgattctcattttgcagattaaatatattcagactcaaaaaagttaggtaacttgtccaagattacacaactaaataaaaacctggccagcagagctgggagatagataataatccacttagatcaaaagtagtttttcccaaggacaaatcataaggatatataatgatgacgatgattacaaacagctaacatctactaaatgttgtgaactctgcaaagcacttacatgcattaccacgtttaatactcttaagagttctatgagggtctatgattaatcttatttgaaggtgatgtgtttgagttcctcttaagaactttacccaaagtcacagggctaataagtggtcgacctgggtgggagtgaaaaatcccagtctgactccagaattcatgcctgacaaggcagttctgctggtgtcatgtaatccttacaacaatataaggtaggcatcatcatcccatttcagagatgggataaatggatatcacagtgctttagtaaactgtccaaggaccaagggctagtaaacaacaaagccagggttggaagctagttatccctaaaaaacacccatgtgcttcaatgtgacggtgtatgtgcatgggagagcaggggtggagatggccctactagacattttaaaagctgaagagatattagaaagcctttataattgacacagtgtggtattagcacatgaaaaagcaagagagaccaatggaacagaaggttagaaataatcccaagtacacatggaaatttaatatatgaagaaagtggcattgtcaaccaacaaacataggcatttttaaaataaatgctgtggagataaacagatagccatttgaataaagataaaattggatgtatctcaaaatttaccatacatgataaattccgagtagatttcaaagtaaaaactgaaaaaaacattaagcatcagagaaaatatggatgaattcctttatgatctggacataggggaaatctttctaactatgactcaaaattttgaagcaacaaaagattgataatttggagacatttaaaaattgtgcggcaaagtaacaaaatgcagaagcaaagtctaaaacatgaaaaattgcaaaaaaaaaaaaaaatctgcattttaccacagaaaaagggctaagctccctaatacataaagagcttctaaaaactgagaagaaaaacaatttaaaatgaacaaaaaatatggacgggcagatcacagaaggaattcaaatagcccttaaaatatgaaaagatattcaaccttactcatgagaagaacagaaattgatattaatgttagaatagaaaaaatagaaaataaaattcaaattcaaattatactgaaatagcacttgtcacctattaaatggacaaaaattcaaaagtcttacaacatattgttggtgaggacaacagacaatcccatatcattactagtggaaatgtaaaatagcacaactcttaggagagggagaatattttaacagtgagcaaaattatatatgcatgtgtctttaacccagcaatctcacttctaggaatctactccaaagacacactggtaaaaatataaacaactcaaatgtccatccataggagactgaattaacaatgctaacacccacaaaatggaacaggactcagctgtaaaaaggaaggaggaaaatcatacaccaatatgtaacatgctactttttgcgtaagaaagtgattaaaaaagaatataaatatatctatgtatatatctatgtatatgtgtatatggatacatatttgcttatatttataagaataaacactgaaatgtcaaatcaaaaaaaagagtaaagggaaaagaacagggtagagagacgtggatcaaagtaagaatattctgaatatatctgatatagttttaacttttaaaccacgtaaatgggcctggcacagtagctcacacctttaatcccaacactttggggggttgtggtgggaggatcccttgagcctaggagtttgatcctggcctaggcaacacagcgagactccatctctacaaaacatttttaaaatcagccaggcatggtaacacgtgcctatagtcccagccgctcaggaaactgaagtgagagaatcgcttgagcccaggaggaagaggctgcagtgaaccgtgatcatgccactgcactccagcctgggggacagagcaagaccctgtctcaaaaaacaggccgggcgcagtggctcatgcctgtaatcccaacactttgggaggctgaggcaggcaagatcacttgagctcaggagttcgagaccagcctggccaacatggcaaaaccctacctctactaaagatacaaaaattagccgggcatggtggcacatgcctgtagtcccagctactagggagactgagtcagaagaattgcttgaacctggagggaggaggttacagtgagccaagatggtgccactgcactccagtctgggcgacagagcaagactgtctcaaaacaaaaacaaaaaaacccaaaccaaccaaaaagcatgtaaatgtttcacatacacaataaaataaaattacatcaaaaagtaaagaaagcactttttaagtactggaaaaaaagaaaaaaaaaaaaaacctaaaatgaaagagcctaactgacaagaagttggtgaaataatcagtcactttttcttcttctcaaaaataaaatatcatagctctattcactgaacaaggacaagaaacaatttcatccaatagtaaagagtagcattccccaccaaaaggaaagagtttcctggaggaatggctgatttccaagtctgaggcaagaaatgtacaagatgagcctgagtaccttactgcagcaaaaaaaaaaaaacaaggaagctctatcaaagataattagggtcatatacaaataacatgagaatcaacctgaagaagcccccatcagccaaagacaggacaaactgagtatcagcaaggatgacataaattgactgaaaacacaccaaaaatatttttaaatgtgtttataatgatgccaaaaatttaaaaaaaaaaaaaagactgagagcgaaataaataaataaatgttggttatgtcttgtttgtgactcatatggatcatatcaacaggctcttttgcatattagcttttcaggtaatgggagatctcagaaggagactgcatgtagggagggaggagaataagggtaggggatatattcctctgtctcccttaatacttgatccacaagctcctctttacttgaaagcacactccccatcagacagacctcttccatagagctaccctcctcagctgctttcctcttccctgtttcctgctggccttgaggcgatcgcaactcccttcctcactgtgactagtcacagagcactgtaccatccctaccagtttccttaaatattatctatacctttgtaaacagtcctttacttaaactcccctcaagttacccagtttgtggcatatctatcataataagtctccaaaataccttgctataacaagtggcaattaaggaaaagattgaagtattcatcctgtatttcatgaattggatttcatggtaaacatacagccctagttgatattaatatgtaaaagttctactcttaacagaggaattacagttaataaatgtgaaaggaataacagaattagaaaatcattattttgctattccctaatgaaataacagggattcagttaaagatcatgaatgaatggaaccattagatgaaaggttaatgaacgattcttacaggaagctatcacagactgatgccacctgaacagaatgatcaaccttagcatcactacaggccaggcagacattatgcacctccgtgtgaggcaaaagaaaatacaatctattgagtacccttgactagaaatctgaaataagtaaatcaagcttttagatctaactaccattttataggaaatatggaaaatacaggaagaagttaaattacatcattaggaaagtaaaaagaaaaatccagaatgtaaaacaaggtcctgtatagtaccactgacctagttccttcaacatgcaggggaaggggagttggagaagttgggggaatgagatttctctatattaagagacttaaaagactcttaaaggacctaaccaaagaaaagcaacatttggactttggatccagattctaataaagcaactgtaaaatagacactgttttagacaatcagaaatatgaatataaactgggaattaatgataccaaagcacttttaattttgctaggcatgataatggccattatgattatgtaagaaaatgtcctttttttttttcaaagatgcttattgaagtatgtaaggatgaaatgacaatatatggaatttactttaaaatattttggtaagaaaaagggtgattaatgaaatcaaatgtgatgacattttgaaaactgcaaaatctgagtaacaggagttcactatcctattttccctacttctgcgtatatttgaaatttttatcataaaattaccaaacagaatgaaaattcacattctttccactgtaactacagttttcaaacttgagtgtgtctaagaatccacatctcatgcaaatcctaagaatcatcccaaaaaattgtgattttgtttgtctacgcaagatcccagattccatttttaacaagtgcctcaagtgaatctgatacaatctacagcctcatatctgaaaactatacacttaattgctttactacaagtaaaccaaaccttaaaggaaagtcatgatcatatctcttacctgcccttcaccataccccactcctatcttagtgtgatagacatttaattaatccttttcctgacactataaattccatgaaagtgggacatgtttgtttttactcaccatggtgttccattgcatagcagaattcctagcacacagtacacaccaaataaacatttgtcaaatgaatgaatgaataacagaaaagagaaaaaggaaagttaattgcagtccactgtttcaaaattagtttgagggctgggtgctgtggctcacgcctgtaatccttacactttgggaagctgaggccaatggctcacttgagaccagcctgggcaacatggcaaaaccccatctctaccaaaaaaaatacaaaaattagccaggcatggtggcgcttgcctgtagtcccagttactcaagaggctgaggcagaagaatggcttcagctcgggaagtggaggcttcagtgagctgagatcatgccaccacacttcagcctgggtgacagggccagaccctgtctcaaaaaaaaaaaaagtagttcaagacaacaatctgagaaaattttcaatttcttgccaaaaatctggtatcagaagtatggatcaattaagaggggcacaggttggcctacccttaatataacacaagtataagataaactctcacctccctgagatatcagactttggacgttaatttgaacatctaccttcctattaattgtttaggaactgtaataaaaatacactctatatttcataatcccaaacagagagggcaagtatactagagaagaaaatcatatctttacattttaatagatatacaaataaaaaattacacttcctatgttcagaaagtacaaacccctacaattatgaacgtaagtcacaaattcaaaaaataatggcaaatataactattgaaattaatttaggaactagttccaaaaaaagcacttactaaagatggttgacagtcttacatttctaccccaacatcatttaactgtttaagttttatttcttaaataataaatcaaagacaattttttgaagttttaattgaagtgtaataaacaaagtctcatagattttgtttaataaattttattttattattttttttttttgagacagagtctcactttgacaaccaggctagagtgccgtggcaccaacatggctcactgcagcctcaatctcctgggctcaagcgatcttcctacctcaacctcccaagtagctgagactacacccaggtaatatttttattttttttgtagagccgaggtccctctctgttgcccaggccggtctcaaactcctgggctcaagggatacttgcaccttggcctccaaaagtgctgggattacagaccaccatgccaggcctatcatagaattttcagagacacaagagacatcagcaactatctggtccaactctttgttctacaaatagggaaactgaagcctagatgagaaaaatgatgtacttcattacacagagatttaatagcaaaacaagactatgctctgaattttcagtccagtgttcttttcacaccacactaatggcatatttttaagaatactttccattgtgaattgcagtactacctgttcatcttcttgaacacatgtgtgtcgtatccaacagctatactgtggacttaaactaaatggatataccccctttttagtggggatgaggaatggagaagtagagctattggattatcttcagcaatagaactctatatataatatttcctgataagtgggtttttctatcaattatcgtaatagaatctgtagttttcaccatatatccataacaccaaaacttataatcgtgaagcaaaactggtgtaaagttatgcaaagtctaatctaaaactgagaatttactctttattcaacataaaattttatatgtagttccttcttctggattaaaaacatttctgggcagggtgcggcgctcatgcctgtaatcccagcactgtgggaggctgaggcgggcggatcacgaggccaggagatcgagaccatcctggctaacacggtgaaaccctgtctctactaaaaatacaaaaaattagccgggtgcggtggcgggcgcctgtagtcccagctactcaggaggctgaggcaggagaatggcgtgaacccaggaggtggagcttgcagtaagccaagatagcgccacggcacttcggactgggcggaaaaaaaacatttctgactcaaaagattaatgaattaaccaattcatatctcagccgttactctgagccacgtctctacacacccacagggtgcctgtagtgcaagagggcctatttacagaacacacactgaaagtataaaagatacacacagaaagagaacaagataacaactcaatctccataaattagttcccaattgccttttatatccaactaaacccttggcacaaagtatataccatattataaatcacaactaaacaaataaacagtctctaaaagatcttccccatttattgaatctattaataaatgtctcaattttcagttacaattggcttagacgtcaataacgcacagctagattatgaatttatgagcggcttgaggtgccagataaattactctgtacttagagacgacaataaatatcaacttctagactaagcacactgactagtatataacagaaatattataaatatgacaatattacaaatgcttactaaataccaaatgctatgatagttgctttgactatattattcaattcttacaacaatctagtacttttatcccctcttatttttctgaagatgaaacagcattgagaggttaaaataactccctaaaatatttcagcaaatacatgtcagagcctagatttcaatccaagtttaggccctatacaaagatttgctgaatgaataaaaatgaattaggagagtaacttgtttttttaaaagaagttcctgcaacatactaacatccaaaaaagtctggtccaaactaaccagatatgcaattgatactaataacacctattaactcacaaactaggaacactggcagagatacaactttaaggctcaaagatttaatgacctcaggtcttttcattccaagagtaatatacccccaaaacagatcaattcaactggcaaggcatacaggggattagacagcaataatccagattcgaaaatgctacccaaaatctgctgtaataacccaatgtgtggactaacactgtcaaaaaagttcacaacaaaaatttcagtttagcgacagggacaatagtggaattaatgacaaaacagataagtttatgggaggaagcttgttttggaatatgagggatttgagactaacatgacatccaagtagaaatgcttacaaggcagtcagatatttaaggtttgaaacaaaagactaaaaataaagatttgggtatcatgtacatagagataataataattgaagctgtaagaatggatgaattcttcaagagagtgaagacaaagataagtatgataggccaaagattgaggaaaagaaaaaaagaagaatgaaaagatgggaaagcactaggtcaagagagcccaggaagataatttaaaggaagaaaaactcaaagactaacaccagaaatttcatttacatttatcttccacattctgaaaaactccctaataagaaatagtagtgacaaacagcacagtgttagaactcaacaggcactatttgactaatactggttcccttctgtctcctccgctcacccgttgctacacctccaccagccagaagagaagtggaaaggtcatgttcttaacaggcatcatgaagcgatgtgccaataaatatgctacaagcaagatattttcatgaaaagtatgtcaaacttcaaaacaaatgtatctataaccctcccaaccatttttgtttttccttttttttgagacaagttctcactgtgtcgtccaggctggagtgcagtggcacaatctcggctcactgcaacctccccgtcctaggctcaagcaattctctggcctcagccctccaggagcgagccactgcacccggccttgtttttcctatttaatttacaaatcataagcattttttcctctgcaaagattaaatagacttaactaaactccatcccttattctgttttcaaaggtactcaaaatcactgagaaattattacaggccctagacaaaataattagaagataaggaagtccggaaaagagaaatagctcccgataatccttataaactgtaacatggacagtaagaaagacaaccattaggacactggaaagaatctgacctacagaaaaccaaagttgactaatttgaatgctctaggaaacaagtgaatggttatcataatgtatcttagtatttgcagactattttagcatttatacatgatatgaagattgaacttacttagttcttgaaaaaaattacaggtgttcgagaaaagattggatagccacttatcagagttcttccagctacattattctaaactactgcaggttgagtatcccttgtttaaaatgcttggaactagaagtgtttcagactgcagactttttcagattttaaaatatttgcatatacataagataccctggggatggggaccaagtctaaataagaaattcatttacgtctcatacataccttatacacaacaacctgaaggttattttttgcaatattttaataattttgtgcatgaaacaaagttctgactgcattttgactgcaacccatctcacaaggtcaggtggattttccacttatggcgtcatgtcagcactcaaaaagtttcagattttgagcacttcaaatttcagattacggatgctattcatcattagtgtctcaacaaaaaagctgtttagtaggtaaggtagtttaaaaggacatacaccagcaaatttctgaaaccaaaagatttggaagtttccatttctaagcatgaatctagtaaaggaggtagagaagaaacaatttgaaaaccttatttttgggattacaaaaacaactctagaactaaaggactgcacgtggcacataatacacactaataagtaagtatcagttacacaaatcaacaaaagtcaaaataacagaaaaaggcaaccaatgtaaaaggagttttgttcctataatacatgagaggtccaaagtccagatagggaagaacaagaacagactcactgaaaaagctgaagtcacctgataggtcaccctgaatgacacaatgaatgaatgaacgaacgaatgctcaatgttaaacataaaacatcatgcgaagaaaattcatgctagatactacaaacccagaaaaaggattttttgtctctaaaggaaattcagtcttgggccaggcacggtggctcacgcctgtaatcccagtacttcgggaggccaaggcaggcggattccttggggtaaggagtacaagaccagcctggccaacatggtgaaaccccatctctactaaaactacaaaaattagccaggcgtggtagtgcacgcgtgtaatcccaactactcgtgggggctgaggcaggagaatcactcgaacccaggagtcggaggttgcagtgagccaagatcgcgccactgcactccagcctgggcaacagagtgagattccatctcagaaaaaaaaaaaggaaaattcagtctttaccaagttcagattgacggggtaataaaatttcagtaacagctatcaataaacagctgtggaactaaacagaaaaagaggacaagattataagatttgaaggggaaaaaacaaccaaatctgtctgttgactattctctttaacaaaatgttgttttagaagtgttgggctccatgatacctggctgtcctaactctggaggccttgatggcttacctcctccactcttcctctttgttcaaccttcatctttcaccctcatttttccctccattgtttctccctttaccattatatcaacttgcacctttgtgcaaatgacttctaaatcattatctgtaattatgagctcagttctgtatctccaacagtctacaggtcattttctcatgattgctccactatcccctcaaacacaacgaatctaaaattgaatttatctgtaggcctattcttcacaagcaatttccaaacctgactttgctatttttaccattctccctataatccaggctcaacctctttagagtcatctgactattgcctctctctttggttccccatcttttccctgccaataaagttccattaattcttcttttctcattctcatgccccaattttgggcttcaatcatttctggactattacaataataacaattttaaaaaactgtccaatctcactgtctctccaatcttttcccatgctaacccatcttccacacaccagattcatcttcttcattcatcctagcacggtcttatttataaatatttaatagccacaacagtgtaaaggcaatccaaaatccttagcctaccaatcaaatcctccacaatctaacgctaatatttccttccaaccttatcttccttgtttccccaaacatgtcatagccagtcatgtctccaccctctattcacgttatcctccactcctcttgagtaccctctacctaaatcctatccatccattataaaacatactttggctctctcaactcacagtgacttctttctctcaatttccaagaacatacattatctaaacaatcatctggaatttatcacattttctcaatctgtgaagtgtttagctttgtttctgtgtatatatgtgagacaaggttttgtcttccattaaatagattggactctcagggaaagagtcatgacttatatttccttgtatcctccacatgtaaataaaggtccccaccaaatgaagctatagcaagaggccagaagatgatttaaagaaaaagaaagctactaaaccctccctataacaccactcatgtaataaggagatcgaaaagcaaaataaaatcaaaaatatatgaaaactggataaatattaaaagataaatcagacttcttagaagttatagaaatccttactacaagatatattctaattccttccacttatctcgtttaataaaatgttttaaaatctattacgcatcaaccttctttactatctctcaatataaagagcatccataatgtggtgagacatttcaaacaacccacaatagtcttatttcctggtcagggatgcttacaacaattctgaaagctttgggaagcttgttgtaaaacccatacacgtggaaaaatacaaataaacagaaatttagagtaactgaaatgcacgttaattttaaacaatctacattaattttcctttgattcaagatgcgatttttgaattgtattatttctttgaatggtattattttgtttccttaatcttaatccccaaaattgagcatatctaacattatttcaccgaagacattgtgaaatcctgtccatatacatgctccctgaaaccttattttagagattatgtggttttgtttggaccaagaaatattatataacccttagttgttcagaaactctgaacaactttgatacatttacagaggaaatgtatcaaacctaagaattccaattatttacagataactgtattatcaaccacttaactatttttaaaatgggattgtggtttttcatgtcataaaaccctctttagaatgttttacaagtgacaatgttaagtgccacaccaccaaaaagacagttacaataactgtatggtacgtacttttgtaaccaataatacaataaaataagttaacactgtaattacctatgaccaattatcttggttttttacaatagtttagcaaaaagttccttcaaactcaaatcacctatgaaattttggctcaaaaatcacttcctcaatagcaattctccgttatcattttcaaggctaaaaactaaacccctaggagctaaatcgcaaaaaggaaaaaaaatgcaaagtagtctttccaatttaactgtcaaacggatcagaaagattaacattaattactacgatcgccattcaacaaactgtatacattgcagtaactctgacgtgataactttttataggatgcctgcaatagcagtttgtaagtatctttcgggtactcatgaactgagtcagaattaaaagttcagagtagttagtacagagccagtcaaatggcaaataggaccacaccatgagatgttaatggtactccaagattcttcaggaaacagaaatctagcattttccaagacgattatgcacacctgagacttttgcagcgaaccagactaatgcaagaggaaggaaagacatgcaaaaccccagacaagcaaaagagaacagcgctactcaccagcaaacaatccgaattcacttccgatttgggatcccgcagcaggttgtccattttttcaaatcgagtctcaaaactgtccccagtcgacatgttgctgctgctgtgacaatgccctcttaccagcaccagcagcggaaagcaatttcaaccaacttcctccgcggtgggttcgcagccgcggggcggaggagccggaacctcagggtcaccaggtgcgcccggttcccccgtcttcccctcactgaggggacctccgctctccagaccccgggccgggggcaacagcgacccacagccgctcggacgcccaaagtcgcatcccacccggcagcccctcacgacagccgacagcgccgtcgccaccagcctcgtcgctccggcgaggtgcttcagtctagcgggccccggccgccgtcgccatggaggggtccccgtcccgagatgggcaggagcgggtagagaaagagaagcagggtggagactccctccgggcaacaagggagggagaagaggaaaggcgaaagcaaagggcgggtgaggagctgtgccagctgcggccgccgctcgggccacgggccgggcccgctccgctcagaggcgctgtagacggtctagccccgcgtccccggctctactcggcccggcccgacgcaccgatcagtctcggccacgagctggtccacgcaggacagcctcactctcccattttgtcccgtcgctgctggggctgctgctacggtgtccggtggggcagggcgaggtcgatgcccgatggagacttagcagaggaaaggctggagagcgggcgaagaggaagacgatagttgggtcccggcggctgctgatgggggagcttctgggaggggctgcggtcccagccggggaaagggcgagtcgcggcggcgaatgcctggggggtggggcgaggggggctgagagggactaatatgtccgccttcctgttcaaacaaacggagaccgccggggcagactgcgcatgcggggcgcggacgctcggaaggggaaccagc

SEQ ID NO: 2581 - DNA, 100149 bp, Homo sapiens
tagtatacagaggaggacacaaacatgagaagattaaggtagagagtgaaatatggtcaggacaaatgtgaatttagagcctgagtgatggtttagtggatttatgtcctcacttgtcactaatgaaaaggaccttacaggttatataattaaaggtagatactaaatactgaaactaataccagtcattctattccatcttctgtggtaggcttcactttcataagggtgtgggggagatacctaacgatgttttcacccctagtgaaattaattgataatttcctatggtgctttgtggctatatttcaaatgcagtattttcttactggctcagtaggaagaggcttggagttagatgatttgggtttaatctttgccctgtaataactataagactcttggaaaagatacttaatgggttagtgtcttagtctgtgctgctacaacaaaatactgagactgggtaatttataaatgacagaaatttattgctcacaattctgtaagctgagagttcagcatcaaggcaccagaagattcactgtctggtgagggcctgttcctcatgcatggcaccttctatgcatcctcacgtgacagaaggggcaacacaagctctctgaagcctcttttgtaaggatatttatcctgtttattagggtagagccctccatcacctcccaaaagccccacttcttaataccattcacctttggtgttacatgaattttagggagaagcaaacattcacaccacagcaataagttaaatcattttgtatttttataggtacaaacaaattactggaacagagaaaagtgctaataatgagacccacttgtgtatgggaacttgggatataattgtggttgtgctatagtcaataaaatagagtggccaggcatagtggctcacgcctgtaattccagcactttgggaaggcaaggtgggtggatcatttgagcccaagtgttcgacagcaacccgggcaacatagagaaaccctgtctgtacaaaaaatacaaaaaagtaaccaggtgtggtggtgcatgcctgtagtcccagctaccagggagacttgaggtgtgggaatcacctgagactgtgaggtcaaggctgcagtgcgttgtgatcacacctccagcctggacaacagactgagaccctttctcaaaaaaaaaaaaaaaaaaaagaaagaaagaaaatagagtggaggggaggggacatttcaataaaggtgcaaggatggtaggctttccatataaaaaattaggttttttttaatctcatcatatggagaaatgaagtccagatatgttaaagacctagatgtgtaatcaaattttaagtgtactagtagaactgattttctgatgtctgtataaccttagtatggaaaaatatttcttagaacctgagaaatacaactctgaaaggaaatgactcagctttattccctctaagcaaagaattcctgcagggggaaaatgatactataaactgagacaaaagacaattcacatctgggaaaatagttttataatatatgtaagacataaaaggttattatccatagtatatacaaactcatacaaatcagtaagcaaaagacaaagcacccaatagaaaagaaatgcaaagtttaatgacattaatggccaataaatgtatacaaaaaagctcatactcattcttaggtcacatgatccatactaataggataatttaaatcagcaaaaccagatagtgtctcacacttaaaagtgcaagatccaaaagtctggtgtgtaccaagtgctggttaggataggggaaaaagggatgttcacacactgtttgttcccagaaaaactcctgcacttgtgtaagatgtgtgtatgagaatatatactccaacattattgggaacaaatttctgtttttctctttttatttttaatttttgcggatacataataggtatgtatatttatgggttatatgagatgttttcatacaggcatgtaatacttaataatcacatcatggaaaatggtatattcatccactcaagcatttattctttgtgttacaaataatccaattatactcttagttattttggaagtgaatttctatcattaggaaatgtgtgagagaactctgatatattaataaagtagaatattcaactgcacataattttaactaaatctctacatattaacatgatatatgtattgaaaatacaatattaaggaaaagaagatcaagtttcagaattaaagcagtttcaaagcagtggaattttaaggacacataaagccacaatatattgttcagagaaatgtgtatagtatagtaaaaaaaacataaatcagatttatgaatgtctagctctgggaaggaagagagaggtagcaaggaattatattctttatctctaaggttgtactttttatataaaaaaccaggaagcagaatgataaaatattaacatttattaataaaggggtgttgtgaacatggttatgttacattaatcaactttttggtatttctttgatttttggcaaataagtgctgcaaagatctgaatgtttgtttcctcccaaaattcatgtgttgaaactcagccatcaatgcaatagtgttaagagatgaggcgggcctttgggaggtgatataggtcatgaaagctaatttctttcattgccttttaaaatgaattctagatatgtcacaaaggtagaaatgatcttctccattagaggagtataattcagattgcattcctcaattacccttccaagtataaataatgcatttgttttctctgccaggctggcattagtcttgatttgtaacttttcctatttacaaagccaaagattgctatttctataaatgccttaccttcttttgtgaccttgttttttggtgattgtcaggttgacccttttcctcccacatcaagaaagttttgtggttagaagaaagggagggcaaccatcaggcaacagacttcctttgatgtcatattcaagtactgatcttaagctgtcctttgggtttttacaaagatactctaatgcatggcttccatctgatcccttcctccagctgtcttcagcctttgctttaatgtattttgattattgtatgccctatctttatgttagtaatcatgcttaatcatttcaaatagactttttaaaagttgaattaaaccaataattggtgcaatagctttctttttgtgtttattcaaaagaattttataaggttatctcttccctgtcttatgtgaaaggctggcagacattttctgtaaaaggccagacagtacatattttaggttttgtaggccaagaggcaaaatgaagaatattatgtaggtacttgtaatacaagagaaaagacaaatttccacatattttattgagaaaattgaaaatataatagtattagtaataataaagtatcttgaaatttgtaatatagatttactaatgtaaataatagaattatttcttttgagataatgttttgcttgcctggggttgaacattaatgtttcctgtcatcagtgttaattgtaaatattcatctgtcgtactgatctgtgttgaaatgttacatatttcatatttaaaacatcttttcacacatacaggttttgccgaatatagatattagtctactagcatgtatgcacattcataatttggacgttttttatacgattctttagattcatctcttgatatttgccttttagaatttcattacagtgcagaatacttccaattgaaaattaggtggaagctcctcagttgcacagtcaaatggattttttaaaaattccttattgaaatatgtttcacatatcgtatagttcacatatttaaagtgtataattattattttgtatattcacaggatatgagaccagtatcactacctaattttgaaactttttttattccccctaagagaaatcccatacccattattcatcattccctgccctcaccccaggcctcctatccccatcctaagaaaccatgaatctagtttctgtttctatagaattgcttttcctggacattttatataaacagaatcatgcaatatgtggtcttttgtaactgacaaatggattttgaaataaggaaatttcaaggtccaaaaaatgctgttggaatgttgaaatcataaattgagctcagaaaatgtgtctactgcaaattagtgtgaaaacggagatcttgcttcttgtttttttaaatgattatttgcttatttttagagacagagtctggctatgttgtccaggctggctttgaactgctaggctcaagtgatcctcctgcctcaacccgtggaatagctgggactataccttgcctggctcttattttaatttttgacaggatgagaaggtgatatagaagctcaacacttgaatcttgtgattcaaatattagttgttacaatgattttactgcaatattaacttgtacattctgcggtttgttgtgattttagattggattaattaacatacattagaaagtctgcagcaaaagctaatttccaaagccgttagattaagtgtccccaatccagggatcaatccccggactgttaggaaccaggccacataggaggagataatgctcgggtgagcgagcattaccacctgagctccgcctcctatcaggtcagcgaaggcatcagattctcatgggagtgttaactgtattgtgaactgcacatgcgagggatctgggttgcacgctccttatgagaatctaatgcctgatgatctgaaatggaacagtttcatcccaaaactatcacccctgacccccatccatggaagagttgtcttccatgataccagtccctagtgccaaaaaggttggggaccactgcattaaatggtctatggcagtttttcgtattctgaaaagtttcaacctaagctcaaaatactgcaataaaactttacgactgctaactcatcaaattactggctaaggcacatcaggatattcagcttctactcatgacagaattcacagaatgattgttaaatccatgaaagcaaatgaattttataagtgacactgttggttcaataacacatgatagatttgagtatttttcacaaagtacctgctgataagtaatacagtgaataaccacaaccgttaaaaacccaaaatgttcactagctttttaaatttgtcaaactaagcctttttctatcctacatttttgccaccatccattttaacacattttagcagattctacttgagattgtactgaatttgtgttttctcaatttgtttaatctttaaacttctctaattaaagttctttaatcgttaacacctttaatctttgcctatagttattccacagagaatgttcattcatagagactgattttccaggtcacttcaaactcagcattgactcctcaaataaacaataacagttaagccgtatctgtatgtcagttgacatgtaaagagccaaggaaaacaacttgaaatcatttgccttgtttttaaattgcatgttaatgttgcttccaagttttgcagctctttgaacaggggtatcaccaaaatgctaatagtcttaaaccagtttatttttttataagcatatatctgctacaatataatttaatttgcttgtctaacaaatgtgccatttgaaaagttactttggtgcagcttcattttgcatgtttacattttgtgaagttctgtgtgatggaatttttttttaatttactattttttaaaccgtcactttacttttagttggcaatattttgatgagcgcttatgctagtaatgttgtcatgtattgtattcttttagtataactacagtctcactgcataataaacaaagttatttgccatgtaattacgtagcaaaataatccacactccattgtgccttcaaagcatgacacttgaagtttatttatcttctttcttcttttgacgtatgcaatagtaatgagaaaagtaatgcaagagtcatggtaaggtaatatgcatggcactccaaatgctgtcaagttttaactgtcactgtgattcatagtgaactgagcaatggtgggaatcaatgagaatgtcacctatgatctccatcacaactcagctctgccattgtcacacaaaagcagccataaacagtgcataaatgatgagcatggctatgttccaataaagctttatttgtaaacacttaaatttgatataattttcatgttatcaattattactattcttttcatttttctatttaaccatttagaaaggtagaaatcattcacaggtcgtaggctgtaccaaacaggcagcaggttagatgtggcccatggaccaaataatttactgaactctgtcctatattattgatttttctctttattggatctttcttcttagcatacaaaccagctgttattgttctctgcttgaaaaaaaaaacaccaacaaaataaagacaacaaaaccccccttgtagggctccatttttccttgcagctagtgttcctcttgtgtgctttctttataatgttttgcaaaagttgtctccactcccatctcttatttcctttctttccattttctcttgaacccatttcaatcaagctttgcctctacctctccactgtaactgcttttgtaagtatctgacacaatttatcactctatcctccttgaaatactttcttcacttgacttcaaggacaccatagtcttcattttcttcattccacactggatatttattttatgatttgttgttaattaatctccttctgaattacttcttaacttttgttttaactcttataagtcttggtccttttatcttctctatgtatgctcactactcttattatcttatccaatttctggtaagtattctgtatctgccactggctttctaatttatatcccgagctcagacagtttcatggaactccagacttgtttatacatctatgtaatatatctgcaattgattttataagagatatctcaaatttgacatctcaaaaactcagttcttttatatttccctgtaaacctgttttatttatagttttcaccatttcagttgatggccattccatttttccagttgcttagaccagaactttggaataaactctgactcttctttctgtcatagcacattcttatttttcatgtgtgattgttagatctacctttaaaatataaccagaattgagccacttctcaccatttcccctgctaccactgtgaaccatgccaccatcattctcaccaggaatctagcagtaaaatcttaactattctccctgccctagtacctttgtagagtgatctcaagagtgaagccaaattgggcatggtggcttacgtccgtaatcccagcactttgagaggctgaggtgggaggattacttgaggccaggagttcgagaccagcctgagcaacaaagcaagaccccatctctacaaaaataaaaataaataattagctgggcacagtagctcattcctgtagtcctagctacccgagagggaggtgggaagatcacatgaccccaggattttgaggttgcagtgagccaagatcacaccactgcaaagcctgggtgacacagtgaagccagagagatcatttaaaaatgtaagacctgacatgttgctcttttacaatgtctcctcagagtaaaggccaaagatcttgcagtggcctgcaattccctgtgtgatccatgactctgttcccccaccctgtttcctttctgacctctctgactccattttctattcctcctgccattgctcactcagaaccagcttctcggactctttgctctttctcacatcaaacccatgtctgcattaggacctttccagtagctgttcatctttcccataatatttacatggctagctcttaatctgtttccagtctgtgctcaaatatcaatttctcctagtggccttcttttagcaacccatgtatacatgctaccaaccctcatcccccccataccagcattcttcttccttgtttaatctgctgtattttttcatggctttattatcttctaataatgatgtgttttatttattatattcatttttgttgtctttttctccccgcaaggctgtaggccatgaggataagaattttgtttggttttgttgattcatgaggcctgagtgcttgacatgtagtaggtgatcaacagacatttgttttaaatagtatcttgaagacaattttgtaaatcattttttctatatctagaattgtaagattttagagctggaagggattttatgttataaatagtttctaaacctgtgctaatagccacatggtactattcaaatgtaaattaaaattaagtaaagatttagttcctcagtcctagtagcaacttttaagggctcttgtgttcagtggctgctgtatttgaccactcaggtatagcacttttctgtcataccagaaagctctattagacagccctgggcccatggattccccaaggtcatacaggtcattagtccatgactgatattgaacccaggggactcaaatgatttatgaaaattacagagtattccttctcatataaatgccctggggatcttgttaacattgcaaattctgatttactaagcctgagatggggcctatacttttacaattcaaacaagctacaaagtaatgccagtaatgctgacctgcagcatcacactttgagtagcaaggctgtagaatgctctaaaatattaaggaataactccttttaacattttaagtaggacatgtattcatttttaccgcaaaggtatgttttgtaattagaataatgtttcctaataaaactaggtgaaaccttaaatactggttttgtacaaagctacatatattaaaacatgttttctattcccaaatgaaaacttgataaataatagtcaagcaggagaaaataagaaactaagaggctatagaacattgattttaagaatgtacttgacataggctggtttgtggtttatatttctaatgctgtgtagatgtaatggctgttctgctaacatctatagcaagatactggattcggttagcttgttctagtgtattatataataaaagtttagaatagtgagaagaggggaggtttttcttgttgaaattgacttgttccattttgtttcagaatgtggatttgatcttggaaagtatggtactatcttttgaatgataaaagtacattgaatttttctgttccaaattttgtaaagaataattctttagcagaacattctttgttgtaatgattttttttgtcaaattctaattgtaaagtaattggattactttaataaattactagttagtaaatgtaataaatttactttaaataaatttaataaatttatccttagttgcttatgcagatgaccactcatcttttacctaaaacgatttatgtctttgatgatgttacatttagatatcagaaaaagacattgccatgaagctgtctaaattttccaatgtaatagaatatttgttcattttatagactgagaaacaactgtcagtgctcttgcctatagtagtattattggcaaatttatagagcataatcaaataaaacattttgtaataattgagttcaaatagtaaaatatacttgatatatgaactttcttttggtctctactgctggccagttatgcctaaagttgacttactatcagaaacgcatgaggcatctattaaaaaatagattcctgaggtcttgccccaagaaattctgatttagtaattctgggatgtgtcccaggaatctgtatttttacaagtatcttgggttttctgactaagcgaacaatataaatagagtgcctagaacaataactggcagatagtaattacaagtaaatattagatcttctcctcccctcccgtcctttccactaaaattattatcattagcccatctgttaaccaaactttggttaggttttcctttctttgatgaagaggcttaggaaatatgagagaataagatcattcctcagttgcgcaaatattcactgagggctttctagttgtggcacgcactattccagatcttggcagtgcaaaggtgaacctgacatgtttttaagtcagggaattgtagcctattcgggtagatatataagtaaaatcacctgtcttacagtgtagtaggtgctacattagagctaggtgcaggtgctgggcggcacataggaaggccgggtaggccagctgtttgtcagggagagttttgtaaggaatagtgaggcctcagatgagatctaagggtaagtaggagttagccagataaagaaggggctgcgtaaagagtgtgtcagggctaagagtgccacagctgaaagagcatacttcttcagtgaattgcagtggctcagtagaagcaggagatcctctggagaggtgagtgggaattcgagccattaatctatgacaaggaattgaggcctttattctgcaggtagtgggcagtgattgaaagtcattgaaacaacattttgcatttgagaaaacaaattactctggctggagtgtggagaagggactggaaagagggaaggggtcatgatggaaggaagaggaaaaagcaagtttagaagaaaatggaattttaaaatattagcctagagaaaaaaaaatatgtatataagggatgtgtgtgtatctttttgttttataaatgtttaaacatatttttaaaatataggcagaatagtctaaccccatgtgcctgtcacacaaccacaacaattagtgacttatgaactattttgttgcgtatctattcccactcacttccccttcccttccttattttgaagcaaaatcctgacgtgatttcatctgcaagtctttcagtatgtatctccctaaagtgaggacttattcttttgaacggagacataattacacctaaataataatcatttcttaatatcattatatatctagtcagtgttcaaatttccagttgcctcatgaatggtagacttcacaaacttgtaagtgaaataactaagactgtccagacttctgacttcagatgtgtgaatctgttttctcccatacacagctgctttgctgctcccaaattggagaaaaaaaagttagttactagcatgatgttaggtagatacaaaagtttctacaacctgctttttgtatatatcctcaaactactacatcctgagctgcccaagtgttttcttttgtgctagtaagtgctactttaggcagttgtatggcattatatttccaactatgctttcatcttttttaggagtaagaattatacttgaaaaactgtacacctgttacttgagcctgaattttatagctccgtggctgactgttggcaggctctgggatttggagcttaccatctaaaagagatagtactgagaaagttgaggtatactacgagaattttttatgatccaggaatagacaactttgtaaattcaggctactaatattgtgtaaaaatgggatgttacgtatccaagtattaacctaaggataatttatagttctattaagaaaaattaaaacaagattatttctcattgttgactatatttgtacccttgagtagggagatgtttgtggtttgtcagttatttataccaccaccttcttcatccatattttattaaaagttagtgtacttttattgcctctaatctcttttacagattttattttgtgaaatattatacatacaaaagaatataacacatggttatagttttaaaaacaataataaaatgaaagctcacataaaaaatagaacagtaacaatattgaaggccatcctggtgccatccaaaacacactgtgcactctgattcagagctaaacaatgtcctggattttattgaattatttattaatttagtttcattacaaatgtatgcatccctaaacactgttgcttagttgtgcacatttttaatcacttttataaaaatgaaaacattctttgtatgttttttataggacttttactttattcaaagttaacattttgagattcttttatatgagacagcaatttgttcatttttcattgttgttttggagtttgttgtatgaatataacccgatttacttacactttgcctattgaaaaacatttggagggcgggtgctgtggctcatgcctgtaatcccagcactttgggaggtcgaggtgggtggatcacctgaggtcaggagttcgagaccagcctgaccaacatggcaaaaccccatctctactaaaattacaaaaattagctgggcgtggtgatggacttctgtaatcccagctactcgggaagctgagctaggagaatcatgtgaacccaggaggtggaggttgcagtgagccgagatcgtgtcattgcactccagcctgggtgatgagcaagactcttgtctcaaaaaagaaaaagaatcaagaaaagaaaaacatttggaatatttctgggttttttttttctatttctcttacagactatgtacatgtataggaatttttccagattttttaaatctgggaaaggttttgttgcttcacaaggccatgaatctttaacctggcttggtattgccaaattgttttccaaagtggttgtgccagttgatactcgctccacagctgatgaaagttcccattgctccataacctcaacagtacttcatcgtatatttaagtgttttgccagtctgcagggtatgaataaacatctcatgattttgtgtgttcattaccctcatttataattagcttgagctttttttatttttgaagatttttaattttgaagatttttttaatttttgaagataatttatgttttctctgatgtgctttttcttatctttagcccatttttctgtttcttgggttgtctcttactgattgataggagttctattttttataccctcaatactaatcttttgttagttaaatgtgtgttgtggatatcttctaccaattcatggttttctttttctatttttatgatgtcttttatgaagagttttaattatctttaatccattgcaatctgaattctgtccccacagctctgttgacattggctcttgaaggcaaacttcataatgaggggaagagtcaagttttgtgtaacctgaagcatatacagtgtgagcatactctttaagactaagttatgaatataaagttagatgcaaaagtaaatgattacaatgagactataagtcacaacaattacaaattttaaaagctaccaaatactacaaatattgcagttttaaaatataacattcctcttaactgccttgtatatctttatattacttatctattttttactatataaagcctgattacctttgtataatgaaaattttgtaatgtaattttgaaagttggagtataaaaatgatccgtattttctttaaatcatcttaatatggtttagtattgacagtggagatgcataaaatatgttcctcttcacacagacttgtttgtagcactcctgcaagtttaggttctacaaacacggacgtgctggtagagtctattttttcatcatttctgtcaaaaaagaatttattttctgttttggtccggtgtgtattcatttgttaaactgatgagaagagaatttctgttttgaccaggcatagaaaagagaatcctctgtttaaaatgttctgtgtgatgattgaaaggatttttctatagaagagttcacggctccatgtatttgcatgtatggctgcttcactactcgcatgttccccaccctgagctttatagaacatgttgtattacaatcctggtgcttaagtcatgactccaggtaagtcagcacaaaaggatggaagatattcctggaaatcattcctaccctagggctctgccaattacttaaccatatgcgaaagtgactgtaaatcacatagacaggttcacacaactcgagttaatatattcccatctcaaatacttcttaggcaaatccgaaaaatgttcactcatagctgtagtaatgacagcagacacattgatgaagggcaagtcagagtggaaagtgacaggggtcttaaccaattacagttaaatctctcactcctgcaaaaacatctgacgcattgagcacattcataggtccttggaaacagcctgtggcgatgagatacctggacactagtttcagggtaaatcctgcatctttaatctgctcgctctctctacagccctgaacactttcccttgcttgttttctttactttctcacctttagttgtctctccctcaaaggcttttctagactctactaacttaatgtatttctccaatatctgccttgcttttaattttttcatcctgtagtatccctttgaccttactgatcccaccgcttgaactgtccttacctgttcttatgtgacggtgactccaaaatttccatgttgaatcctgaatgtctgcctgactccggcattccttttctgattgtgagcaaggggcatctcctaattgacatggctcctcagatgcctcagattatatatgttcagagcaaacttttaatatttcttccagaccattcaccacttcatcctttcatgttccagtcatttctattctcagctctgggcattttcattctcccagtcacgtagcctcaaatcttcatcatctccgttaccttattttttcacactttacttccctcattttgcccctctattctcctatcccatggattcaccttgtatgtcatttacatttgccttttttcttccctcagctcctttcccccatttcagattctctaacagaggtacaaactgctgtgggatatggacaaggggaagtgaagacgaattcaacttttcctaaagcctcatgtaaatctgtctgcttatctccatcttcactttgtccatgatcccaaaattcagaatttctctaccatttttctatatacatttttttaatattggtcataacatttaaaaactgtgtagaaggccaggtgccgtggctcaaacctgtagtcgcaacactttgggaggccaaggtgggcggatcatgaggtcaggagatcaagaccatcctggccaacatgatgaaaccccatctctaactaaaaatacaaaaaacctagtgaagcatggtggcgtgcacctgtagtcccagctactcaggaggcccaggcaggagaatcgtttgaacctgggagggggaggctgcagtgagccatcgcaccactgcactccaacctgggcaacagagcgagactctgtctcaaaaaacaaaaattgtgtagtaatattttgtcaacataagattataagcacctgtatggttgtaaacatgtagtgggcaaggaatctattctcactttggtccagaacaatgccttacatgtaataggccctgaaaaagtacatgtggaattgactccttcaaaagtgccttttgttgccactttttgttttcaaaaatagatacatgtaattatacctttacatatagtatagagcttgcagttgatttatagcagtatttgacataaaacacaacttctttcttaaggtgacttcgtgcctctaaaaagcatactaggaaaaacatactgtgtattatactgaagacaaacaaggcctagtggcccctagtccagttctgagactggctgatctttggtatatttcattttaaatttcctcttgtaggaatgtcattccatttttaatctgcccgtgtcatgagtttctaaccgcaggtgcacaaggaagttggcacttcaagctggcagggattcatttcttccttagctgattccccagcagatcccttctccagtttcactgcatgctttctgtcttgtgaattcctgtaagtgtatctcttctctcatctttcccacttcttttagaaaaagagcaaatacaattgatctttaccttttttttttcaagctttaaaattgtggttcaaactcattgttatgtttagtgtgatcttgtagaaaatgcactgtactttaggctcatagactgtagttctgccagagcctaaagtataactacagtcaagccaggtgatctatctgtgccacatttgcttaatcttgaaagtgagggtgagccttagggctgttctgtggatcaaataaaatgatgaaaactgctttgaaaagcttggagcagaatttttcaacattgagaaatgttcagacaacctttaaaggaaaaaattatcatggacccctggtgttgacttagcattgtaacgttaaaaaaaaatccagttgtacttttcacatactttatacttacttatttctcttatacagataaacagctattaaactattaaataaatatatgaaaaaggtcccagaacaattataccaccaatagcttatttacaaattgacaagatcagtttaatgaacaatattgttgtttttgctgctgtttgctgaaactaaattagtgtaactgagcattgtactgattactgccactggtcttgtaatgattcagttctctcaagctatatctctgtttaagctagagaaaccttggcttatggaatgcagtcccattatttaatatttactttctgaatttacatctctgtttatttttttttagtgcttggcaaatagtattaatagtataaaaccttgccacatcgtaccattattttgaatttaaattggtgttttagtttgtttgcgattctagaaactaaaaatgtattctgttgaatggtattataacatgaattattacttaaaaatttgtcttaaagctgattaaaacaagactcttttactatagtgatagttgctgtatattaggttacactttgagaaacacacataatgttatatgatatgttatatataatacacaatgtgtaaatgtaagggggcattatagatatcagacaatagttgtaaattgttcagccatttttatatgatataatattctataaagaaaaaattattattttttgaaaacaactactgattcatccttaaatatttattattttataatttactagggtaattttgatcctcacattaatcaggtattctaggaaaatatggtacatttcagatttgtatgcatattagagaaatagagaccctagaatatattttatctgaatatattggctgaaatacatgagtatctacatgcctacattttaaggaagttttccatattcctatttcaactaagttcatagtctagcagtgtgccgtattactggaaggggtagtcctaagtggataactgtagtaaaaagatttctttaaaaataaaataagctttactccctagaattcaagcatagcatgcataccacagggattttttattctttcttttatatgtaatgccatggatatttcaaaagtatggaagtatgatgtatgagaaatgtctttcaattacatatagtgaaaacattctaaaatgaccttggaatatagagtctgaaatatccaatcaccagctcaaagattatgttttacttattgatttggcattttgcaaaatattaatttttagattgttctttgatttttctattgattaataccacctactgctgatttatgaggcttttcttacaagggaaataaaagaagtcaagttttttgaagattggagttagttatattagggaatgctgaatttagtatttatgtgaaattctatgtaagttttcttgtatttttaatgtgttttctcttgttaccagtttttgtgtgtttgttctcccttgcccagcccccattcttagaggctatgcttttgaggtcagtagtaaatggagttgtcttctctaaatttgttggacttaattcgagaacggtagaatgaaggaactagtgaagtctggggcacagagaatcccgtattaatgttaccaccagtcttataacatggcagataaagacgtaatgatatgttttgtcaactagtaattaaaatgtgacaattgaaataattaagtaaacttattcctgataattcctagcagtatggcgttttagtgataaaatataaagttaaatttgaatcacagttgttaaaattagggattattgcttactaatccagagttcacacacttgtcttggtctttccctttaagtttgcaattttgaacaaagtataggatttctcccttgtgtgataggaacacattgtaatgaaatccttcatgcatcactgcattgattttgtattatttgtgctgagagagggaaacaaaatgattattttctaatgctgagtggaatgattcaaagcaaagataagtgaaaaaatgcatagcagctggagaacaaatgttactcccatcaattattccctgacagatgagggagtattctcaggcagacctctagaatcactgtttccatctaggcagggtgtactaaaataatttctccacgtgtattttaggtgctgttgtattctccatatgaaataagatctttagttacagatctttttatgagccccaaactcctaatggatggtatgcattgaattattttggtattgttagagagtaaaatactggagagactaataatctccagaatggcttactttgatgagcctagccaggacatctttgtcttgttgttagcttctaaatgaagtgcctttctgtatggtctgttgctactgagtgtgaggaatcttgtgtggctgctgaggaatttagctgccactttccaggcaccggaacaatgtgcccattcgtggattaaggaaaccatgacctcaagcctcctaatcctcctcgtcacaagcttcatggtctttaactggcccaagttacttttaattactgccctacttctgcttccatttctgtatccaaatgctgtcgtgccccctgcacgcccctatccccatcttcccttgagacttagagaattgcttgcttctctatgctttgttttggtttcatttccttatttacttccaacctgaataccttccttgactttcatccccaaagaatttttttaaccttattatctacgaccacagccaccccgttttcctcttcttgcttttaattgtcagtgtcacgctggccccgtatgttcctgtttgaagtcttgctaggtctccctcctcctttctgctttctgatagtgtccgtgtgattttcgtgctggcttatcaaacttcatatcccttatatggaaacttttccccattacattatttttgtaactaagtacttactgtgtattgtggaatctatttggttctattatagctagatgaaggagagactcttgcagactttattaggcagaggaggctacttggtatattgtaatagttctgggtctacagcataaggcaattatatcatgtaaatcagagcaaccaggatgctatggagtcagaaaatcttgttattatcctaataatgaaagtataaaaaattggctgcatattaaaaggactgatttagtaataatagtggtagccaaagattaaatggcctaccttagtaagtagtgaggcccttgtcattttaaacacacacgcacacaaacacacacacacacacatacctattcaccttcagagttgtaagggaggctaaaaatcagatatatgggtgagtagaagagatttaacatttgattttcaacataggatcacaggatttagtgattagcagaatcgagaggctgtatggttgtacaatcactgataagataatgaagtaagcatatcatagtggaaaataacactggctctggagtcagactgatagggattaaaatcccagcactgctggtttttggtatgtgaccttggaaaagttagttaacttccttaagcctcagtgtcttcatgttacaatggtgatacagtaactactacataataaatactcagaaattattagatagcaacatcattatcatcatcgtcatccaaagatgattgtaggaataaactttagagattcactgcacagtatggtgactgtagttaatttatattttaaaattgctgaaagagtagattttaaatattcataaacatataaggtgatggatttgttaattagcttgatttaatcattccacaatatatacctatattaaaatatcacattataccttataaatatgtatatataattatttgtcaattttaaaaatacaggtagttatagcaaaggaaaaacccaatgtgatttttttattgtctttatctattatcagagctcataccataagaagctcatagcttcttatatgctatgtcttgtagtcctcataatcttgttaggtacgtggttttgaaggagaaattgaggttcagatacgttagggaaggcctattatgggaactcagaactaattgatcaacatctgtgtttaagcttgttgtccagtagccaaatgatgtcaagtgctgcaaaaatctgcacctaaaacactttttggattagactttttaattctaatctttctttaaatgaggggttacagtttttttctttaaaattcatccatcaaataaggttgcctttcttagaggcagctttgaaataaaatctaaaaggaaatattagacaaatgttaaattatattaaagaaaacagggcttgccagttatatttccccttttgttgtagggcacacatctaatccttaccctgttactgagttacagtttgattgtgaccacaaaagtaatcacagtcaacaggaatggctggcacaagaacagctggcatcaggtgcaactttctctctcctccatcctagttaagtgccattacttatgcccttacccttggattgtaccagcactgtctagccaagatagttttcctgtggctgatgaatcacatggtaagagggatgagggtggaagttgagggaagataagcagaacagtgaagatcctagccctggggagaataactgtctggcaaattaaagataacgagaatgactttcttccctgcctaggaaattgcctccaaaggtaggtacagaagtgttctaagttgggatagtatcactgggagaagaacaaggcttctagtgaagtgctgtgaaggcctaagtctttttaaatgatcctctgtttcacttgttgttgaaagggaaagttaaaattataaatgcctaaatatatgcacaaaggacaagaaccacagctcgtgtgtaattctggtgtgtttcttagaaagtctcactactttatattaataattacacaaactatacaggttttttcagtagttgacaaaaggaaataaaggcactttctaaaggccttgtcttagtccattttttgctgctataacagaataccacagactgggtaatttataaagaaaagagattgatttggcttatggttctggaggatgggaagtccaagtgtatggtgctggcatctggtgaagacttttgtgctgtgttattccatgatagaagggcaagccagggtgccaggcagaaagggaaagggggcagaactcccaggataacagcattaatctgttcatgagggcataaccctcgtgacctaaacacctcttaaagtcccacctcataatgttgcaatggcaattaaatttcaacatgagcttcagaggggatgttcaaaccataacaggcctgtatgttaggtttataactactatggaaaggactgatgtaaactcagcctcaaacttggcgtctcaggtcagtcagaaaagtgcctaaagcttcttcactctgaaatatcagcatattgagacatcaaaggataaaaaattctgtgcaaaatgttgactctgcaacttaaagacaaatatggcttgcataacataagggtacaaggtgaaactctttaatcatgatgagaaagcagaaagacattgtattttgcaggcaagagaataaacttgatctctgcaggaaagtcatgataaaaacaggtatgtttggattgggttttcagtcatcaactggtcatcactgaagcttcctataacagctctttaaagtttcctttgaaaatcttttgaaagaacttttttcttaaatccatacctttgaaatcttgaaggagcacttaatttttaagaatctttaagatataatgctagaaattcatgtaccatattacattcgaaatatgatttcatgtggttatttattctgttattagataaaactgtatgcaatagaaagctttcaaatatagacttgtttaattaaatatggttttgtatagaacataaggtattagagcatagttaggaattatgggaaattattattatttatactggaaattcaggcttgatttatgtcacactctaagaatagtatttaaaattcagataaaaatcatttatactgtgccagccttgaggaataggtcagaaaaggtgtttgttataagaacttggtaatgggctgttaattaattaaatagtttttgaggcacgctgccaggcccaggaaagtgctttcaaagtctgtactgtttccatagctcctgcaaatgataagaggcttgaggatacttcccaggaactcctgcctttttggaggtgactctgtcagttaaagtgtgaatgaagagtggagcataaaagtagagtatccctttatgttggagatgtttatgttgcaataaatgaagaaaaataagttatgaacttttgactcgagtttccaaaattcacattataactgtgatgcaggagctgagaaatttccattaaaagagttgttcaatgcaggtgattaataatactcaactcctaaccacagggctatagaaaagttaaaattgtttaatctcactttcctagcatagttactattataatattattttacttgtactcattttttctattatgttatatagttacaattattccacagaaatttacagcatgcttttttaaacttagatttatttaacatacattttcaaatttgcttcataaacttcataattaatttcaatgaaagcatactattctgagcaaatatataacaacctaatagtctcctatcagtggacattaaaaattatttctgagttttgatttttactattaaagttgaatgcatgggctgggtgtggtggctcatgcctgtaatcccagcactttgggaggccaaggtgggcggatcacctgaggtcaggagttcaagaccagcctggccaacatggtgaaaccccatctctactaaaaatacaaaaattagccgggtgtggtggtgcgtgcctgtaatcccaactactcgggaggctgaggcaggagaatcacttgaacccaggaggcagaggttgcaatgagccgagatcgcgccattgcgctctagcctgggtgacaagagcaaaactccatctcaaaaaagaaaaaaagaatgcatgatagacatctttgtgtatatagctttgtctgttttttatttgttctgttacagtaattattaagtatgtaaataaagttctagacaattaattctgagatttgttatccagttcacaaattttgtcttcagctgtatctagtctataaatcaacttgtcaattgaattatttcaatgaatgtgcttcttatctagaattggtattgtttacatcattttttcatgcagccttcttcttgcctaatggtttctattcttctttttttcactttgagcatttttttttttttgagatggagtttccctcttgttgcccaggctggtgtgcagtggtgcgatctcggctcaccgcaacctctgcctcctgggttcaagcgactctcctgcctcagcctcccaagtagctgggattataggcatgcgccaccaagcccggctaattttttgtattttgagtggagacaggttttctccatgttggtcaggctggtctcaaactcccgacctcaggtgatccacctgcctcagcctcccaaagtgctgggattacaggcatgagccactgctcctggctgactttgagcattttaaacatagttattttaaagcatcttcccatttgttctgttttcttcagtgcttggggtgcagacatcttttgtttgtggtgactaatgcttctaacatgttttcttgttcttaactgtggtttgcactgtcttatagtcatccttactggggggaaactaattattttccacagacatcccttatacttcaggttagagaaccagacagtagtaccttttatgtagggggcatacattccaagactcccagtggatacctaaaatcatggatagtactgaacactatatatactattttttaatacatatatacctcttataaagtgtaatttataaatcaggcagaataagagatcaataactactaataaaatttaaaagttgtaaaaatatgctataataaaatttatgtggccgggcctggtggctcatgcctgtaatcccagcactttgggaggccgaggcgggtggatcacgaggtcagtagatcaagaccatcccggctgacatggtgaaaccccgtctctactaaaaatacaaaaaattagctgggcctggtggcaggcacctatagtcccagctacttgggaggctgaggcaggagaatggcgtgaacccagggggcggagcttgcactgagctgagatggaaccactgcactccagcctgggtgacagaataagactctgtctcaaaaaaaaaaaaagttatgtgaatgtggtctctctcaaaatatcttacagtagtactctcctattttgggaccatagttgaccacaagtaagtgaaatcatggaaagcaaaaccatagatgaagtgggacttctgtacttagaaagaagttaagcattaaccaatcctggacctgccatcctacctcttttctgctcagggtccatgaatcgcatgcatactgcgagtttgaatatcccagtcatcagcacagtccaggccttggtttccaacttcttggagtgattctttctccacccagtcaagctgatgaaaagtcttgtgcccttgacaaagtgctgattagtcctgcaaatgtagcagccttccgtggctttgtgcattcaggtcaggtcaagatttccttgtgactgtatcatttctcatcctttgattgccctcagccccagcttgtatctatctggtcctttcccaggggctaccttttttttttttttttttaaccctgtaggtttccttctctttgtttcaagcttaattaggtagtaaaaatgttgtgtttaatacttttatgtgtgtgtagctggtggagagattttccttatcagctcaattccccatattgaactgaaatcaccaaattactttcctatgccaccagcaacgtgtgagtattagtttctccatactgacagtagcattgttatcataaaatgtgtttcccctggtttaatggttgaaaatgatatattattacatgtaattttatacctcattacatataattttatatcactggttcatagagaacaaggaagtagatagaatgtgctttcctgaacagacgtgttagaaatgtatgtataaagggatttgttctttgaccttttgccattttttctcttctcatattcataggtccattgccagcacttgagtaaagataaagagtaggagaatcaaagctgttgtataattagttctcttctcatccacacccataaaccagttcaagaaagggatgaaggtaaagtacatagatgaagaagccacatttatttgtgctgcaggagcccttgtaatctcttcaaaacacctcctgtgaagccctctcacagacatagagcctggaagagtagattttttcactttccttgagtataagtgattttctttcagatggtgccatctctttctagaaagaatgtaagaaggcagaaaaaaaaaagaaaaacagagactatttaccatgaagagctatatcaatgtactcatttattatgatgataggatgttggtgcctggcagctgactattctattgcattagaattataggctcttttttccttcctttccctccctttctccctcctgcccttccttccttttctttctattttttttaacctctgttgtatgatccctctaaaaacgtagacagatatcaaagctttgctctcctaactagtatcagagataaactgctgacaagctgcattccatctccgtgcacattcgttgggagaactttcagcaaaaactatttatatcatctcaattttatttccagttaacctgacccatgttatattacacaatctttaaaaatgttcagattcccatattgcttcagctattttagactagtttcagaaaatagttttttggttcatgcttgtcgttttctgttcccttttgctaatgtgaattgaagacagcttagcattcttttttttttttttttactaaatctgagggtcagacaggtcttcagacagcagatttggcttccacagagaaaaggggaagagaagactgcagttggccagcatcttcagggtgtactgcctgttctctgcatttgatccatttcatgtaactgaaatgaacgttttcttacattatgctcgttcagtattttgctctaaaggaatgaagatagtgttgttaaggtgcagatactgggctgctcagtgtgactggtaattatttcctcttaagaattgccagagtataataatttaccatgtttttgtctattttattctcatttattagtgatcaaatatgttcaattttagtttcaattgattcttctcattataatgtgctttttaggtataatgcatgaagtgacttgatgtaagaagttataataagatatctgccttactgtaattctcttctaaacaagcaattcatgaaatagctcaaaggagcattgtgtttggcagatttggatgtctataccaatttccacttcttctgatgcaaacagtttcacattaaatctccaggaagttttgtttaaatgtgcttcagtttaaacaagcttaagtttattttatgcaataaaaatagttcgttgtgttaaaaaaatagatctttacaatttactaataaactacctattctacttaatgctttaggcaaaatttacagaaagggtacttttttgcttctttgtgcctactaccctattacccacaggttaaaccaaggactctggggttcatgtgcatttagtagtctccctgatgctgctgtgcctgggtgtagcagagagagctgaggaatgatctaaggtctgccagctccaaagtccagccctcccaggtctaccacggtacctaaaattctgcagttaaatactcaaaatttcagttaagatgtaccttcaaaaagacggggttgaattcagttataacctgagaaggttgacacactaagccactagcatgccagacacattagcactgactctttagatttcttacatcactttggaaagcaatcgttttgaaggtagtatggtggtggtatagggtaccaagaatgttaagaaaagaaatggagccgttaaaagggaaggaagaagaactccaaagataagtttttcttcttttaaagttttgtctaaggctgactccataataattttaacctttagggacagtagaaagctaaagactgaaagcaaataaatattacatgtaattggctctcacctccaatgatataggtaataataatggccatcatttattatgtatttgctatgtgccaggtgccatcttcttttattacagcctgacaaatttggcattatcatattcacctggaaaatcagaaactgaaggctcagcgaggatagacaatcacttattgggccagatacgtgttcaattgggttttagacccagcatgctccaattccagagccccctactttgttcatctcacctcatgattttcagtttcttgatctattatttttgccttgttaacaatttttaaatataattacttggaaaaaaatcactcggttaatgtctgaaagcatctactgacattagtgtagatacatttttaattggattagatcccatagttttatatgagagagcaaggagtgtcaggttctaaaaaagtcacctttaatttttttaaaaatgatttactaggaacccagtattatttctttcatggaattttcccatctagttctttacttttcattgcatttcacttttcttttctttgctcattttcctctgtatctactttgatcagctgtgatgttcaaagaaactcttctcggtgagataataactgccagccctagtttttggtgctgagttcttgactctttcctctgtcttcatatgcattttagtgtgatttggagtccccaccaggaggggctggccagatgcatctttaaaatcaaaagccactttctacttttaaaaggatactcattgaacaaatatatactgaatctaattaaaagccttagattaaatgaaagagatagtcagaggtagtttgatatgtagtctcgcaaaagaaaaagatacttaaaaagaaacaataagaaactaccaaggaataaaaaactatgaaggaataggaaggaattgaagcactttaaatgtttccaaatatttaaaatatagcatatacaatactaaaaatgaaagcattgctaagagctatcctggtaagcacaacagaatgactatgtttcagtttgaacagcttatatgacagaatttggatagtttttgcaaattaacatttactgatgaatttgagatatgtacaatggatactttaaaggtactccgtcatgtctacagtgtgtttttatgtatacccattttatatatgcccactgaatatacccatttttgggtaatggttcacaattgtttatactactttggatcttctgtttaaaatatatttgcatgattataatttaacgtgaacctcattgataatggtggatttataaccagaatatttgacatattcttagaaagcattagttttgtgttttgcagaaatttattctatgcagaattttcatgaatttgttcctatgttttcctttggtgctccttagcataatatggtagcagacagccttgggagttaaagttatattttacttttgtaatgtgcaagtgtcactaatatttgaataaagtagatgtgatgctttaatttgatttgatttttggctttgctagcaaatctgtgttcatctttgaatttcttatttatatgcttatgttttgatcactatattccacttccttttcaaatccttatttcataactccttaaattgaaggtatattttcagaacttctagtaaaatatctttgaacaacccagtctttttcatgggtagtttttcagatatagaatattaaatgtttatttccagaaagttagcatttctatcttgattcttcttcaatgcccataagaagaaaagaattgaaacatacttgaaataattgacatttagttctgattttttttcattgtttcagtatgaaacaatatattcacctattcatgtattataaactgttcatggttctggggatatagcagttaaccaaaatgagtccctgttttttggagattataatttagtgagaagaaacaggtaataaacaaatatacataacaggacaggggtgataatggttaatattaccagaaaaacaaagctaacataagaggaagggtaggaataggccaaaaagaaaggtaggtgcttgcatgttttgtgtatgtgtgtgtgtgtgtgtgtgtgtgtgtgtgtgtgtgtgctgtttttgagagcatggtcgtggaacggttcattgatgaggggatgttcataagagacctgaatgatgcaagaaaatgagtcatgaaacatctagagggggagctttccagggagaaggtcaagcaggtaccacagccctgaggccagaatatgtctgggaaaaaaaaaaaagtagtctgaaagctttggctgttttcttttagtaaagacttatagagttcgtattcagctaccatatctaattcatgttaaatagcacagtaaaagagaagtatgtgaattctgagaaaatggatatataataccaagaatactccatatatatcaattacatcccagtcattcattgtgtcatctcactgagtggtaaccagaaagagcacaagatttttagtctagcagatctatttccaaatccccattcttctgtcatgtacctactgagtgatgtttctaaggcaaaggacatgtaacagcagcaacaataaaagcagttcttatttattaatttatgaaatgtgttaacataaatcctagaaacataatgccccgctgactacatgtgcaagttatactgtcatcctgtctctgtttataaaagaaatttattttatttaagatttttatttgtctgcctgttgttctctgaatgggaactgactctggatttcattcagggctagtgtgtacacacatacagaggatgctgtttgcttagacaacctcaggtagcaccatttacattgttttccctggagttggtcagaatggatggtcattaactaaatcaagtgatcctggaatagattgaaagctcttgcatgcctttatcaaaataccaccatagagtagatgggaagagattttggaaatagtgatagcaatcactcacagttattgagtttgtactgctctaaattccaggctgtactctaaatgccttgcatggattagctcaccacagcctcggtacaattctgtgaggtatatgtagatgaggaaactgaattacagagagaaaaatcaaattataattgatatcaagctctgctttcctcttatttaatgttatcattaagttatttggtacagctattgttcaaacagtgtatatgcctttctgatgcaggaaatgagctatgaatccatctctgtgatgattgcatcatctcactgtagctggagtaatcagcctccagagataactgaatcttttagccaattatggtcagaagcagttcaaaatcacacacactaaaaccaaacttttctcatgggttagagtcttaacattctgatagtatgaaaacttccttctcccagtgattcattcatttacctgggatacaatcttcccatgaactcatttttgtgatgaaaggaagttatttttaaaaataaaaattaataccatttaatgtcaagatatctcttttgtactttagtgtagtattgttagggactcagtcatgcatgtgcttgactgaacttttgagcaaacccaaagccccttcctaataaaccatgttgaccctgctcaaaatcctcttcaggccacctgtacactgagatgcactggtcctgtgttgtgtaaatatatttaaatatgtgtttttattttcccagaaagccagcaacattgccatttagctacttacttcatgtctgaagtatatagacttccacctaacacttagcaatcacttagaagtttcattgataccaatgtgtatgctatctggtttttatctgaaagtcacctaaaatagttgatattccagaaaagaaagcaaaggaacatattatatagtttgaagtcacatcttcagaaagctatatacctaaactctattactttacacccctgtaaaatatatcttcattagatgtattgattttaaaaacatggctatatattggttttgtaagacatctttttaaaagttcgtacttgtaaagtcagcacattttataagtttttctacgaaaataatcagaaatgcccacaaacaaatacactaggatattaatcactacaatatagtagagaaaacatggaaaactctaaacgctgaatggtagagattagttacataaatagtaggatgcctgtatatggaggaactttaagctattttagaaaagaaaagcggttatgatctaataaacataaatgccaagttatgatagtatgtagagtatgatcactattttacttacgttttaatatatatacattataattgtatatatattggtattgctacatccagtatattttctctattttctacattttcatatgctctgaaagaaaatagtaatgtaaaaagagacatgacttctcaaaactcaagaattttacttctaattcacacacatatgtaacatgtaaaggggcattcattgctgtactatttctaagaactaacatttggaaacaacttcaaagtccagcaattagagattagattaataaaatatggtatattcataggatagaatataatgtagcatttcagcaaaaaaaattaaatttttgttcaccagcataagtagatcttaaaaaatgtgtgaagaaagcacaatacagagcagtatgtgtctactgttatgtcaatggattcactggtacataaaaatataaggaagcccacgaatctaatgacactggataccaactagaagaagaaatgagaatataagggggaaagggtctggttaaaagagacttcaataaatggatagatgaagtctgtaagcaaacgtaacaacttaataactgctagaggcatatggttctttcattattctttgtacttttccaggctttaagaaatttctcaaaaaattaaacacctaattgtaggcaagaaagtaaagacaaaatttagagcactcgaattttaccgtgaaggagagaagagaaaaacatcagaagcttgaggggaatacattgtcaatagattttttaaaaaggtgggatatactaaagctgtgttttgaattgagccatgactctttgatggtatatgaaatcaatgtaatgggtcattattgaccattccattattttagtccattatttaatggtccctccattatttttaatggaatctgtgcagaaaagtattaacagggttgggactgctgtttttagaaagtttttagaaagttctctttgtaagttttcttttaaagaaaatgtggcacataaacaccacggaatactgtgcagccataaaaaaaaggatgaagctggaaacatcattctctgcaaactaacacaggaacagaaaaccaaacaccacctgttctcactcataagtgggagctgaacaatgacaacacgtggacacagggaggggaacatcacacaccggggcctgtgagggggtggggggcaaggggaggaataacattaggtaatacctaatatagatgatgggttgatgggtgcagcaaacggccatggcacgcgtatacctatccaacaatcctgcacgttctgcacatgtatcacataaagcataataaaaaagaaatagttggaaattagaatcaataaggaagtgtataaaaaataatggtgtattttccatgggatactacgtagccatgaaaaggaatggtttcctctggacttggccccatgcaccttttctctttgcttcttttcccttttgctgcagtaaatcgtagctgtgagtacaacttaaaatttttaaaaagacatggtcatatgaaaatatgttttgaaaactttttatgacactgcctttcaatatgctttatgtaaatagtcatatgaatttccttagaattttatgcatggaaaacttcctcttgcccaatgagttactatatttttctttattgaacaaaaacagttatacaccatattgtatttttcatttgccttttcactgggaaactgttaaatgtggggattaattggtagttgtcctaagcaaggtttttgaatcagcagtattagctctttgatgaactggcagctgttccttctccatctttggtagctttatttgtctctattgtcacaagctgctttaaggttgttctgtggaattataaattagctatacaaaacaagtgtatgaatggctaaaataacaaggataacctatcttggggaaagaagacttctgtatagataatcttattatgagaagtgttcacatttctctgcacttgatactaggattatctgttctataggcctttaagctcaagtcttataaccctatcattaaaatagggattaaattcctttcttaattatgtatatttaaatgccattaactttggaaggttataattacatattaactgactgtatttttttattgtgggcactagtcattttaatctttctattcaaactgtgttcagtagttattctgatacaagcatagcataataaatgggttaacatatgcagtggtgaaaggtcaaaatgaaacatagcattgccaatactaagggaaagaattcactttataaaagagggtaccacatattttcacgaatcacattttctgatgcgtttaaaatattttggttacatccagtcttctagtagcacataatcaattgacttaaagtttttataagtgtaacaactatccatttctaacactagctattcaataatttgtggtagggtaacatggaattgtttaagaaaagttgtatgttttttatagagacatggtatgagggctccttactttcaaattagcattaattagaggtagtgtagaatcatataatgccactgttttatatctgtatcttgtacagtgttttaaataatttcttacttaagccttccccctttcatttgaggaaagttaacaattatctttatttttataagatcaggtgactaatggaaatccagggggcactggtattgagcaagaaaacagaattatttctagtattttcttcagaatttggctttagttttgcaacagaatgatctcattttatttaagggacagttctctttgagcacaagatttttgatgaaaacatagcatcttgtttgtgtttgttgaagacttttcaaacacattagcatttataaaacttgagctttaactcacaaagacagtgagagaaaaggaaaagccaacagtgaaccagaaatcagatttatttttagggaaaaaaaaggatagatggataaactgacttagcaaatctgtttgttaacttagacgattaaaaaaggaatatcaacaataaagaggctagtgtgcaccagtgaatctcagaaagtctttggtaaagatggtagtaggactagttgaaaacctaaataaggaagaggaatgctaccctcctcacctctcttgaccatgactaggtgactacccctctcccagagtaatgaagactggaggtgtgcactggaggtactgcagtgtggtgatatagatgcaccatactgaaagtagggaatctatggagaatccatataaagggtggtaagtctccccggactccatttggccacatgttccagcactaacagctggacatacacctccaggcataaaacttgaggattcttctctggggaaagtgtacagccccaaggaaaagatcctaggttactgctgcttgggacatttgatctcccagtaaaaaagcccgcttgcctctgatcacagagatgcaattagccaatgaggctggctcacagatcttccagttagcttcctactgcatctctcttaaatgcagatttcatgacacctccacgaggaggttgtacaccatttgaaaatcccttcctttgaaaatcacctgtcatcatctgtttttcaatcgtagctatttattttggtattaccttaatgtttccaaatatacttatgctcctacattagagattgacttcctattacaaaagattagaacttacaactctgctatctttcttaccattttacccacctccatccatcctctcgatagctatcatacagttttttgttaattaataatctacatttagaatactgtgactatataagcaacactttttattgctgagtctaacaatatatatgttattcttatatgactattacattcctaaacctaaattttcccctttttattttttagctttctatactaattacaaattaatttttaacccttattaccttttactctccacttgaattataaacctctccaaagatcattttccaccaaattagacgaataatttagtttctcaagttccatttttttccttcttacaggcacactgtctggtgccctctgtctttctccaacacttactggtgctaggcctgctacatttctccaacactgaagcccttggcctcctggattccatgttgcctgctctcttgcttgatgtccccttttttgcagtggggggggagtgaaaaaatcctttattaaaataatttatattaaaataacatgttgccatttttgcccaacagattaaagttgctgtttgcctcttagcttagtcagctttgtggagaagagcccagtaaccctgggcgagggactccaggtgctgtgaaggcatccagcctgtctcaaggggccaggtgctggtctctcttggtgccgcttttcccatgcagtgctgctggcgtgagttccctgtgccagacttcccaccctcagcagaacttcagacagagctgttcacgagaatgataaacagctaccattgcaattcgcagacacccgctggcttgggctcagatgtctgccaaggtcttgattattctattttagtgtatttcaacaaacaaatactaagtgcttactgtatgcagggcagggtcctggtgttccctaagatgccaagacaaatagaatgtggtatgtgcctatgagaagtatatgatccagagaaagagggcttgagacaaatcaatatctgttattaaaagggtagagaatgtgaaatgattttagaggcagacaaacaatattctgtgagcatttggtattcacaagtccgcctagtttttacttctatcatgcaggtctttctcagaatgacgggctggagcctagtcatccagatggtttgggactttatagaaccatgattcatggatgtgagatctggttgttgttgcctttttttttttaaattgccctgctttctgatgttaattactgcagctgggctgccaagtaaacatctgttccgggtaggattctagataaaggcgtattgctttggcttgtcttgttggaaactatttttacctcacatagaatattatataatctccatgaatactgtatactatgtatggactattacagatcaacacatgcctagaacattcacagaagaggggaaaacaacaaataaatactctaacatatattaaagcttacaattagtaagatacacacaagcattaaaataataatattgccatttttccttatcaaattaaaggcaaaagttttggagggtttttgtattttttcatttgtatgcttatttttctaaatgatagaattcatcatggcaagttgtaattactatcatggaacgtaaataaacatggcttttagaaagcagtttggcaatatgtgttaaaagtctcacaataatcagatactttaacccagtattttcagttctgggaatctaccctaaggaaacacagaatgaactttatgcaaaagttattcatcccacattatttataatagcattaagttggagacagcctccatgtggagtttaactgtggttcctctactctctgaagtattatacaatgttcagaaacaatgattatagacagtaataacatggaaaaagcttttttttttttttttgagacggagtcttggtctgtcaccaaggctggagtgcaatggcgcgatcttggctcactgcaacctgtacctcccggattcaagcaattctctgcctcagcctcccaagtagctgggattacaggtgcctgccaccatgcccgactaattttttgtatttttagtagagacggggtttcaccatcttggccaggctggtcttgaactcctgacctcgtgatctacccacctcggcctcccaaagtgctgggattacaggcgtgagccactgcacccggccagaaaatgcttaccttatgttacatggaaaagcaagttaccaagttgaattcagagtacatgtagaataaatatattctacaaggacttatatgaaaatgttgatattggtagtattaggatggtaagacaaagcctgattttttccccatttttctgttttcccagtttcctttataaagtcatttatcagctgtacaaacacaggtgaccttactttccctgtataactgaaaaattgactaggaagatcagacattgtgctcttcaataagtaagaacagccattcccaggattgtcattaaacactttcccatgccttcccccctttttttgagatggagtctcactctgtcacccaggctggagtgcactggcatgatctcagctcactgcaacttctgcctcccaggttcaagccattctcctgcctcagcctcccaagtagctgggatcacaagcatgcaccaccacacctggctaatttgtgttatttttagtagagatggggtttcaccatgttggccaggctgctctcgaactccttaccttaggtgaccacctaccttggcctcccaaagtgctgggattacaggcctgcaccaccatgcctggcctgttttcttactggttctaacaagtgaggcccacagcagatctatttggtttataggagaaaatacatttctattctccctcaaaacatgaagagattattcaacagttatgtaaaatttatatagctccattatatacagtacgaattcagtgaaattataggcagtaacagttttgaaaattaacacattaacaaaaataagtaacaattaatgttctttcacctgagcagcctaggaaactctggggaagttggactaggaaggatgagcaggctgacagggccagaaaggttttccttctctacatctctgccctttttctttcaattagcacattgagtgcaacagctgaactgcaaccagccaggggtgtggttgttcctttaagggaggctgggcttctggcctacatgtggcctctgccctggtagttaagactgaacatttttatcttcttataaaccagtgatcaaggccaatttggctgtcatctctccctaccccatgaaccccttaaaatagtccagaacaggatgctgatttttctacttacaattacacattacacgctagacaaaacaaacatacacaatcacacttccttccctttaatttatgtcccttggactagtggtctggtgctctcctttgtcacctatgtccctgcttgaccttgagttttctgtagctagagatcactatttagaaaaacctcacactatctctattaacctctttttgaatttcaacaattatttcttaagcacctactttatgtcaggttagtgagcaaggtattagagatgccagaataaacaaggcacagtttctgccctcaaagaatttataggataatagggaaaacaaacaattttgctagaataggataagtaaaaatgacaggaataagcacaggttgctacaggagcaagtcttgttaaggatcacctgatacagttttgaggtattacaaaaggcttccaaaagaatttgatgtctgaggtaagacctgaaggatttaagcaagaaaaatatgtgtaaagtatgtcctgggtagaacaaaagcatgcggaggagcccagaggcaaaatcaaatatgattgaggcatagcctgcaatggggcaaaagggagtccagaaaagtggtcacattttcacatggagggagttttcactttatcctgaacacaagggcattattgaagtattttaattagtggagttgtatgatcagacttgtgttgtaaaaagagtgctccagagaagagggcacccttgtatactgttggtgggaatgtaaagtagtacagccattacagaagacagtatggaggatcctcaaaaaacttaaaatagaactgccagatgatccagaatctcactattgcatctatatctcaaggaaatgaaattagtatgttgaagagatatctgtactcccatgctcattgtgccctgttcacaatagccaagatatggaaaccacctaagtgcccattgatagatgagtggataaagaatatctagtatatttaacaatgggatgttaatcagtctttagaaagaaggaaatactgtcatttgcagcaatatggatgaacctggaggacattacgttgagtaggatagaccaggcacagaaagacaaatgccacatggtccccctttatatatggaatcttaaaaagtcaaactcatagaagcagaaagcagaatgttggttaccaggggatgggcatggggggaaaaggactaaggagatgttgttcaagacatgcaaaatttctgttaggaggaataagttcaagcaacctattgtacagtatggtgactatagttagtaacaatgcattgtatacttgaaaattgccaagagagtagattttaagtactttcactgcaaataaataaatatgtgaggtaaacaaaatgaaacaaagagtactccaaagcctggactaagtagcattggagatcaaaagatgtaaatgattgtttgaagaattaataaagtaggattttgttgatggttgagggagagaggaagcagaagaaaagtcgggaggggatattactttgctttctgtgccattttcatgataaggaacatgaaggaggccaggcacggtggctcacgcctgtaatcccagcactttgggaggctgaggcaggcggatcacctgagctcaggagttcgagaccaccctgagcaacacggtaaaatcccatctccactaaaataccaaaaattagccaggcatggtggtgcacgcctgtaatcccagcactttgggaggctgaggcaggcggatcacctgagctcaggagttcgagaccaccctgagcaacacagtaaaatcctgtctccactaaaataccaaaaattagccagacatagcggtgcatgcctgtaatcccagctactcgggaggctgaggcacgagagaatctcttgagcccgggaggcagaggtcgcagtgagccaagatcatgccactgcactccagcctgggtgacagggtaagactctgtctcaaaaaaaaaaaaaaaaaaaaatgaaagtgggcagtcagggggacatgggaagtgatgagtttgtttttagactgttgagtttgaggtatttgactgaagacatcaagtagggaattaaacgtagatatcagaagcttagtatagagatctggactggtgttttaacatgtgggagcttgcactgtatatatatgtggagttgaaaccatgggagtggaagagtaactaaccctcagaaagattaaccaatgagaacaatccattataaatgcaacctcagagactcaggaagccttaaaggatagatgcagggaaaatccacaaaggaggatacaggggacagaaagaagtcaggaaaatcaggaatgtgatgtgctagaggtcaagaaagaaacagaactcaacagtgtcagatgttgcaaaggaggcagtaaagtaaggattcaaatggacatttagtaaccagaaggtgattgataattttgtagagaatgactgaaagtcatttcaaggaggaggtgagacagatagcagtgggttttttaatgtggacgtgaacacaagaacattaaataatctttcatttggcttggctgcaaatggacagatgataaggactggagaccaaggcacacaatcctaacgagttttttgttttcttttgcttttatagtgggagaaacttgagcatgcttatcagtttgagtgtctgaagttagcagagggaggtgagattcctgacaaggcaggtggaaataatcatcctagaaattttgcaaagtcctgctttctaccgaggagggagggaggaagggatatttccaaaggaaggaaggaaggaaggaagaaaagaaggaagggagggagggagggagggatatttccaaatgtactcccttatgagtggggaacagaaagttgaaggtgttctaaggaagggagggagtgaggaaagaagggagggatatttccaaatgtactcccttatgagtggggaacagaaagttgaaggtgttctagggagggaggaagggaaggagggagggagggagggagggaaggaaggaaggaaggaagggatatttacaaatgtactctcttatgagtggggaacagaaagttgaaggtgttctcagctgatcctgttggatttttattctgtcaagtacaaggtgaagtttttgactgtgtgcatattggtcagttgaaaggaaaagttaagagtaaggccttgaagagggaggtgaaatggttcatgggtaagaaagaagcaccccagagggtcccagagaaggttgctgctcagtgatgatagcccatatgatcgtggagaccatctgcttgtccacagcactgagggagatgaaagttagactgcttgtacttttcaaagtatcacatccaaaaatgtattacctgcctttgatgaagtacttaagaattctcagtggccgctagcaacatggcattattattctaagcagccagttttgcaaaacctgggtagacatctgcagtgacacagtggcaatgtgtccaggctctgccagtgactaacattgaattaaagctttagtactttctttctgggtgaccttgggcaaactaattctgtacttgggatcctggtagggtctttatcaggagtaactgaggttaatcaatggaaaatgcttagaatagtgcctggcacatactaaacgctcaacaaatgttagctgctgctatcatcatcatcgtcatcattatcattaagtttattgtgataataggataaatttctaggatgatacaattcaagcctttagagcattgagagcgtaaacgtgtcatcagtactccacatttctgtgtagaaagaatgacaaaaggtattcctgttttggggaagataactttgaaacaagtatttaaaacatttctctgagaaaaaaaaaagggaatcacagttaggtgctatacaagtcagctttttttaggtagggaaggttgcatattcagtccttaaactctgcaagaattgcactgcttccctgtgtgactcttgaccctgtggaagacaagtggggtgtgaaatctgcccaaatcatctcccttactggatgaaaaaaatgaaaacaaattaaaatgaactgtgatatactagttatagagtagtattattttcacatgcaaagagtaattgtgttttggatacagtaaatattaatattaatatattaatgtttattatatttgttgaatgaacatgacataatttgtaccattcttttttaaattttttaaactattttttaacatttttgtgggtacatagtaggtgtatatatttatggaatatatgagctgttttgatgtaagcatgcagtgtgagataagcacatcatggagaatgaggtatccatcccctcaagtatttatcctttgagttacaaaaaatccaattacattaagttattttaaaatacacaattaagttattattgactgtagtgatcctattgtgctatcaaatagtaggtcttattcattcttcctgggcttttttgtacccattaaccatccctacctccccgccaatgcccaactacccttcccagcctctagtaaccatccttctactctctatgtccgtgagttcaattgatgtgatttttagatcccagaaataagtgagaacatgcaatgtttgtctttctttgcctggcttatttcacctaacagaataatctgcaatttcctccatattgttgcaagtgacaggatgtcattcttttttatggctgaatagtactccattgtgtatatgtaccacattttctttaccatttgtctgttgatggacacttaggttgcttcgaaatcttagctgttgtaaacagagctgcaacaaacagaagtgtagagatctcttcaatatactgacttcctctcttttgggtatatacccagcagtgggattgctggatcatatggtagctcaattttcagttttttgaggaacctccaaactgttgtccatagtggttgtactaatttacattcccaccaaaagtgtacaaaggttcccttttctccatatcctcaccagtatttgttattgcctgtcttttggatacaagctgttttaactggggtgagacggtatctcttgtagttttgatttgcatttctctgacatcagtgatgttgagcatcttttcatatgcctgttcaccatttattcaaatcattgcccattttttaatcagattattagattttttcctgtagggttgtttggactccttatatattctggtgattaatttcttatcagaggagtagtttgaaaatactttctcccattctgtgggttgtctcttcactttgttggttatatctttgctgtgtagaagctttttaacttaatgtgatcccatttgtccaggtttgctttggttgcctgtgtgtcctattcttaatgccagatatagtttgttagtttatcttaatcccccttttttggttcagtacccctttaaatatatgacaaaatctgggagtatgtactcccaacaatgcacaggtgaacaacacacaaagataatttgaggaccccaagataggagcaccttttcatatgcctgtttgccatttgtaggtcttcttttgagaaatgtctattcaaatcttttgcccattttttattaggctattatatatttcttttggaactacactgagtgtatatagtgtatacagtgtatattttggaactatactgaatgaatatagtgcaaaatttcttttggaactacactgagtttctcactgtatatatttagtgtagttccaaaagaaatatgtttctagaatatatattatggcaaaatgtattataattcagttttaaaaagtggaaagagcataaaataaaactggaaataataactgatgcaaaattgcactatatgaaaatgcttaaattatgcaattattctctttttacacttgtacctgtgtttcacttaaaagagaatggtgtaagagctttttaaaataaggttttttttttagttttacttattatttactgtgttaaattactgtgatgtgttccactgggctttttttactgcttatgtaagtcttctgatgtgctgtcttactgcctttttatatattttatcttagctagttttcttaagtgaattatttcaatcaaacttcatatttgatctatctcagttgtaacatgtgagaaaatatttacctggttgaccaataacaaaatcaagaagttttaactgtattgaaattacccaaagaaattagaaagctcagttgaagcagaacaggattctctaaaatgtattttcaataacaagacatttaaaactgaatattccaatcccttttcaacctaattacaaactttgcagtaagagtttggagtatattctttcagcatggaagtcttttttggacacctctctaatccagtaatatttttaagagacacttatacccctagaatgagtttgttttctccctattttgaaggtattaaacatcaaaagcaaagacagctttttaaaaacatatatattcttttattttttcatattcaaatacactttgatttagttcctgggggatataaaggaaaatatggttcctctacactaaacagcattttatatttggaagtaatgaatagaagccaggaaggaggaaattatttctttctttattgaatctaaaaactccaggtaatgaacagaccattcgtagaactgggtggatggtgcacaaagatactttgttttggcatgaaaaggctccgttgaagtttctgttaaagaactatgttaacttggtttaacatctaagaaggcattgatacttgccaattttgaaagaccaaactctgtaggggggagaagtgtaaatgttgttggtaaaaatgtagaacgtgcattttttaaagtgtcaaacgttgattacctccaggtttgcagttattatcataagaaatgatcttgtcattatatctgttaagtagttttgaagatgaaaagttttggaataaaaaaaaatttttgaaatcagctacataaaaggaacattgctatctgtgaattagctgagatgacgacagcactgtgtagggtgggattcccatagggcttagtttacttgggacatagctgctttgttactccgttttcatgctgctgacaaagacatacctgagactgggaagaaaaagaggtataattggacttaagagttacacgtggctggggaggcctcagaatcatggcgggaggtgaaaggcatttcttacatggcagcagcaagagaaaatgaagaagaagcaaaagcagaaacccctgataaacccatcagatcttgtgagacttattcactatcacaagaatagcatgagaaagaccagcctccatgatttagttacctccccctgggtccctcccacaacacgtaggaattctgagagatacaattcaggttgagatttcagtgggggcacagccaaaccatatcattctgcccctggcccctctaaatctcatgtcctcacatttcaaaaacagtcatgccttcccaacagtcccccaaagtcttaactcatttcagcattaacccaaaagtccacagtccaaaatcccatctgagacaaggcaactcccttcctcctaagagtctgtaaaatcaaaagcaagctagttacttcctagatacaatgggaatacaggtattgggtaaatacagtcattccaaatgggagctattggccaaaaggccaaaacaaagggtttagagcgcccatgcaagtccaaaatccagtagggcagtccaattttaaagttccaaaatgatctcctttgattccaggtctcatatccaggtcacgctgatgcaagaggtgggttcccatggtcttgggcagttctgcatctgtggctttgcagggtacagtctccctcctggctgttttcatgggctggcattgagtgtctgcggcttttccaggcacacggtgcaagctgtcggtggatgtaccattctggggtctggaggacagtggccctcttcttgcagctccactagacggtgccccaatagggacactgtgtagggtctccgaccccacattttcctcccgcactgccctagcagaggttctacatgagggccctgcccctgcagcacacttttgcctgggcatccgggcgtttccctacatcttctgaaatgtaggtggaggtttccaaacctcagttcttgacttctttgcacatgcacgcggaacaccacatggaagctgtcaaggtttggagcttccaccctctgaagccacagcccgagctgtatgttggcctctttcagccatggctggagcagctgggacacagggcaccaagtccctcagctgcacacaccctggggactgtgggcccagcccacgaaaccactttttcctccagcgcctccaggcctgtgatgctaggagctgcgatgaaggcctctgacatggcctggagatattttactcatgatcttggggattaacattaggcttcttgctgtgtatgtgaatttctgcagctggcttgaatttttctgtagaaaatgggtttttcttttctatcacattgtcaggcttcaaattttccaaacatttacgctgtttcccttttaaaactgaatgcttttaacaacacccaagtcaactcttaaatgctttgctgcttagaaatttttttcatcagatactctaaatcatctctctcaagttcaaagtttcagttccacaaatctctagggcaggggcaaaaagctgccagtttcttcactgaatcataatgagagtcacctttgctctaattcccaacaagtttctcatctccatctgagaccacctcagcctggaccttcttgttcatatcactataagcattttcattaaagccattcagctagtctctaggaagttccaaactttcccacattttcctatcttcttctgagccctccaagctgttccaacctctgcctgttacctagttccaaagttggttccacattttcgggtatcttttcagcaatgccccactctactggtaccaatttactgtattagtccattttcacacttttgacaaagacatacacaagactgggaagaaaaagaggtttaattggacttacagttccgcatgtctggggaggcctcagaatcatggtgggaggtgaaaggcactccttacatggcagcagcaagagaaaatgaggaagatgcaaaagtggaaacccatcagatctcgtgagacttattcattatcacaagaatagcatgggaaagaccggccccccatgattcagttacctccccctgggtccctcccacaagtaggaattctgagaaatacaattcaagttgagatttgggtggggacacagccaaaccatatcagctgctttctccactacacagtaaagagggttaggagaaaacccataattcattagtgcaaagatatgggatagaaactgagactagcaaatgtattcagaaacaaacttaaaattcctaattcaattttgataggtagaactccatacccataattcttaataatctgtcttattgtcaagaccaatgcaaagatttggttttactgtcagttctgcatctaatatctaccatagttaggaaacacttatgccaaatatataaatatatatatatatttcttatctccagaatattttgtcaagtaaagaaagctaggtgaatattatttgctaacatttgggttaaatatttaagttaaaaaaggacaaaatatgtatatttgtatttcatgtatatactttaaaagtttctggaaggaaacgacaaccattttgtggggtgaatggagaaaagaggacagttgtaagagataattgtatgtctactttatactttttggtttatgaactatgatcatttttgagcttattttaaaaactgaattaaaaatttaaaaatttgcataagaggataagggagcacgaacattcagatagtaaggagggaagaaaagtttaagtaatgtaaaaaagatgattgtagaaaagtacatttggactggtttcatgaaacattaatatctcattaattgtacagttattattttaactgtaatattaaacattgttttggggaacctttaagtactatgataactctttccaaattacacgtgagtgtggttttattgtacttttccctgatgacttatgaagttgaatacattttcatatgctcactggccatttggacattgtcttttgtgaagtacccataaagtctcgactatttttctttttttttcttttttcaatatatccaaggccatataattaatacatttcagagtttggatttcaactaagatctgtttgcctacagattctgtgttctttttttttttttatacttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtatccatgtattctcattgttcagttcccatctatgagtgagaacatgcggtgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctactgtgaatagtgccgcaataaacatatgtgtgcatgtgtctttatagcagcatgatttatagtcctttgggtatatacccagtaatgggatggctgggtcaaatggtatttctagttcaagatccctgaggaatcgccacactgacttccacaatggttgaactagtttacagtcccaccaactgtgtaaaagtgttcctatttctccacatcctctccagcacctgttgtttcctgactttttaatgattgccattctaagtggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggttgcctattcattctgatggtagtttcttttgctgtgcagaagctctttagtttaattggagcccatttgtcaattttttcttttgttgccattgcttttggtgttttagacatgaagtctttgcccatgcctatgtcctgaatggtaatgcctaggttttgttctagggtttttatggttttaggtctaacatttaagtctttcattcatcttgaattaatttttgtataaggtgtaaggaagggatccagtttcagctttctccatatggctagccagttttcccagcaccatttattaaatagggaatcctttccccattgcttgtttttgtcaggtttgtcaaagatcagatagttgtagatatgcgacattatttctgagggctctgttctgttccattgatctatatctctgttttggtaccagtaccatgctgttttggttactgtagccttgtagtatagtttgaagtcaggtagcgtgatgcctccagctttgttcttttggcttaggattggcttggcgatgcaggctcttttttggttccatatgaactttaaagtagttttttccaattctgtgaagaaagtcattggtagcttgatggggatggcaactgaatctataaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaaatattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggcagagacaatggggttttctagatatacaatgatgtcatctgcaaacagggacaatttgacttcctcttttcctagttgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctctctctcggcagaaactctacaagccagaagagagtgggggccaatattcaacattcttaaagaaaagaattttcaacccagaatttcatatccagccaaactaagcttcataagtgaaggagaaataaaatactttacagactatttttcttatgggtttgttgtctgcatgtttctcattgctttggagttctttatatgttctggatatacaaaacttgtcattcatgtgttccaaatctcttctcacacttttgtttgcatttcttctctcttaaaaatattaattggtaaacaaagatttaaattataatcaatccagtttatcaaaatgttatggttttttaatgtcatgtgtaagaaatcttactctttcccaaggtcatgaagatgttctttttgattatctttagaagctttttcattcgccttttatatttacagttacagtctacctggtttgagttaaaagtcaagacttatttgtgggtttttttgtttttgtttgtttgtttgcagctcctcatctgttgaagttttttttttcaattttacttttatttatttattttattatattttaagttctgggatacatgtgcagaatgtgcaggattgttacataggtatacatgtgccatggtggtttgctgcacccatcaacccgtcatctaggctttaagccccgcatgcgatagttatttctcctaatgctatccctccccttgccccctaccccctgacaggcctcggtgtgtgatgttcccctccctgtgtccgtgtgttctaatcgttcgactcccacttatgagtgagaacatgcagtgtttggtttactgttcctgtgttagtttgctgagaatgatggtttccagcttcatccatgtccctgcaaaggacgtgaactcattcttttttatggctgcatagtattctatgctgtatatatgccacattttctttatccagtctatcattgatgggcatttgggttggttccaagtctttgctattgtgaatagtgctgcaataaacatacgtgtgcatgtgtctttatagtagaatgatttataatcctttgggtatatacccagtaatgggatttctgggtcaaatggtattcctggttccagatccaaaaggaatcgcaacaaaagccaaagttgacaaatgggatctaattaaactaaagagcttctgcacagcaaaagaaactatcatcagagtgaacaggcagcctacagagtgggagaaaatttttgcaatctatccatctgacaaggggctaatatccagaatctacaagtaacgtaaacatatttacaagaaaaaaaacatcaaaaagtggatgaaggatatgaacagacacttctcaaaagaaaacatttatgcagctaacaaacatgaaaaaatgctcatcatcgctggtcattagagaaatgcaaatcaaaaccacaatgagataccatctcatgccacttagaatggcgattaaaaagccaggaaataacagatgcttttattatttattatttattatatttattatatattatttattatttattataaagcaggaaataacagatggagaggaagtggagaaataggaatgcttttacactgttggtgggagtgtaaattagttcaaccattgtgaaagacagggtggcgattcttcaagactgatttttttaatggatattaaaccaacagcacaatttattgaaaaaaaaaaaaagtcctgcccactgccctgtagtgttcatatggaagtggtattgttctattctcttttctgttccattgttctattatctatccttgtgccactgtcacactaatgtaattcctatagctctatgatcagtcttatttctggcagaaaaagttttacaactttatttttctagatcaagagtattagtctattcaggctgttgtatcaaaataccagaaacggagtagcttttaaacaacaaactaccagcaaggcacttgaggctgaagttttctacttgggaatatgcctttttctctggttgcttcttgttactgtgtgtttggtattgatcacttttacttgatgtacttaaatgttttctttgtactgtatttatcttgcttagagtcaagagatttctggaatttttggcttgattttttaaatcatttttagaaaaattcaaaggcatctagcactaagccctgtagttgctgctgagtaaacaaaaaaccgtatgtgtcagtagagcaggcaccttcccataatcactgatgagtaaagtgaggcggacatcagtgagtctgaaatcaatctgccctgatggtgcacctcaaagtaattaatccacacaaactacctggagctgtgctttgcttgtagtagatctatgtatattttgtgattattgttactgctttcgttgcaatattctcttctctctgccatattaacatatttccatttttcaaaacagaggaaatatgaaattccctagtatcaagtgagcaaaatccaaagcaccttgtaaactatcatgaccaacacttacaaccatgatcagagtcataaactacacatttgataaattgagcaatgaggcctgagatttgtactttttcccgtccttttctttggagagtttaattaattagtctgccacttttccagaggtcttcatcacctgagtcattaaattacttttgagttctcccaggtggcaaattagccatgtagcttgaacgttaagtggataatagtgtctcttaatgatgccttgtagattcctttagagttaagcaattttttcctttcaagcatggaaatgtttttgttcagaaaaactgaacagcatctttttcagtgatataaatagttgtattagcattttacacacggagcagcaaaatatctttaagtacattaagtagataaaatccagtaaacagaagttagatgacatgttatttagaatgttaacttgatactaaaaaattgacatttttgtagatatatggtatcatggttatggttttaaaaagacttcttaattttttagccccatactgaaatatttatgaatgaaatgacatgatatctggtattttcttcaaaataacatgggagggccatattattcagggtatagaagaaataagattggctctaagttgacaatgtaagctagaggatggctatttaaggattcataatacccatctgccaaccttcacatatactttaattatccctaataaaaagttttttaaactattgggtaaatattaaatgaattaataccaacaaatcccaatttgctagaagactatcaatgccaatttaattgctacattctcaaggtctatgaaggcaggattcacggcttaattcactttatactatggactttttctatcacctatcctattgttaggagcttggtatgagtttttttgggtgtattaatgatctttttttctaatttaatttttaagttctgtgatacatatgcaggatgtgtaggtttgttgcataggtaaacgtgtgccatggtggtttgctgcaactatcaacccatcacctgggtactaagccccacatgcattagctgtttctcctaatgctctccctccctccaccccatcccctgacaagccacagtgtgtgttgttcccgcctgcccccatccctgctgtgtccatgtgttcttgttgttcaactcccacttgtaagtgagaacatgtgatgtttggttttctgttcctgctttagtttgctgaggataatagcttccagctccatccatgtccctgtaaaggacatggcctcattcctttttatggctgcatagtattccatggtgcatatgtaccacatttttttttcttttttaaaaaaattttactttaagttccaggatacatgtaccgaagcaagggttgcaatcctagtctctgattaaacagaccttaaaccaacaaagatcaaaaaagacaaagaagggcattacatagtggtaaagggatcaacacaacaagaagagctaactgtcctaaatatatatgcacccaatacaggagcacccagattcataaaacgagttcttagagacctacaaagagacttagactctcacacaataataatgggagactttaacaccacattttcaatattagacagatcaacaagacaaaattaacaaggacattgaggacttgaactcagctctggatcaagtagacctaatagacatctacagaactctccaccctaaattaacagaatatacgtttgtctcagtgccacatggcacttattctaaaatcaaccacataaatggaagtaaaacactcctcagcaaatgcaaaagaactgaaatcataacagacagtctctcagactacagtgcaatcaaattaaaatttaggattaagaaactcactcaaaaccacacaaccacatagaaattgaacaacctgctcctgaatgactcctgggtaaataacgaaattaaggcagaaatgaagaagttctttgaaaccagtaaggacaaagagacaacataccagaatctctgggacacagctaaagcaatgttaagagggaaatttagagcactaaatgcccacatcagaaagctggaaagatctgaaatcaacaccctaacatcacaactgtagagaagcaagagcaaacaaattcaaaagctaacagaagacaaaaaataactaagatcagagcagaattgaaggagatagagacatgaaaaaaccttcaaaaaaatcaatgaatccaggagctgtgtttttgaaaaaattaacaaaatagatagaccactagctagactaataaagaagaaaatagaggagaatcaaatagacacaataaaaatgataatggggatatcaccacggatcccacagcaatagaaactaccatcagagaatactataacacctctacacaaataaaccagaaaatctagaagaaatggataaatccctggacacatacaccctcccaagactaaaccaggaagaagttgaatccctgaatagaccaataacaagttctgaaattgaggcagtaattaatagcctaccacccaaaaaatgcccaggaccagatggattcactgctgaattctaccagaggtacagaggagctaatatcattccttctgaaactattccaaacaattgaaaaggagggactcctccgtaactcattttatgatgccagcatcatcctgattccaaaacctggcagagatacaacaaaaaaagaaaacttcaggccaaaatccctcatgaacattgaagcgaaaatcatcaataaaatactggcaaaccaaatccagcagcacatcaaaaagcttatccaccacgatcaagtcggcttcatccctgggatgcaagactgattcaacatatgcaaatcaataaacattatgtaatcataatcacataaacagaatcagtgacaaaaactacatgattatctcaatagatgcagaaaaggccttcgataaaattcaacattccttcatgttaactctcaataaattaggtattgatggaatatatctcaaaataataagagctgtttatgacaaacccatagccaatatcatactgaatggacaaaagctggaaacattccctttgaaaactggcacaagacaaggatgctctctctcaccactcctattaatgatctttgttctgacttctgttgaaaatgagcagtgaagcaatgcatttattaattagcttgattaatatatattgatctgtacatatatattaaaacatcatgttgtataccataaatacataaaatttttgtcaatttaaaaaaatctcattgattccacttccaaaatacaccctgtatcttgttacctctcagtcatctatcatctactgcctgtaacagctagacatcacttgtgggaagagccattgaatccagacttccagaattctcccaaccttcacttttattcctctgcagtctgttctccaagaagagcatgtcagtcctcctcataaaaccagtgatttgtattgtctttatataatacagactttttaccatggccaacaaggcccatgtgatctgtcttctgcctaactctccaacttcatctcatactgttctctccctcctttagtatatatttttgtcactgagttgtgtgctctgagcagaggcaaatcagacaccttctgactggagccaatgttcttgtttcctttgtttgctgtctcttccccatgttctctgcataacaggcctttcagttctcaactcaggttgtcatttccttagagattgcttccatgatgtgtagttcattcataacacaggttacaatctgtcttgtttatttgcttgtttactattcatttcctccagtagaaaccccatgtttccctctcctcttatctttccagaagtccatcacactacctagcccataaaaaccacatttcactgaaatctaagatgtgatcaattgtaggatgcagtattcggttatgcaccaccaagaaagtaaaaacactgcaaattaaactattgtgcaatactaatttcttttgattataaaaaacttggctttcgagaaaataaaatgtgcttttaaaatgcattcttgaattgatgaaatacatatcttgttgaacacatgaaaaactgtacttcacttaatcataattagttgtttgctagtgatcttttgaggaaaattttctgaaaaagatatgcatgtagaggccaagagattgcataggtgatgagtaacactatattatgaaaaagaggatattgttagtatgaagaagtatgagtaatcgaaggattgtatgagtagctgttccaaactgccaattactggcttgtcaacaatgattccaattctgtaggtcttgagtgggccatgaaactggaatgctcaacagacactttaagagactcatatccattgttccagaaatagattcagccctctacagggggaagacagaaaacagagatgtaaattgctagagctggtagtgggtaggtatgggaatatgcatctgattgcctctatgtgttcaataaaatatgaggtctttggttcagtgtagtaggatagggattttggagccttgagaaagaagggaaggtaaaaaatagtcaatgcagagagtatgaaagcaagaggaagtaatatattcttcggaaattgaatagatttgcagatttgagaaatactgcagtagaaaagaaggtgtttgattggatgttggatggtatcccgatgtggttgattaacaaatacccactgctgaaggagtatcaagacaacctgccctctttagctgccttggattgctctcgtccctaaactgcattcagtttccataacacctggcctttcctgagtggctgtgaaattgctgcttccattgctatcatttacatagttaaaataaaataaactcataggtgaagaaggctggattcaaacactgacctcagagtaaaaaattcaggctcttaatcacagaaatgtactgcttcccaataacaagtgcctctcgaggtggcccaagtaagccccttttctgtggacttgaaagaaactatctctcacattctgaaaactgcagttttctatttaaatagaaaaacatccagactcctaagatggcttcatgctctgcccttgtgctctggtcctagctggttcatctttgcttacagcctcatctttccttactcacactttgtggtccagtctgctgttcatctttaagagccgtcccaaggctgtgatctttaagttcagatgcatgtgcatttgggtgctatacaagttgatccaattggggtatgctagtgctgtgttctctttcctccaggcctttgcccaagttgtctctttcatctgcttgaaaccccttctcacttttgtttggctaaatcctgctagtcttaagctctcacttgaatcctcacttcttccaagaaacctcttctgatccccccaggtctgagattactatacttctcctgaaaacctgtactcaccattttgcatcctgattgcctctttactgacatgttcctgcaaagcttcagtacctagcccgtacctgcctcagaattgtgctccataaatgcctacagaatattaaaagaggaaacatttaatcattttttaatgtttaagttataaacttcattaagccaggttcttagttggttacacaggggtttttatctacacaaaaatctcctgagaagttttgtcttgaggcagaacaaaataattgattctaaaacgtaatttgaattataatagcatcgtaacactgtaacatgaataataaaatctattgggactgtgagcagactcatccaaaaaaatagaaaaaagtgtttgggcacatatttttaaatcctctctgggccatgttttgtacagtagtagcataaaattatgcaacaatttatacttttaacaggtcaatactaataaggagaattatccaaagccaccctctttcattttgctttcagcttagctcatgtccttttctggtattcaatatgtcaccccatgcatccttcagcctgcaacttcttaactaccttacctcaagtttgtgccagataaatagcaatgttaaaagttactatgaatttagtttttttttttaattgctttttgtagtgatgtttttctttccccaaactgcgtggctttctcccattcctacctcagtcttcatagcatgcttttctactccaagtgcgcatgttttgctttctgagaatgtgagattcacccaaataaaaaagaaagggtttggtgttgtttgtcatttggagtttttagtgcctccctgtactacattaggatggacaaaagagattgtaatgccatgaatataaagagttattgttcactacttacgaaaaatactctagctactcattatttcaaagtagtttattttaatcatttaaaaattagttgtgtccacactttgtgctttaatcttttattgtaatttttaatgctaaacatatctagtactccataacacatgctaaatgttgcgttttgatgtatcctcccttctctcctaatctagcttcgtagtcctttgaatacattaattttgtaaattaccgcagtagcagccagatttcataaggatgttttacattgttgtaactggtttcattttcttacttgttcctatgattctcattatataggaactacttactttatgttcttaacacagaagggtcagaggaaacagttattttttgtaacaatttttaaactattaggcattatacattacaaaatcttttgttcttttaaaatagtaaaatgtgcccagagtttagtgctgaagtattctgcagtgatgttgaaaaatgtgaaacaccttttatttggcatgttgtctaaatgctgcctgaccccgcagttcttgcagttggtgcatcatctgaatgctgtctaaccctgcagtttccagaaacatgagatgataatttgcttctttggtgagcctgtggcttaggtccatttcttttcacaaaaaagaatgatcagagaagacttaaatgccctataagtcatttcagaaacattacgtagtgattattttggtattgcctaaagcaggtatcaaggtgattaacattcattatgttatcttaaaaattacacacaatcctttattgcggtcatgaaataagtaatactgtatacaaaaaaaaaaatgaaagaaaataaccagtgacgtttttttccttccatctgctcttccatcatgcaggtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaagtaagcattttcaccagagctgtgggttagatgtcacatggcagaagcagccagattagatccacttgtcgtgggcattaagggggcatctttcctttatggagctgaaggtgagcatatattggccatcattctgaaagcatatggtttggggaggctgatgataagagagtgctcttaaggaattaattacagttttgtctttgactttaaccatgttgaaaattaatctagtaaccttataggaaggctgatctttagagtaataatagttactactaccaaatactaaataaatactaaggctttttctttattattatggacttgatttttttttcagtggtcccaatgtaagtctcctcttgttctgtctataataggtaaaaatagtataaatggtactcattcatttattcagcaaatacagaatgctgtatatgctaggcagtgtgctaaatttgggggctatagagcaaatgtgatacagtccctgcttcaaaaaaagtcgaagatgggagagacatgtgttctaaaaatgacagtccaatatgattagaaaaaaacacaaagctgtgtacatatagtgtgctttgaggacacttgaaggagggttaggctctaggatgtcaggaatggcttcacagaggaggtgcagttctccagacagataaacctggtgagcatttcagagcaagggatgagtaagtgcacggcccccgaggctaaggccaggcttcttgtaatcaagtgcttctagagctggtggagagtcgggagaggcagctgatcgggcagataagagcagatcatgttgagtcttgtgcagtttgcgcagaagtttggatgtaactctgtaagcattagagaaatgtcatctggcagcattcatagaagctatcacaagaggaccagacagaagtctggtttgaaaccaaggcaacaactgtgacagcagagcattgattcacagccctgattgtatattagaatcacccgagaacttccatgacacaccagtgccccaggcccaccccagaacaattgtcttccaaatttttgagcctcaccaggtgactaatccacagtagagaatctttgcagtaaatgaagcagaaaaccagtgaggctgtggcagtagttttcatccttgtcattacagcaaaatggcaggatgaagtggtttcaaaggctgtttggagtcatctccatttaaggtaagtttctggtcatgttccctttcttgagagcagcagttacattattcattttgtagctttgaggggaccatggtttagcaggtagtttcctctgctgttgcagttataagctacagtattgtaggttagtcaaagcttcttcatgagtcgttgttctttgaaactgcttggctctcatagttaatttatttactgtttttatgcaggccattctctatcaggtataactgttagaaaaaaatcctatttttctcttctataaaaagcattatttttgaggttacaaaaattgtataactaaagtactgccctacagtggtgttgaaggctaactgaacattaatagaatacttttatttcatgctatatatccttagattatttttaagttattttcattgcaattgtatgttattgtataagatcaggaaattactagttttagaaggactcgtaattccataaattaggatattcaatttttttctaatatatgtttggacttagatacatagaaactgagactatactaatttttaaaattgcagtaattaaaacatgtacaaaattgaattagagtgggaataactgagtaacttttaaatgtgttgtttttatgaaatgggtaaaggagttataatttaagtcacaattatggcaatagtgaaatgttttacgtctcatttcatctgaaatcaccaaaatcatgttgtgatgagcataatgtatcacaatacacatgtattgagagtgaaatatgtaaaaattgacaaatagaagattctatatttgtgtaattttgagcgagcccatggtattctgataacatttcccagaggtcaggcttctccaatgtctatcaatttgttgtaggtaagaagagaagcaggggcaaatggaccaacatcttaaatttattaaactcaattgattccttttgattagtagaggaaaagaaaatttgctttggtgtgaggaggaattcaacaacacaataaatgttgattatgaagcagttaagatcctcagatcaacatcttaaatttattaaactcaattgattccttttgattagtagaggaaaagaaaatttgctttggtgtgaggaggaattcaacaacaccataaatgttgattatgaagcagttaagatcctcagcggtgggtgtggggtggaaatctcattacactataaaatgaaacttaagcaaatttcaaaagagtaaaactaccacagaatttgaggatgattatttttgttactcttctttactagtgtagaagagaagatcgataacagaagaagttaataatctccttgatctatgctgtacaaagttctagcaatgattcaaataattcctgaagcaataatttttacttattttagtgtaaagtttatataacatttttcatcattaaactctgtggtttatgttaacattaactacctggtttacatgcccatacctgtctgggtattataggtaaggagagcactgacatggataccccagccaaccaatcgtgagattcatggccacagtatggcaccctgtactgagactaagatctttgttctttgtgatgaacaggtgaacattttttattttgcagtatttttaaaaattcagtttccctaataaaataaggtagttccaaattggtgtcatttatggtaactttaagaggagtgaattcaagtactcacacacaatacattgcatcatgaggcaacagaaatagaaaaaaaaaggttgctgctaatgtctgacgtttctgtgcaatttaacgtctctttataataatgtttacaggcttaagtaggtttgtatctactgataaaacccttgtaatgtttattttaatgttattctgagtcattgattcacagtatcttcatccaagatgtcattctttgaacatttattatggcttttgctgtcaattcaactgtttgaaaatattatagctattttatagctgagtaagtgcttctcacatgaagtttgagacctaaaatatcatatatgggggttttaatttttgtgaagaccacttgttaaattgtttgtactcagcaggtggataaagggtaaaaagaatataagaataagcagtaactagaactcttacctgtccatttgtccttccaggcccaacacccaacaattcccttctggcaaaaatctgagtaaatagagctttatattatgttctgaacatcgtcaaactcatactatatcaaatagaacaagtgcattcgtgaattgagagatttacattcagacaaccttgccttttgtcaaatccagtctcactttttcatccatagtatttctgtcttcttctccctaaaactcttgtcatgatgccagaaaggcttaccgttccatttctacaaggttgacgtcagcttccaactagaaatctaatttctaacctgaatagttcctgtaatttatcagtgcaacagcaaccgcttatcaatatagagaacaagttaatgatggagaaataaaaaaatgttgaagttttgactaatgtccttatgttatgcctggagatagacacatcacccacacccaaagcttttcaccatagcaattatcacctgggattttatgatatatatgtgtggttatttgccttaagtttctctttctaactggtctctgggagtccaggtccaagtttacttcatttactgctgataacctgtgtcaagcctatgtctgatagagggtgcactcaaaatatatttgttgaaggattcatttaagagtaaacacattaagccttgaggtgttggatttaccaaggttgaaaaggcaggtcagagcactgctttcacactggaattaaactctcagcctgtcacacactagctctgtcaccttgagtatcgtttccacgtctttaactggggatagtaatagtacctatgtcataagaatgtagtaagaattaaatgaaatcacacatataaattacttagcaccacatatgacacatactggaaagtattatgattgttattattattaggcaaagagagcagaatgagcaaccctgggtattgagaagggcatgggggagtaaaaaagaatatagttgaaagaaaacatggggtgagtggtggacaatgggcagaaaggaggggtaaaattgactatgtctggaagaggaggagcaggtttgggaaatggaaaattagttcagtttgaaatatgttgatagtgttaagtttgaagaccctttagggcatcaaagagatgtccagaaaacatgactcaggagtgatttggtggaagtcatcaatattgggggcagtgaaggggattgtcattgaacttacgaaaatgaaaaaaatattctttgggaggtagaggaggtgatagcagttctttatggaagagaggagagatgtgtaaaggattaaaagtagttattttactcatacaggttttactgaggtaggtgcaattctgggtttcattcttattccaagtgcagactgaataaatgatcccccttttcatatcgatttggagaaagagttgaaggtcatgcttatcaacatgttagagaacacgttagaggtaattcttttgatggttttcttcagacaagactaataatccccattcttcttcccacaaatgttaagcagaatcttgataatttatacaatggcacttttgatgcatctttcaccccaggtgaaagaaaaaagccaataaaattccctggagaaactctgtctgtgtgcttaccttatctctctagctgtctttttttctttcttataaaccctctgagtagaaattacattttataaacactacacaaatattttctcatgtggtaaaagaattttctaagggctttaagaatacagtcaaatcaatcggttgttgcgaactggtgtactttaaaacgtgcttaaccttcctcctggtaaagataacttgagaactgtttcccatatataagaatgtgtaaagctttcccatgaacgtgtaatgagtatgctgctttgttctggttttccctgacaccatcactttaagttgacagtgtttacaaatggagaatctagttgtgcgtcttccctgcaaggttagggtagcttacaacacacactgatttctcttgggattaatgtatcactcatgtcaggagcccatagaaaaaaagtgtagtttcttaaatggttgttgttggcatagatttatgagacagttaaagtcgtctagccctgttgatagacgccagtgtaaacaaagtgtgtgttacatacattacccttgaaaaaacatataacactcagctatgatgcaagcctactaaattatgttagcatttctttcttcagttactaatggagtgttttgctaaggctgttctttgtttgcttttttgatgcataaattagacacaatatttttagaggtttttaacttgtgcttgaacttctaacagccaaatgttggaatttatctgatattttagcctacacttcacctaaaaaaacaaactatagtaataatcaaatcttgcagctaggataaattgacctgcactggtactaagaactgttttccctttatcctattgtcattgggtctttagcacaatgaacaagtgaagaatcgtctctctctgatggcccccgagatcgtgtgttaaagtaggccaagtgtggtgttccttataaaatggtctggaagatattctgaaagaagtgaagtgaagaccttacatttcttatctaccaccctctgtgctactacctttccatatttacttacttagatttgtaagagaatctactggggctgtctacacagtgcacggatcccctctacaatatgcctaccagttggccatgcagactctgaacactgcttttgttaaggaacttgttaatagaatcattcctttccattttcaaaaacctcagatttgaaataattcattgttacctttaggctgaggtatgcttccctcctgccttcacttattggtcacagagaatattcccatttccttatgtacacttaacacagtggacctcttgctactttatgtgggtacctcttgtgagctgttatcctgattctgttgtgttcagaacaggacatcttgttcaaaacaggatgataccacatttttctggccaggactttgggctatgcaaatcagggaagaattttccagtaccctttgtgttcaccagtgaagaaatgggtcctcggacaagaaatagacccagacaaatgcttctctgggctttgctctctggatttacaggaagagtctgtaaatgctgaaggtgtttccaggtggtaggagcaagatggactgatatgaaatagtgattttcaaattagggagagagtactttttcaaacaacccccattctcaagttcagacatgctgtccaagaaaagtatgagtccagcttgaacataaaagctagtattgaggtgaatgcattgtgcaataaataattgtgttgcatatgtaaaaggaaaccaatgttgagggagttcagtaaggttatttatataaataagcaccatatctcaatatagcttaccttgtcatgcgttttgtgtgtgtgtgtgtgtgtgtgtgtgtgtgtgtgtggttttatttgttttgttttgttttgttttgttttggtctgctgttggtcctcagcctttaggaaagtttctctttccctttccagcttagttttagctgtgctgtgagaaactaaggcaaggatcacttggccacatttggactgttttcaagggtgcagtgcctcatgaagactgtatgttactggcatttccatgcagggaagagatccccaagtaggcagtgaaatatcagggagtaagattaaagacaagaagtcaaaatatgttttcccatatggagaatttctttccattgccaccatctgactttaggatttgatgttataagggagcaaacagtgcttccttgaaagtatttgaagccattcatcaagactcattttctcctctctataacatgctgtacctctccacatctcatcttcaagaaaagcatcttcagtttttaaaacatttttataactacaagatttcccaattatttaccattttggttagtttctttaggacatacccgaatctgacagccatgatttttacatgtttcctatgcagagtttctggaccatggtatattttgggggacatgccaggattataggaacttactggctccatttattgtacacttagcaaggatcagggttgagctagctgaagtgacatctctgttcaggctacattagaacacttgctgtttccccaatatatcatgtgctcttgggcctctgtgtggtggctcaggatggaccctctattcaaagtgttacctcatcacttgtccctgtaacattctactcattgttgaaggccacattctctctgaacgcttatgttccagcttcactgaagcctctttccatggcactcacttgtcccagcttctattctggcagttactatatgcctttatagctcttttggtttatatctgtcagaccccagtaagttccttaaggacaagtattttcatttttttctgcctacaatcaacataagcagttcctgctacttgaaggtgcccaataaatatgtgttggatgggaaaatgaattgatacatgtgcttcattattgagaatctgaacctgaggttctagtaaagcaaatcctttttggaaaactgaatcagctcttatatttgcagtgctactttacacatggatgttgtctaatattttgaatttgataagtaatgattttgtgatttatttaaaataatgatgtgtataggggtatctagaatttaggcaggaaaataatgatctggggttttctttagttttagacactgtttttattttgtgggttgtttccttactcgacttgatgaattatcaggagaaaatgccattttcttagggcaggtgagtcggcgtactttcatctcagtatagcacagatttctggtaaaactaagggtattcaaaagtcaaaaatctaatgtaaggttcttttatcttttgtgagttctggagaaagctaattaagattcttagctctgataactttattcttgaagcacttgaagccctgcttgcctcttttagaagagtttgtgcgttgatcatagtgcttagtaaaagttcattaggacaatgtatttagtaaacatcatctgataatataggaattagtaatactacctcagccactagtcataaattagatatgttggtttttctttgaattcatttaatgttaactgatacgtgatacctaaactgtgtgtaaaatcattcattttacatgagacaaagcctttgacaaacacagttcactgaggagtgaacttgtgggctgttggagagattagacatctacatccctaatggaagttccataagaaaggtactgaatctggttgcaagaaatagggaagacatcttgaagaaaggagcatttgatcaagataagattttaataggtttaatccactggactcttccagttaccagaagcagaaatgtactgtttcttgggctacctcaattagtgaggtttagtctaaggctccatggggagcaggaagggcaggaaaatactctctgcagctgcccaggcaggcctcatagagaatcagacacaagctctggtagtgtgagagcccttctgtcatctcaccagaagtcaatgtctgtgtccttctccagtggtctgcattgtagtcatttagctcttctctgtctttgcctccatgaaggcatcctttgtatctctatgacactcctcaagagagaaaaatctatcttggctaatttccattcaacaatgagcacccatgctacacaaagctcatgccaccgcttaggcagcttgccaactagtggatacatgtttttggcttagggactcattcctggtccaataaattgtggcctgggcgatgcagtcacatggtatagagcagtgcctctcaaactttaggatgcatacaaatcaccttcggaccttgtgaaaatgtgcacttttggctctgaggtctaaggattcatgaattctgtgtttccaacaagttctcaggtgatgctgatgtttctggccctgcaaccacactttgagccacaaggacagggcatgatgatttctgtgtgactgtaattactaagaaggcaggcactccatgtggtgggtatgtggttgtgagatagcatttcatgtggaagaataactgtaaataaaagagtggaggaagatgcagtgttgatgtctgtatgtgtttgcgtaaggccaattttgaatatggttaagttcaaaatgaatgaggcatcttcagaacaaaaaatctgggacaatttcagatgtagtcttttaataccaaagttgttggagttggctattagtccttttatggttttaatccaaagcaaataaagagtgattctgatgttttcagtgagagatagtaagcaatccagtatgagtttaacttatttgtattcacttgagagactgccccataactctggtcacagtttcccactaagtctgtgctgttggtgaggatttgcaataggatctgcagtaggacttggttgtttattatgagccagagtccctggtttggacacaaagcgtcagattctttattattctgatgccttaggagaatcatgcattgctataattgtcttcattagagattcacaaatgtgatagttcagcacttaatcacaaagatctttgagtcattaaatgtctgacatttatagagcgaatccgagtttcaaagcatctttacattcattctaatatttcataaatataatctaagactgattaaaaactagagagatcttttcaaaaagttcatttaatgatgctagaatctagtgattcagaattatgaataatgtccaatagaagataaccgaattaacttttcaggtgttctgacttaatgttagatgcataaggaaaagcaatttttttccttctttcctcatttcattcattatattggaaaggaaggctccatgtgatatttacatctagtcttcattgctcaatggcaaatggaagtaaacattttatattgttttcttagctgaatctcatctacttcaacttgttttcttttaaaaatgatttattttaattgtaatgatcaaaaaggaaaacagttattttaaataactaaagagtaacatcctttttttcttttttcatttttttacttaaaccaagtagtttctcaatttatataagtagatcttgaaaagaattttcaaagttcaccttatcttggtaatcatgtggaattctgacttattgaatagtttaatgatatgaccatctttgactactacattttaagttgtcaattgtcaaagaacaaatgccgtttagtataagactatagtgaaaattatgctaaacttggagccagacaaacttacgtttaaattccttcttaacacatatgtgctgtgttaccttcagcaagttatttaatctatctgagtctcatttccatcatctgtaaactgatgatgttcatatctaccttccagcattattttgaggatgaaaataaataatgcatgtaatatattcaacatagacattatcattgaacagaattttaataaataaataaacgtgaaaatcttttaagccttatgacagaataccatttttatataaagttaataacaaaagtacttttacttcatagttgcacaagaggagcattatccattcttgacataagtgaaaattacagtgctttgagttattaacagaagagctgtgattgtaattgccactcagctaattagtctatatagtagaacctccattgtcaaaaaagttgttttccaaaaaggaaattctaactaacctttaaaatgtagtcagtgaattcacacatgctgcagtgacgtgacatagaggagcaaagagagtggtcagttataaatatcattcataatgagacattttattaatccattgtaatcacatggggctctgtaagtcaggttatacccatatgcttttagagagttaggagtggaaataatgtgtatgagtggaatattccactatcattcaaaataaaggaagtcagataaaatatcctccatgtcaagtggaagacagatattcatattaaacttacacgtgcactgtcatatacccctccacatagtgaaatatgaaggcccgtttctgacggttttctaagtacaggccacagggccactatattgatatatttctaataatagaatgctttgcattgtttttataattagcctgccttacgttggtagcaaaccaggagtatccattattttaaatgctgcttcatagcaaatgctgttctagcagtttgtttgttactgtgtttttattgttgttgttgttgttttgagatggtctctctctgtcgcccatgctggagtgcagtggcacaatctcggctcgactgcaacctccgcctcctgggttcaagtgattgtcatgtctcgtgtcatcctcctgagtagctgggattacaagcatgcaccaacatgcccacctaatttttatatttttcgtagagatggggtttcaccatgttggccaggctgggctttaactcctgacctcaagtgatctagccgcctcagcctcccaaagtgctaggattacaggcataagccaccacacccagactgctactgtgttttttatttgatgaagcatctgtggggctttttaaaaataaaatgaaataagccattcttaagaagacaatggaaatggctgggtaattcgttcaaaggaaaggtgaattaaagggcagcctgagtgtgtggatttggggccttgtgagccttcaggttcaatctgggagactgcacttaaatctgggagattttcttaaagctaaattggtttccagaaccaaatgtttaactccagtacagcctacaaatagccaagtcatccttgccaaagcaattctttcctgtagtaacagagtattcatatcttcctgtagtttgagtcttatagagggggaggtattttaaattataaacttttagctaatttccccaagcatcaccttcttatccttttagacactttcagtatatccactagtaattaatatgatttttttcttacacagatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaaggtgagataacttttaggaggaaaagaaaaaacatgtacatctggatgtgactgaacaatatttacattattgaagggaattataactgtcttaatgcaggtatgtggaaaaagagtattgctcttttattttggaaaagtaattatataattaaactgaaaatttttataaaccatgtatattcttatttttgcattactcttcaaaatttaaggaggccacatataaatattgacttaagacattgaggtccttatattacatttaaaaatgaggatgtactttataggaaaaatatagcgtaaaagtgatataaaagtataagttctagtctgccacgtgtactataattacttctcaattatataggctttgaatccttgcgatcttttgcttttctttccttgctgacattgctgatcacttaaaaattacattaaattgaactgattgttttgcttttttgcaaatctggtaaagtaaaagctcatagctaaaatcaggacttagggattttatgaatcccacttttcatctttcttttgataatcatgcaagtaatcaagaactagcaggcaatttgagctcagacctagatgtgttgaaagttagccaagcaaacagccagggaagactctcctacgggaggtcagccagtaaattcaaccagaaaactttggacttgatgtctatagtatagggatctgttgaagtttgaaagttttaaaaaatcttactgtagaaaatcatgtgtgtgtaccctttgccttatgtggttcctaccctttgccaaatttatttttggaaataatctctaaattggcctaattatcttttaagcacaattctgcaattacttcttggagacttagcaccagataaatgaaacttgaattgccagaaaatgtttaaaatttaaaaattatgaatacaattggaagtaaaagtatattctaagcctataaatgagcataataataataaatgtacagatttactataccaaattcacatactggtttataaatatagtaaggaaaagtattgtatgaaataacgtgttgcatttttagcaattggaagaaatttttgaaatagtttagatgacctggctttctaatagaagtgatgtctaaagatatttggcctaaagttttctttgttttccttgtagaaggcaaattcatccacagtcacccattttgttttagagctatttcagatcactgcatcggttgctcagtatacttatttttcattccattaaagaacaactagaaaatgaggccttcccccctttctcttgcctttttagtttattcaaagctactgctcagtttcaaacaaaacaaagaccagtaggaacttagagtgctgttaagttattctacttaacagttattcataagtgcattttatatcctttggaaagctgtaaaaacaattccaagttagcctggttctacaactggatttggaatgagcaccactgcagcattatacgttggggaaattctgaataaactgatgtaacacaaaatacatacatttgttactgtaatctcttaacccaaccttaaatggactataatgtaaaggaagaaaaagaagccgaccatggggaatttactgaatgttctaacaactttccacagttgtaacaaatgtagataaactgttaagagaaagcataaatgctggttcccctttgaagtaatagctaaaaggtcagggctttaaaagggattaccttttaaatagctgaaaggaaaagaaccatggaatcagtggacattattacattgtagcagagagcctactttctggtgggatttgggttctgtgaagtttctgtctgtttaagtcatattttatgatgtgtttggagtataaatggtttcatttttctttctcttttaagcatgactttaaaactttaccttttttcttggaccctaaaattatgttttgccccatggaacatttctattattacaacagaaacctatgaggagatattactgagtgaattaatatttgttttatactgtaaggctttcttttcataaatatatcttttaccatttataaatataaaataggaagatggtaggaatttgagtaaaagaaatgaagaatttctcacataatgcctccaggtaaacaattatcacatattttcatataaatgctttcaatcatgataactaaatgtatttaaaattttgttaggaaagtatatatgtgtatacacacacacacacacacacacacatatatatttgtaccctactataggtatatgttttaattagttcataattttagtaaatattgttatttatttatttattttgagacagagtcttgctctgtttcccagcctggagtataatggcacgatctcggctcactgcaaccttcgcctcccaggctcaagcaattctcatgcctcagcctcccaagtagctgggattacaggcatgagccaccatgcctgagtaatttttgtttcttcagtagagacggggtttcaccatgttggccaggttggtctcaaactcctgacctcaagtggtccacccgcctcagcctcccaaagtgctggaattacaggtatgagccaccacgccaaaccatattttgatttccaaatgatttgtttatcaaggtgatataacatcagatagaaatttggaaaagagagggaaaatattcacccagaattctgccgccccagtgtacttactcctaacatcttattgtgtgcccttggtctttcaccctatttaaatggctttttaaaaagttttagttgtgatgttcaaataatttaatatcattactattttcacctaacattgcaaacatttctcatattactgagtagttttcaaaacatttatttcattaaccatgaactgtgtaacacttgcttaaatattcctccactattggataccaaggcttgcttggtttgttctgggatttaaaaaattgtgtattataaataatgtgttgatgatattcatctagaattttttttccatattttatacctttgaaagcatatatttataaaggtagaatgactgggttaaagaatacctaagtttttagtatttagcacatattggcaatttgctttctaaaaggaatgaatcaatttataattccacctagaaagtttgaggacctgtttcagtatgagcatttgttggcattttaagtattttttaaatattaatttaataattttaaaatattttttcttgtattttatattttcctgtttgcttgtaaactgaatataaattcatgtatttttgagtttgtaatgcccccttttaaaattttctgttcataccctttgcccatttatgtgggacagattggggcatatttttattatcaaattttatgagctctttatttagatatttaaactccacttctggcattattgtctccacattttccctgttttctatttcttcctttttatttgagtggtaggttttcgtttttttttaaattaattgatttgcatatgtattgtttagtttttttatttttgttttactaaatatgttattctctttctttgtggtcaaatacacaagcacatatgtcgtatgaacacatatttttatatatttacatatctttgtatatcttttgtaaatatgttgcttctgagtttaaaaagtcattcagaagtttgattaaaagttcaattttctttctttatttgattttttaatattttaactctttaatccaaccataatttattttagtgcttattatgcattgggtacctgaagtaatattttttccaaattgaaaccatctaacccaattgtgtttatgggatgactttcccctcatcaattgatttgtaatttctctctaaattatatcttaaattacaatatcttaaattataatacataatagtctcttttcttgctgctgatttttaaagaaaattctgtacttacactggtgagttttaaacgattatgcctttgttaaatttgctaatctaagcaaggtttgataatctattaattcattattttaattagtattctaaatgaaacaaaattttatcttatttatgtattaagcattacttctctcttagtgagtttttacctttttctcaaatggatagaccaatttaatacatgatatagtattatgaagagatttgacttgtgcttagaaatcaaaatttttatttataattgtattttggcaggtaatcaggatgaacattaaaatttttttcctcatgatcaagatacttacttacaagtatgatttttatagtacgataaaaatatacaaacatatctagaattaatttatagaatatttttatgaaaacataacccaccacattaaggtcaactttacttagccatttttatttgaatcttattgttccttttgtttgtttgtttgtttttgttttttttgagatggagtctcactcttttcacccgggatggagtgcagtggtgctatctcggctcactgcaaccttcgtctcccgggctcaagagattctcctgcgtcagtctcccaagtagctgggattacaggtgcccaccaccatgcccggctaatttttgtatttttagtagagacgaggtttcaccacgttgaccagcttatctcgaactcctgatctcaggtgatccgcccacctcagcctcccaaagtgttggattacaggcgtgagccactgcctcattgcttcttaatgcaaagtatttttcagtcacttatgaaacaccattttttatcttaacaatgagttttctatttaatgtaaattcttaacctatggaaaatatgtgctaattttgaaatgtcttctttagttatcttagttatcacaaaaataaatctagtttgtagacttagtcattacaaaaccaagtctagttcgtaatagttttaatattaaatttaaagcaagtaggcaatctaaattttgttggaggtatcagaatatttgttcaatgtcatgcaaaaattcattttagactgttttataccacagattagatactaaagtctgagttaagaagaaaagtttctaagtcaaaaattaaaagtgagatgcatgctaaaaataacaaacacaggattatacgttataaaagcaaataaacagttaatgagcactgtcacacatacactaaattgtaatttattttattctaaggtcaacatattcattatttctagatgacaggaagttacttttatgtttttaaaagaaagatcaaatgtgcatagtcatttctggattctgatacgccatctctatacaaagtacctttgtccggtgctctttgtttgtggtgttatcacagtaataataacactaacatgtactgacatttattgcatgtcagtctcctctgtagttactataaatatattgtctcatccaaacttcagatgtgatactaagattctgattttcagtgtaccactcagatcatcactattaagtgatttgataaaactttaaggttttgcacaataattataacataacaggattggtagtatgtaagtttcatttgttgtctcaattctcaaaagaaagttgtaaacaagaggtaattaccaccatttcaagatgcagaaccagtttcagagagtttaagtaatgaccaaaaaagcaagcagaaaaaaagtgaattgtatttattcataatttattataaatttggaattagagggatttacttgtcatgatatttccctttagatattttattctcttcaatcctataatagaatgctttgggcaagaatgtattgattcaaagaaaatgaataatcttcccctgttcacataaggtcaacacaaaagctatttttttggtcttttatatctgtggctatgtaacttgcagttgctgaaataagaatccgaagtattaatgttgcatcttataggtatcctgcaattccttagtacttcatatatcactacaaaagcacattcagaggctgactactttcaaataatgcacattcagaggctgactactttcaaataatgcccattcaggataaaatagcttttccctaactactgataaaccatttttaactctccagattgcttaaaatcactaaatctggagcaggggttatcattggcactgtttttatggtatgccaagctctagaccttagttgttagaagcatgattgtttgacggcacatactttggaggatattaactacattgtatccaatgccctgtttttatgacaagtaatgttagtacttgcttacggtcctgagattaaatataatgtgactacctataatattttattttaaaaatcaatatgttgtcttagttataaaatagaaataagtgaaaatattgtaatgaaataatgcatattttaacatgtaaatactcagatatcatcaaattttatggttcctaaaatgaagaagtaaaagaggaaatgaagaaataatgaagcagtcaaatttgtgcatgcatttagatttaagaaaccttgaagtgaaatttgaatgttatcaatacctatcctttatatttaatattttaaaatgaggacaaaataagtacgtgtgtatatattatttttatatgtatatcacatgtcatctatacttgtatgtatatacacatacatatttatgtgtgtgtatgtacgtgtgtatatatatatagttagggtactagaaaatgtagtgtaccttaaaaccatgcaaacatattttggacttacatataaagtagaattagcttctgaatataaccaatctcatcaatttacacagtagttatataactgaaaaattcattgtatattaaaactatgcaatcacgccggtaatcccagcactttgggaggccgaggcgggcggatcacgaggtcaggagatcgagatcatcctggctaacacggtgaaactccgtctctactaaaaataaaaaataaaagataaaaaaaaaattagctggacgtagtggcagtcgcttgtagtcccagctacttgggaggctgaggcaggagaatggcttgaacccaggaggcagaggttgcagtgagccgagatgacgccactgcactccagccttggcagcagagtgagactctgtctcaaaaaaaaaaaaaaaaaaaagtcatggaaatgttattttgtgtttatacgtaaaatagagtttggttctaacttaagatatttcaaacagagttttaccaatatgaatgtccgatgcatttaaaaattacatgagaaaagctcaattctgtattgtgcaggatattctaagcattgcaggacatacataaatgccagccccaccatctttgtgacaactagacactccagcaacaactaaattctgaagcgtctcctggggcatgagagcacctgttgagagctgtgttatagatgatgagggcttctgcaaaggatgaaatccagtgatctatgtagacaagaaattgagtaaaaagctgcccattttccatgtgggtgctgatggagacatttttgctaaaggatctaaagctttcttaatgtaattcattagtttccattttcatttcttttcaggttttaagagttgctttctctttctacagcaaactacacatagaattaaaaacagggcacacatttagctgttggctcagtcggtaggcaaatcgtaaagttttggggaactgtgagaaaagctatatatccaaatagctactcaacatcttcaaccggatctaatagacttctccaacgcagtatgttctcttctccccaaaatggttcttctcatagcttctctgtctcagtaaatggccactccagtcttccagctgctcaggccaagaactttaggttatcccagactctgcttctttcatttcccatgtctggtgagtcattaagttttgtagattgtgccactaaaatgtatttagaatctgaccatatctcagtacccccactatcactaacctggggcaaggcatcatcgtctttctctctgcaggattttcatgtacctcctaactggtatctcattcttcacaacgttcttaacccagcagctagaatgatgctgttaaacataacgcagattacatcactctgctcaaaattgtctgtggttcctatctgacacagagcaaaagttagttctatgatgaccatagaacccgtcgccctctggacatgtccccactctgtgactcctctagtcatatctttccttccttcaccctgctacagtcaaatttcactgctggctgtgcttcgaaactgcaggtattctcccttctcaggatctcagacttgccttgtccctctgtctggaatgttcttaccacagatgtgtgcactgccagctctctcacttcttacatgtttttgaggaaaattcagcttctcagtaaaacttcccttggtcaccttatctaaaatttcaaaccaccgtcccctacctcagtaggtactatcccctcccatatgccttattttttctccatggtattatattacttatcactacttaaaataatgaacatattttgcagctgtgagagcagagatttgatctattttattgtctgagttacctctagtatttagagctgctgccaggctttggatagcactaaataatagataatggctgaataaataaatgaatatactttttcattctaccttatatggacttttaatgagaatttgttgtgtgccctgtaggatgtggttctttttcttgtggaacttgcagaaggggagacatagtccttagactgacaatgataaacactattgcacttcagtggaatgttgcaggagtattatacgagggttcatggcgaaaggactcaacaccatcttgaggaatccaagggagctaggttgtggaggattgttgggtggattatggcatgatgaaaggtatccagaagagggagattacaattaaaactgcaaaggcacagagccaggaagtgtttgatgtctctaggagccacaggcactttgtggttaacttagcgtaaggtttatgcaaggaagtggtgagaggtggggctggagaagccaacaagagctgggactttgcaaacaacattaagatagttgggttttatcctccagactataggggccattgaaaaataaaagcaggagagtagtggtatcagatttatattttaggttggctgcttgttgattttatggtgctagctgtagacatctgaaagaaaaataatgacaatatgaactaggccagttgtcaaagggctggaggagaaaagaactagataaatattatggggctaaaactatctgaccttgatggaaagttgaatgtgggaagtaaaaacaggataaccaccaaatatttagtatgggtatctaaatggatggtgataccataaactaaaataaaataatggagacagagttagagttatttattttttgttgcagtggtgagccatgaaatgatgatgagtttggttttgttcacttgactttgaaatggctgtgagggatataggtatatctgactagcaaacagttactatgtgagtcagaagctcaggagccaggtcctcagtagagataaagatctacctttgttggaataaagttgaaaccattcgaatgtggaagtgatcactcaaggagcaaatgcaaagtggtgagtcctggatggaattaagggcttggtgaaggaacaggaacctcagagaggagaggagaaactggaaaaaagatgtcactgaagcaatagtgtatcaaaggtcagtaaggaggtactgagcgactgattaagtgacacagagctacaataagataaaaatttaaaacatgttcattatattttgcagatgggggtcatggataatattcatgtgtttttttaaaaagtatttattaagaacatgctgtgtgttggtactgtgcacagctctttaatgagataatgaaaaagaagtacctgatctgggcccctgtagattttatagactggaagagtagagagtctgaatggagggatacagataattaaagagttttaaaatgtagagtgaggaatgctgcaacagggctagtgcagggtgcttctcaattagtagatacaatgccataaatatgctgtatttagaattctctccctacctttaagtccccttaactggagaactgctacttgtccttcatttcttagatcaaatgtcattttcttagagaaacctcctctgacccttacaccagatcaagctcatctattgagtactgtcttcatactttctacttttccttcacagcatttggcatagcttatgaatatatatttgttagtacaattgattactctctgtctacacctataagctccttaagggcaggagccatgtcagactttatcagtgagaaaatattttttcatgcatttggcatagcttatgcatatatatttgtttatacagttggttaatgtctgtatacatgtataagctctttaaaggcaggagccctgtcagattttatcaatgaacaaagtaattatttgttgaatgaaaaaatgaatgaaagacagctagatgtttcaagaacatgggattgcagtcagcttaggaggaattgagatgcaagtaagaacaatgagtagtattctttggaaaaatttggtaaatatgaaaaggtgaaggtaatcattgggtagagggccaggtggaatgaaaggaaggatttagtaggatgacatgtataatcacagagaggagaggtgaagatgaagctgaaggaggggaaaactggcatctgaagatttctgagaacatggggcagtgggatcaagggaagtggtgtggtaaagaagaaggaagaaaactaggctcatttattgtacggctctaccctgaggaataagatttggacagtatactacactttaatgaattcttgtcattataaattaatcataagacttaacttgaaacatgaaattttctgtaacaaaaaaagaactcagtacattggagacaattattgctatcagagtgttggccttaaaaagctaacattatagcaagagacaccaaataattttgaaatcagcatctatttatttttgcagcatagtctactgtgatagaagcagctgtttcttattcatttggagttttacacctgataattacctctaaatagtagtcttttacacctagtccttgatattttctattgactccctgacatggcagttgaggattcattttacttacttgaattcagctgcattcatattgctgcaaaggatgtgatttcattcttctttatggctcagtagtattccatgatctatatataccacattttctttatccagtccactgttgatgggcacctaggttgattcagtttgtttgctattgtgaatagtgctgcaatgaaaatgcaagtgcatctttttcatgaactattttcttttgggtatatccccagtaataggactcctgggtccaactgtagttctaagttctttgagaaatctccaaactgctttccacagtgattgaactaatccacattcccagcaatagtgtataagcattcccttttctttgcagcctcaccagcatctgttgttttttgactttttaataatacccattctgactggtgtgaaatctcaggggattttttttatttcaatagtttttggggtaccgttggtttttggttacatgggtaaattctttagtggtgatttctgagattatagtgcacccattatccgagcagtgtacactgtacccattacattatgcctcatccctttcccactcttacctcctattcctagtccccaaacttcatgagatcatctttatacctttgcatccccatagcttagctcccacttataattgagaccatacaacatttggttttccattcctgagttacttcacttagagtaatggcctccagctccatccaagtttctgcaaaagacattatttcatttcttttatgctcttcagtagtattccatggtgtatatatagcatgttttctttatccactcattgattgttgggtacttagattggttccacatctttgcagttgtgaattgtgctgctataaacatgtgcgtgcacatgtatttttcatataatgatgtctgtccttttggatagatattcagcagcaggattgctggatcaaatgatagctttacttttagttcttcaaggaatctgttttccatagtgattgtactaacttgcagttccacaaacataaaagtgttttcttttcaccacattcacaccaacatctattgttttttgactttttaattatggccattcttgtaggagtaaggtggtatctcattgtgtttttaatttgcatttccctgataattagtgatgctgagcattttttcatatgtttgttgactgttggtatctcttcttttgagaaatgtctattcatgtcctttgtccacttttttatgggatttgtttgagtttcaggaaatttttttaaagctttccttgtaacttttgtttctaattaattcttccaggtatcaaaagtcattgaaggaaacacatatataaaaatactttcaaaaatgaattagaggttaggattttatctagagtaaaatatttgttgggggcagtaatacataacagtcaacttagttatcaaatgctgcttaaacaataaagtaagccttcatttcttggtgaaactggagacaaatacttgtgggcagatgtatactgatttagtcataaaacattgtaggtttagcagttcatttactgttattcttctaccttatgattaggtagaaccttgtttgaaaataaaaggccacattccagttcttttttttagatactttgtgggcattttattgaattaaatgtaaacaacttgaggaggacaggtactattttcttcatgcagatggttcccaagttaggatggtctgacatgatttcgacttttcttacgatttttcaacttttccatgatgtgaaagtaacatgcgtttggtagaaaccatatttcaaattttgaatttcgatcttttcccaggctcaaagtaagctgggcagtggcagcgagctgtgcagctggcagtcacccgtgccatcacgagggtgaacaactgatactcacagtggactgggttgccagcattttttggatattgtgttttgttttttcacatcccatgtctacaaattgcccattttcaacctatgatattttcaacttggagcatctgcctacatatgtgtgtgtgtgtgtgtgtgtgtgtgtgtgtgtgtgtgtgtgtgtgtgtgtgtatatcttattacaggttttaatccatcctgtgaagaatatcctaggcacaaaaatggctccttgtgtcatttccatctactacaatgtggacttaatatcaaactcttataagggaatatctagcttattctgaacatttcatcttatgaccttaagtatagaaagatataagtaatgcttggtgcctaaatattcaattccttaaatgtcagtcatccttatttgttatagatagaagaaactatgagtactaacaattcaaatgtcattcatgatttatgagtggccagttttatctaatggattaggattatctagtctttctccatcttttaagtaaaaagagaattttgatactaaattttagccacttgggcagttagtttattttttagcagagctaaactcatgaatatttttggagctataataaaaaataaaaacagcttcattgagaacaaaatgaactttctgtaaatataatttaaacctatgttttaaggctttgtgttttaaaaacaaagatgacactgttaaagtgagactgataaaggtgtacttggggaattcatcagcataagaaatgtattatcccctggtagtacgagtttaaaattacaacttgcttagcaaatgtgaaaaataatgtctcctgttgcagattgcattttgctagtttatttctctgttagtgtcaaataaaatattcatatataatcaagatatattcataataatattaaaggcagcactgtgtacttgacagttggtaaatgatgaaacaattttttccgtgattatgtgtataaaatactcaaattaatctatagagccatataatcccaaaatgtacaaggttactatagagcttacaattttaccacttcctgtacagaaatattatttgaccaacggtattttagttgcctgctgcatttggaatataataatactaataaggaaagactgttaaaagagaaaggctagaaagtgcaaacttatttaaatgaaataataaataggccacataaagattttagaacccaatgaagcaatattacaaacagatataaaattacagtgaaaattatatgtgaaatatgaggcaaaacttattagaacaagtttttctgtcaggaaaagtgatgccatttgaaggaagaatggcacagaatggcaaaaacaagaagacacagatataccttgtggagggagagctgacatgtttgtctgactggttggcaaataatatgattgatcttctggtgttaccttttaagttcatcataagaggctacttagcataataaagaaacacatggattcaaaatctttctcactcacgaggattatcactcaggcagattacttttctgaactctgtttatgaagaagaatgccaatctcatggtgcagttataaggcttaaaagtgctaatctgtgtacaatgcttggcacataataggctctacgcaaaaattagcgctctttccttggtagatcacccacgacactgctatcagtgtcaaatcaggaaatttgttaagtcgtattatctccactttaagatcaaacacaatatatagtcaaaaagttgaatgtacgatgctttgggttttcggcagttgtcttcaaatatgtcctagtgctcatgtggtttaaataaggatcagaaatgattcagaggtccagtagggctgttggcctgtggtattcctaatgccatttactgtgctaaatggatgtggctacagtaaccattgataaacatgaacaacagagggtaagtgctggactaggagctgactcacagaaagctaaagggcttaagcttcaaagaccttcacctgcacaggccccttcttaggccttgtatctaatttgtctttgtaagttggattattttgcttaaagaaggattctcaaattaaacaatctacaggccttgcaaaacctggatccactgctactggtctgtcatgtaaaaggaaaaaaatcactatgactaaaaaagttagataaggcaacccatagcaagaaacatgagttttgcttttcttgcccaaatcatgatttgttggtaactctcgaccctaggtgcttatatgcccttgaccacacacttgcctatctaggaaagcactctctagtccagcatcagcctaagaattgcccatatgaagaagtaagaaaggggactgcctggcagtccaggaacttgcagttaaattacccgggtatttgatttctggcatttttaggtgggtaaaggggaataagtagatgggaaacaactttatattgacctgactccatatgtgccaaaacgagtttggcactgtgcataggttatcacattttacactggttggtagggaatattatctaacttgacacttgggagaggtaaagtaacttctttttaaacagctagtggagctagaattcaaacacagggctttgtgaagtcaaagctcatgttctttccaacctctctgtaaggcagaagcttacctgccaagtgtcagtcacccactggaaaggaatggacatttcacctcccagttcacctaacgattttgaatacataaagtcctgccagccaattgacaaacttttctttcttggtcccttcatttccccatgtatgaagtgcccgcctgtaatatgctgtgttccacttaattattacttcttcaaaatgatcacagtcaccaagaaactctccagttaggtaggtcggtagacagaagataggtagatagatagatagatagatagatagatagatagatagatagatagatagatagggatgggaggaagggggagagagaggtgttatcttttaagtgacatttttgtgattactatgattaatggccgttattagttcacaagcagcctcatgagttcttttgaaattcatattgttccattaaattgcagttttatattttagttatttaatccctaaaactgaaatactgcacataatttggagttaggaacttcaaaaactttttattcctaaaagctatacaacaaggttttattttaaagtaaagaaaaattttcatctctcaaccttttcatttctcctttcacagaactcttctctttttcctggatgattttatcccacctccataatcattgaccagtttttttaatgcagttataactacactacttcagacattcaaataaatacactgtattaggggaaggaaaggataattttaaaggaaatatgcagagttttagcttatggctaagacttgactgacaagagtcaaacaactactgaaggatttgacacacttgttaattgtaaaactcccaattgctttaaaacattcactgacactctagtcccgaaacaacacaatgaatagaagcctccactagtcaaaatggtatcaggagcattttcaataaaatttctaagcaaagaactcacatgtgaatgaataaagatgtgacttgagcaagtacctactccaagtgcaagcttgtccaacctgtggaccacttgctgcccaggacagctttgaatgcagcccaacactaatttgtaaactttcttaaaacattatgagatggtttttgcaattttttttagctcatcagctatcattagtgttagtgtgttttatgtgtggcccaagacaattcttcttcttctagtgtggtcaaaagattggacacccctgccgtagtgaagtagtagactatttttaggaggtctcattttagtaacaggagaactgggcaattgtattagtccattatcatgctgctatgaagaaatacctgagactgggtaatttataaagaaaagaggtttaattgactcatggttccgcatgcctggggaggcctcaggaaacttacaatcatggcagaaggcacatcttcacagggcagcaggagagagaatgaatgcaagcaggggaaatgccagacgcttacaaaactatcagaacttctgagactcactcattatcacaagggcagcatgaaggaaactgcccccatgatccaattccctccacttgaccctgcccttgacacgtggggattgttacaattcaaggtgatatttaggtgggaatacagagccaaaccatatcagcaatgtaaccaaaatattatgtattttgattaaataatgttaagttaaactatgttgtcttttatgattattcatgcaacaaagtacgcacagataaagatggctctaatttctatacaatatctttccatgaggattctgagttgagtttccaattttatcgcaaagagtaaagtcttgattataacatggtctcactgcttgaggcggtgactaccacactgtatgttatatatggtgtatgtatatataccataccaccactgtatggtatatatggtatacatatatatgtatatatggtgaactacccaaaaatgaaatccttgttacatgatgggtgaagctgtgtttacatgtaacttgactgcaacaatagaggaaggtgcttagttgcacagatggtattgtacaaacagttctacaaacaacacatttacaaataatattagagctgaaaactaaaaaggtattgcaaatacatttatatctgctataatttccttcaacaaagagacctctgctttttggtatttattcacaaaaacttttatgtaatcctttcttttaaggaatactgtttatctctgcttattcccccaagttggctcattcttgctgatcatagcataaacaaaatatactttcaaagcattttaaattgcctcctaaccgttgaattaggtgtatgtctggaaagataaatgtgtcttccttggaatgtgtttgcttttatattggtcaagataagccaacagcttgagtacctgaaatattatcaagctttgcacacatgaaagtatttggtaaaaggataatcttggagggtatgattataagcaaattcacagcctcaggagtgctgtgagagacttttattttggtgaaactggtaagtgttgtttcataaaatttgcgattttgctttttaaaaactcagctaactctttccttctccttccctctcttgctgatacagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtggtgagtgtctgacatacttatgggtgtcttccctgggaattaagtagtgaaaatagaacttggaaatgtgcagccatggtaattcagagcacctgccatgtgcccagtgttcagaggaggatattctctcaccctttaagaataaaatttaaaacttaaattttgttaccaggacactacttatatgagcaagtagtaattttgtttgaaaaagcagcttattaatcacacgcagaaatctgaagttatttgcctcttaaatttctgaaaccctgtcgtaagccacttaacaagaggggcagtgtcatgtatatttttgtaatggacaatatccagcagcaggtcgtacacatatcctccactcattcatggaggacctgcaatacagtacagcatggagcgtagcctaggaaggcaggggaaaaaatctaccttttagagccctgtaatagagttccattatgtctatataagtgataagttgcatatatttttcattgttttaattattaataggtaacagttaatataataagtatcaaatgccctcagtgcatacaaacccaagtttaattatccaagtgaaaatgcttttgtggattgactttttaccccctcttcctcaacaacacatagtagcctcatacacaaccccttcccacactggtacacaagtatgcaaatagaaacacagacacctgcccataaacaaatcaccctggccaaatgccactgcctttgggtaatgcagggttcttcggcggaatatttcttcttctgctcctctggaatgtattccattccctgctgctctggaatgtaaccatgtgagatttcttcccctttttcatcacatggatgtctgttagaattccttttctggccgtgtttctcatgtgtaggcaatactttttatcatcttccacatttccgttttccttcctacttttgcctagttgctttatgaaaatctttatatctctccttagcccttggtcacttcatgactgttgtgaaccattttcctccttagaagcatatgatacctgatcagaacaaagctgatgttagtgatagatttctatcaggtaaaagatagaacatgtatacgcaaatgcactttcacatatggaaaccaatgccgtcattttctaaaatctatgtgatctctataaaaatattcttcctgaggttaatggaacataattttccacagccaatagcattcaatagtcaagactgcttttaatgattttccagtgcgtgccgcttcttaatttgcaaatatggtggatgttataattatataaccaatatgtatgtattagttaaacagatattggagggataactagggaatctaaccttaacctctaataccatgagaaaatcaattgcaaattaagttctgagatagaagctgtttgcaaatctgtatatggagagagcaacatgaaaacacaaaatcactgtattttttgcattgttattttattttctacttcagtgccacctttaatttggtcgtggcagtgtgtttccgtccattctttattttaaatagagaagtcatttatttggctcatggttctggaggctgagcagtccaagatgtagtggctgcatctggtgagggcctttgtgctgcaccatagcatggcagaagggccagcaagcccacgagacacagaaaatgggagccaaacttacccttttgtcaggaacccactcccttgataactaacacgctcctatgatagtggtattaatccagtcataagggctctgctctcaagatctaatcacctcttaaaggcccaacctcccaacctcctttttggcctgtcttttgtgtgtgcaggcgcatgtgtgcaaataaaatcacatcaggttaagcttgtcaaagtagggagcagctggctttaagataaactctctcatccacacatattttccccaccccaagcacagctgcctcttaactgctgttggaccataactccaagtgaagtggtcctccctcccccatctccacaaatagcaggaaaagtaatgttgtaatttacaaagttacttactccctgccatttcagagagaagatggagtataggaaagccctcccacccactgtccttgtgtgatgtgacacaacttgctccctcagtcttggaatacagcctcatgtggtccttggccagaggcagagaaagggccttcatctctctcacagctgaagggtgggaaacatggtcttcattccgtgtaaccacgtgctcagctagagatcagaggttctgctcataaattataaaggagaagagagatttggggatgattagcagcctctgacataggggcatctcccccagtgaggcgtgggcagattattaaaggaatggtactgggaataaaagtggctgaggataaattttaaattctcatattacttcttacaaaaattctaagttttaaatcaagtcgtataatttttaagaataggtcttcaattgatttctagatggcaaataatttatataaacaaaaacaatggagccttctccaaaaatgaatactcaattaaaaaaaaaaaaaaagacaagcctggagccagaattgaagaaatacaaatagccaatacatatgttcaaaaatattcagtgttactagctgtcagagaaatgtaaattggcagtctcaaaatgagatactttgagtattattaacttgataagacatctgctaactattgattagcaaatgttttatcaagttaatacttaatattggactttcatacttaatgaattgaaattttgtacaattcttttgcaaagaaatttgatactaatgtgaaggccattttaaaacatgataaatctagataaactgaaaatgggttatgtgcaagtataatttaaaatagggaaaagaaacaaaaaattaagtataggaatatttaaataaaatacgatatatggatatgatagcaattaaaaatgatgttttagagcaatgttactaacctaggaataagagatagtatgcctagtcccttaaaacagtttcaaaagtagatgtaaacatgttttgaacatggattacataattggaataagtttatttcctatctcgttccttcaattctgtgatatttgagaggaaaaagaaaatcaatgctgttactttttagttatgttttattactattaggaaaatatactgataattatttaaaaaggaaatatgaatgaacagactgagctatgtgcataggagaaaaacacattcttttaaaatatatgtgcttatatattctaaactcttaagcatcactttaagagtgtactaaacgtaattattcaatgggacttattacttacttggattctgtcattggcaaaaaatataaataaaacccatatctagacatggtgctaatggaatggagatctttttaaattagatatttaaaacagtgttgtatacatgtctggtcatctggttccaaagatcatttcttaagaataaaaaagttagtatgttttgacaaacttccaacaaatggctgtattagtttcttttttagtgtaattgattattctaaattactgtcctttaatttatagaatgatattgctgtttcatccttaaattgccttgtgagtctactgcaaagtttctctctttctcatctcttattgcatttgagttgtgcggccctgaagctgtgtcacatgccgtaaggtttaaaatacaataacaacatgtatttactaacctcttttttgtgcctgtgtctttcaaagtcagtgggattctgatgttggactctgctatgtatacttatggctagagtttatcatcactgcttagtgattcatttagaaaagaaaatgctggctgataccacttgacatccttaccagcactttgcctttttattttataagtgcttcctttttcaattcgttaaaatgattcacttgagtaactttcaacgtactaggtatttattcatagttttctctaacatcttgaaacgtcccatttttagttcagtctgttaggcgttcatattattagttttctttggacccaggatgtaaataaaccacttctttagatgtgggcttggacagaagccctctgtaggacctaccagctctccatgttatgaggtaacaagattttctcctaccaactcaaaatgtgccacttctttcttaatcttttagcattgcgaacattgaaaatggaaaggatcttaaggaaaagcacaaagatgaactgtcctggtagaatacagtaagccagttgctttggaatgtttttggttagaaaggataagtgatttatgtttgatgcatgtgctcaggactttggtgaagttactaaacttacatgtgtatatctgttctatacctaatcctgatacatttcttagatatatacagccttaagtgtaatcagactacttaaaaaataatatacactgtggtatttaaaaagcatcactgtaattatttggtaggttagttttaagactccttaaataattttgccttttgttttccagctggaaaattattcattgcacctctaattatggttttgggattggcactaggggccatagcggttgtaatcggtaagaaacacttcatgcatctgagattagaattatctgagggccatagagagaatacgagtgtaaatgtaataatatgaatcagttattaagtggacataatttatgttgtatgcctgctttagatagattaccagcatatcatttaaaaggtcagaggagcgtgtttcctgtaggatatgttagtatgaatttttcagtctatgaacactgtgattcatgtaccttataaagcattattaacccttttataacacaaagctaatagaattagtatccttagggaaaaaggcaagtggaatagaacccaaattttctaattctgagttcaggttgaagcatcaaggaaaagaagctctgcaccttatgtgtttcatttggtccagtaaaagatgccataggtacaaacagataatgtcagtgtgtacaggaacatatacccaacatacacttgagcactgacaaatagaaaaccttgcagtgatttgcatagttttatttatgcaagtatattaaaatgtgtattttaaagcagtggttctcagactctagcatgctttagaatatcctcaagggctggataaaacacacattgctggtttcggtctgcagtttctgactcggtatatgggaaaagtccattgatttttatttttaaaaagttcccaggtgatgctcatgcagctggttcagggaccatactttgagaactattgctttagtaattttaagctaaatgctatagataaaggctgctttgatcattgttccatatattagatggggtttttttgctaaataaaatgattttcgtatgtcaacttgggtttagcaagtaataaatgtgcaggacagatagaattataaagtatctgacatttaagttcttgcaatgtgagttaggacattatgtaatagatattattatctgtattatacagttgaggaaattaagacttactggaacctcataagtggtagaaccaggaatcaaacccaacatttggctccacagcctgtgttgttaagtgatatgctatactgcctgaaacaagtgtgagtatcatagtgtgcaaatgatatgactgtggacaataaagaagatttaaaccaaagttttgatatttggatagaaatcattattattaaactggtatcactgagggtgctaaaggggagaaaagctaaagggaaatattaaagaatgaaatattgaagaagtaaatacatttcatagcatagatgtcttcttctttgtatgttcgtacactgcaaataaataaacatagacattttaaaataggaaaacctaaatgcctctcatcctaactaactttaattttttcttatccctaggtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgattctccgtgggccacaatgcctctagctatggtgcactcccaacatggtatcctgtcctttccctaaacaaattgctgctgcttttaaaaaatggtcactttcataaactataaacatctatatcataactctgacctttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgagaagaata

SEQ ID NO: 2582 - DNA, 47516 bp, Homo sapiens
gtatcattgattaattgagtgattttagtcaagtgaatattgatacatggctgaaaaagcatgaaaataaaatgaacacgtacgggaattactattaacataagcgataacatcaaaacatctggtaaaatgcagttaaaaaaacaacacaaatgaaatggaatgtaaaacattttcacagtattcaaagcttttgtaagagacttaggatctaaaagaggagtactacaggaagaaactagaggaaacgggaatttcatccatgtcctgtgtatctgctggcaacaggtcagaacggccagtatgttattccctgcaggctgcctagggtgctctcctcaaacagatcacctgagcctcctgcatctatgaagttatgacacagcaaccagttactcagagtctgatgagaaaaacagattttaggtttgggaaatgggattactgtaatttacacatccaaatgcaaactggagctctgattgaattctaccctggggagaacttgatgctaacccacaggtaccaagagccaagtgttacacaggatattttaaaaataaaatgtttttggaatcctcacctcccatgctatcttctaagataactacaaatattcttcaaagatttaactgagttctgccaaggacctcccaggactctatccagaatgattattgtaaagctttacaaatcccaccttggccctagcgataattaggaaatcacaggcaaacctcctctctcggagaccaatgaccaggccaatcagtctgcacattggttttgttagatactttgtggagaaaaacaaaggctcgtgatagtgcagctctgtgcctacagagagcctcccttttggttctgaaattgctgatgtgacagagacaaagctgctatgggtctaaaaccttcaataaagtaactaatgacactcaaggtcctgggactctgagacagacggtggtaaaacccacagctgcgattcacatttccaatttattttgagctctttctgaagctgttgcttcctacctgagaattcccatttagagagctgcacagcacagtcacctgctcttccgtattctgtggtaactactaatgttccaggtaaacccctccactaaggactctgccgcagagagagggcccggttgcatgaggcactttgtcaaaatgagcagatacgtatgagcactgaactcttgagtgaatcaaccagaactaagacccagatccacgcactcaggaacttgctctgaatttcagtttgacaacagagaagtagaatatttctaattagctaatatatatacacattttttaatcatccaaaattacaggcaaatcacttaaggtccccagcactttacgatgaaaggtcagagagaaccccacaaaaaaggtgttaaaaggacaggatcactaactgtgagaggttaatttatcaggataactctccggtaggtaactaggcgggcatgctgattttcatactggagtcttcaagagttaacagaatctaccatcctttcctccgggtcaggctagggccgcagggggccactttacagcctcactgcagcatcctcactgggtataagcattggcccagagggacaatcataaatgtcctcaaagtgttgcagagaattaagaatccggctttgggggaagaaattaatatgcattttttttagaactacttcctgtacattggacaagaagggtaaagttgtctaagtgaactggcttatatacatcgctgattaaacataagggctttgggaagtatctcagggtacttgggaaaaactgcagagatgttttgcttttgaaactctctcgctggatggggacaccccacccatgtcaactttccatctgcagaaatgaaacaaatatatgtaaaaagtgcggggggacaggcaggctgttctgaatttctttgatccataggcaatcaagttcaaaggaaatgtttctttacaggaaagaaaaaaacggaaagctctgtgagttttgctagggggtgttaggttctagggcaaccacggactcttcaggaaggaaagccacacagctacactaccagggaaatccgcctcccttggcaaatgcctggggagagctgctcctctgggaagcagcctcggacggatcaggagaccttgttctagcacacctttcaaatgctcaatgtagactgttttaaaaccttgaaaaataagtgggtgtttgtcattgttcttttaaaaatgtgaaaaggaaaaaacatgagattagaatcctaagctcttcacccaatttcacaattcaccctgactagcaatttgctggactgttctaaaatttttttcatttgtttcttttttaactatgtgttttgaaaactactgccttctcagcccgaaaatcgccgtctctctcaggctcactgtggtttcctttttctgacacaaaggcaggcacaggctgcccctccacatgtcttggggatcagatcatgccccgggctcataggaaccgaaactttggggcatctgagactggctgattcagattcaaagacaatcacacggaaagactgtgggcagagaaggcaatgcctctcccctggtccctttgctgtcactattacataatggacttgcacttttcctccctgcacttatcactttctgggcttgaccttaattgtaagtgtggtatgagtctgtttccatttaaagcagacagaaagaaactactctggacctgaaaacaacgtgacttgccaatcattagaattttctagttgaaaggcatagatcagccaatagatccacaccaacaagttgcaaaatgtagtttttgctgctggctctcactttccgcccaatccccctttttgtgttttagtggctgtgttgctgttggaaatggtttgtcacctcctcctgtgcagtggctgctgctccacattgcggatcttaaaaaccttcctaatctaaatggcccttgctttacccggccatggctaccctggggtttggagcgtggctatggagggaagggagcgggaatgctgcaagaacaagccgactggattacaatgtccactactgacaggcgcagtgcgtgtgtgtgacccaccgggttcccggggcactgtcccccccgctcccaccccacccgaggctccctccccaccctgcccccgggagaatcacttaaacacggactgaaaggtggggcactcatggtttttcattttcttcatgaagtttttgaactccttgtttttcttgtcccacttgtggatggccgtcagcaagtactggctcttcaccttgcggcccatgatgaggaagtggtggctgaggttgtccagctggtggcagggacagtcagccccattcttcaggtacagcacaagcttcttcaggtccttcttcttgatgggccccaacttcaggggcttcttcttcttggggacaatcttcttgtcgccattttcttttttcacttcttttattttcatcctcagtgctagagatggagaggacagaagaagagaaaagagggtaagagaaagcatttagaacacagcttttctttttttgatcctcaaagtgattgcattttattattttattttttggcttatactttcttcttgtaaatatatatgtttttaattttagattcaggggcacaggtgcagagttggtttcatgggtatactgcatgatgctgaggtttgggcttctaataaccccatcgcccaagcagcaattacagtgtcggccatcctccctcatgtcttttggaatctccagtgtttactgtggaacaaagcttttcatctagaacaataacccaagtgtacagctgaggtggagaagaaaatgaaaggcaagtaacaagtcaagaaacaggcagttttatccataaaaaccaaggtctgttaatcccagcactttgggaggccaaagtgggtagatcctctgaggtcaggagttcgagaccagcctggccagcatggtgaaaccccatctctactaaaaatacaaaaattagccacacatggtggcaggcgcccataatcccagctactaaggaggctgaggcaggagaattgcttgaacctgggaggcggaggttgcagtgagccaagatcacaccactgcactccagcctgagcgacagagcaagactccatctcaaaaaaaaaaaatcaaggtctcagttacccattctgccaccgcctccgccccctattctgtggtgtccagtggtatctctctgtaatggccatcggtgccaggagatcctcaaataaatttcaaagctaaatcacattgctctttttaaaaatccagttatcatgcactgctttaagagaaaaaagggtcctataacccaatttactccacatgatctgatgctattgatctcatcattcaaagacaaaaaatcctgagtgtttttgttttttattgttgtctttgtggaggcagggtctcactctattgcccaggctggagtgcagtgtctcgatctcggctcactgcagcctcaaactcccgggctcaagcaattctcccacctcagcctcccaagtacctgggattgcaggcatgcaccatcatgcctggctgatttttttttttttttaagagacggatcttactatgttgcccagaactcctggactcaagaaatcctccctcctcagcctcccaaagtgttgggattacaggcatgagtcaccacgcctgaccatgagggtttctttttgtttggttttgttttgaagagcaagttattggtttagtattttaacattgaaagacctacaattccttgaaaattgagtcctataaaatgacaggcagaactatgtgtgtgcactcagcaagggaaagttaaaggttgtttcaaatggtcatgcttcctgcattaaacatcaacgtccaaccacagcatgggagaaatcagtttctactactgggtctctatggcggtaagacagcaggtactgctagtatcagtcaatcgctaatcaaccactaatccccactgacaggcagcactaatgttctgccaactgagaagacctacacaaaatccaaatctactttgactttctggcagattagagcaagttctggtgaagtcctaattgataaatccaggtgatgagctctcttcaaatccaatatggtaccagggctgcttctgttctcaactcccaggagtgtgggaaaatcagcccattcaccaactctgctttctcttttctctgtcccaatggacactgaattaacagtgttaacctgtgagccacatcctgtagcaatgactccacaggggctgctgatgaagataaatgagcgtggacatgctctataaacgaagcagactgaacacacagtgtcgcgggtacaatcaactcccctttaagactggtcagcccgagatattcccaaaggagttggaaatcactttctaggtgccagtcaccagataatttgcgtatcttctgaactctttttaatagaaaattaccaagccccctctttttaatgatgcaaggcttccacccacacaccctgaggaaagtctttaacctgaactaaatcacagtggctaacaattatgaaagcatgtgacctgccagaacatgtgctaagtattttccgtgcatttcctcagttaattctaacaactccaggaggaaggcataattattttcccatctaatagatgagaaaactgaggcatagggggttaagttggcttgcctaaagtcactaatcctaagttgaaacccatgtctaaatgtgcacttttaatctgcatgttgtccatgctgactctatggttccaaaattctttagaatggaccccaaacttggagtactgattaaatggaccaagaagatcacagggaggagctcagaccctcttcccagtttcacctacatttcaaaatgacttcacttatgaaatggcaaaagagtgcctcctggttgaaagagacttctctggcaaaggagaaactgcatttgtgaaagctttattatttaatattttaatttattttatttattagagatgggagaaactaatgcatactccagctgacaaggcgagcgccctcttgtctgcagagaagtgagccattgtaaggtagtacccaccacatgctgggctctgcagatgagaatgggatatgtctatctacgactccttgtttaatactcgcagcaaccatgttaagaaggcatcaatagtactttattataatcaaggagaaggactcaggttaagtaacaacagcatgaggccacagtttgtaagagacagaatcaggatcagaacccacacctaaccccaaaaccactctttcctgccatacacaccacgacccggttagaagtgatattgcttcattggaaactatttcactcttctgattgtgttgctttcaatcacaattcaaatcaaaaattaatgttcctttgccatgaccgtgtaaaggaatgtagtttacgtaggtgggggagcagccagggaggagaaatcagagtatgggaatgtgttacacattagactttacttcttgtcttgccacttggcccctttctttttttgaggtggggagagcaggaaagaaggcacgtatggccagaaattactaacatctttccatctttcaagggtttgttttaggagtgcagactaccaacaatgttgaaaagatcatgagctgtcccgggtggatttttccttgtgggtgtgtgtgcagaccccaccatgatgcatcccggggctgctggggcgagggcaggtgctggcccaagagcagcccggaactgatcaccaccaccccatcccatcatgctcacagggcctgggccccagcgatgttgcccatggcctgaatttgcaatgcaaatggtggtggtgaacaaacagaagcccagaaggtagcagctggggcaacagctggatacagtcccaggtcctgggttcttctctgagtctcagtactctgtctgtaaagtgcagggcaccatccgactgcaggcctggtggatcgaccatctgaggagcccctgctgggtacttctgggagacagcaaagtttatctccagcactatccccaccctgtgctcactccatgcttccctgattgggcaccctgctgtgcctggagcatagggctaaaactaaactaccaccttggaccctggatctcagctccctgtaacagctagaccctaatctaaaaccaaacaaaaaaattttaaaaattatgtgttttttttcttaagcaacaattttaacatcctccaagggtaggacatgactcccacctaggcatagctgccagcaagaattcagagacccagaaactttgaaaactcaaaatttgaggctgcaacaagggcctgcctgggtctttctcgggaaatcttaaaataatccattatatttgagtaggccattaagctttcattctacttgcagtcacccaaaccatttttgctcacaaattatacttccttggtagcctccctcaagaagcctggccttatttgggaagctgaaatgagaatgaggaagtcatcacacaccatcccaaaccctcacattcttcaaagccgtctcttcctcctgactccctgcttctatgagtggtgcctccaaccctcccaagcccgagacatcctacccatgactttgaacgtaaggcaaccattggcccagagccagtcatttcataaccagtcctgtggaatggctgtaggaatccaggaagggtctgtggggaaaggtggcatggggttgcattaggaatcaatcttataactcctctgatggcagatgatagtagcaatgaagggtaaagtacagagggaaagagggacatactagagagcgccttcgtcaggtgaaaggaagaagagttactgtaaatgccacgggaggccccgctgggaaaccaggcagcccagtgtcaatgaagaccacagggtccatttaaatggaggaaacacccctcaaccctaagtgccgaagagcttaagaatgagtctgaaactagagcacttcactgggtgattagggggccacgccaacccataggaggccaggatctggagtggtgagggcaaattccagagagcaaaaatccaatgggaagggaaaagaagagagaagccatatcaccaagcttctggactgagtgcgaaggagcacttgcaggcacgctagccacatggattagactgagcccgtgcaatcattcccactcttcttgaagtcagtttaaaattagagtcaaaaaaacaagttataaacacatgcaagaaagtggtaaaggaaaaaagaacatatcaacattttgtatgacagaaagcaaatggatggtagaatctggcttaaaagggagaagaaaagctaaaatgcagatagggatgccagtaaagtgcagagaaaagaagaaaaagagggacagacagggatgccagtaaaaaacaagcccatttgcactccaggtcccacaaatgctcctgattggggcccccggacactcctgaactccatcacagaggctgtcaatgttgggattggcagcaagtttacatatggacactcaaacctactcccctgggccatgagtccaggtggctgccctcaccaactccagcagtagccatgggcttcattccatacagaaggcctgtagttccagctacttgggaggctggaggtaggagaatcgcttgaacccgggaggtggagattgcagtgagccgagagcgcacactgcactccagcctgggtgacagagcaagactccatctcaaaaaaaaaaaaagaaaaagaaaagaaaagggggaaaaaaagaaggcctgaacctgcacacagcctgccgctggggtatactagacacagaggaggaccggacaggtgctgctgcgtgaacaccaaagggttacatgaaagtctgcaaagtgaagaatgagacactcgggtcttagaacactacatttatatgcctgtgtcagaggattgagtggtttttctctaaagaaactattaggctgttgcaaaagtagtcacggtctttgccattactttcaactgcaaaaaccgtagttacttctgcatcaacctaagaatagttcaaaagaaaagacatatgggccctctgcaaaattctcaagtgaggcctaacaaatcacaggccctgcatgtacacaaagagcttccaacgtcatgtctcgctgttaaattcaaatggacagtcaagggctggcaagtatttaaggaaagcctccaaatgtgaatggcagagactgtaacatacaaaacagaaaaggaagaaaaggaattcagagataacagagacaatgcagggagtattaaaaaaaaaaacttttcactttttgccttgttgcactcctaaaagcaagatgggtcaccagcagctctcctggagccatccaaaaaaattcggccagggttctcattcttgtcattatggcctcaatatgtgctgccagtgtttccatcagtatgcagaggaggtaggcttcattaggttagactaagtgagcttccctgaatggattatccaaggcatccaccaagtgaaagaaaccatgctagctctctgtacataaaataaaattttaaaaaaaaaactttaaaaaatgataatatggccaggagtggtggcccgcacctgtaatctcagcactttgggaggctgaggcaagcagatcacttgaacccaagagttagagaccagcctgggcaatatagtgagaccccatctctaccaaaaaaaaaaaattagccaggcatggtggtgcatgcctgtagtcccagctactcaggaagctgagatgagaagatcagctgagtctggggagattgaggctgcagtgagctatgactgcacccctgcgctccagcctgggtgacagagtgagaccctgcctcaaaaaaaattgttttaaatgataataaattagataagacttttgtattcctaaaacaagaacagaaagctattaaaaggaatgttcagagactgggaaagattacttggaaatttaaaatataagagaagaaatataaaatgcaagacaagtaaaaagatgtgaaagaaaggaaataaatatgcagtacactacatggctcagctgcaaataatatttacataattctaataaattaaacattcaatattaaccaaaagtgtgatgtaattatattggaaagatagtgtaaaagagataaatctttaacttcaataacagaaaatcaataaataatggttttaagataaggttaaagaggccaggcacggtggctcacgcctgtaatcccagcactttgggaggccaaggcaggtggatcacttggggccaagagtccaagacccgaccagcctggccaacgtggcgaaaccccgtctctactgaaaatacaaaaattagcctgtgtggtggcatgtgcctataattcctgctaattgggagggtgaggtaggagaattgcttgaactcaggaggcagaggttgcagtgagctgagattacaccactgcactccagcctaggtgacagagccagactgtctcaaaaaattttttcaagaatattttttaaattttttttaaaagataaggttgaagaaatttcatgaaaagatgaacaaaatgacaaacagatgggaaacagaggaaagaaaaagagaatcaatccaagagtttcaacatctgagaaaagggtattatagcaagagagaacaagaaaacaaacggcagaaaataccaaagaaataatacaagaaaactttccagaaatgaagaacatgagtcctcaggttaaacaacacccagctcaaagaatcatgacatttacaaatatgaaagacaaaaagaacttttaaaatcttcaagagaaaagggtagacatctaatacaaaggatcagtatcccagttgcactggatttatcaatacagacactggaaactggaggataatgaatcaatgcctttaaaattgccaaatttgatactgaggcaagctatcaatcagcatgcaagagtagaatgaaaacatcttcaggcattaacaggttttaaaacatcatctcccatgtatcttttcttaggaaactactcaatgatgtgctctacaaaaatgcagaatttttttaatttataaaatgtattatcagccaggcacagtggctcacacctgtaatcctagcactttgggaggcagaggtaggcagattgcctgggctcaggagttcgagaccagcctaggcaacatggcaaaactctgtctctactaaaaatacaaacacttagccaggcatagtgatgcgcacctgtgggccgatctactcaggagggctgaggcaggagaattgcttgaactcgggaggcagaggctgcagtgagccgagatcatgccactgcactccagcctgggcctctgtctcaaaaaaaaaaggcattattaatgttatttttgattgaaaagtaataattgtataaacttatgggttacaatgtgatgttttgtataagagaaggaatgattaaatcaagctaattagcatgtacatcatctcacttacctatttaaaaaaatgcagaattaaacaagacacgggattcaggaaaccaaaggtctaacctaagaaaggaaaaggaaggcttaggatggtttttcccgaacaactgtgtggcaggctgtgatggttaattttaggtgtcagcttggattgagggatgctgagaaggctggaaacgtgtgtgtgtccaagagggtgtttcagaggagactgacatgtgagtcagtgggctgggagaggaagagtcagacctcaatgtgggctggcaccacccaatcagctgcgagggcagtcagaataaagcaaggagaagaaggcaggtattcagcttgtggagtttctgctctccctcccttcccaataatggctgtttctcttctcctgcccttgcacatcagactccatgtttttcggctctgggactttggggcttgcaccagtggcctcctgggggctttcaggctttcagcctcagactgggggctgcattgttccaaggcttctctggttctccagcttgcagacagcctatcgtgagacttctccaatcctgtgaaccaatgcccctaattaactccctctcccatctcctgttgtttctgtttctctgaagaaccctgtctaacaaaaaagcctaaagctccatcagcccagaccaatggtaggaaagagaactcaggcagatttcctgatgcatatctgccagaaagcttggggctgaattcataatatgaacataagtaactgggttaataaaatggggcagttactatctccaggaaaaacaaaatgatgtaaaagaaaggaaataaatatgcagtacactacatggctcagctgcaaataatatttacataattataataaattaaacactgaatattaaccaaaaatgtgatatacctgtactggaaagacagtgcaagagagataaatctttaacttcaataacagaaaatcaataaagaacatctaaatattaaaaataagaaatccaattataaccatgttatttatttgctccagtttgctgaatatgaagaaatcactaaaatacttgaaaattattacttctaggtcataggaactagaggtgggaagggaactgcatgcagtttttgttaaaaaccattcattccaatttaactttttaaactatatttacgttgaatcaaaaatttaaaatttaaaaaacttagtctaataaagaatgtcagtgtatataaaatataaatgaaccacaaaatgtcagatcatgaaggaaatacagagatttcacatctccagacccttcaccctccattcagctggagcaacttggccatatagttaggacttcttaagggttttgattaagaattctgctttctcaaccagctttttgttgtttcctttttttttcttttttgaggaggaggagggaggcagtccactgatttagtcaatccccatcatttttcagataacaaaatcaattgggttagaatgcaaattatttacttagaactggaagagacgttaaatctggttcaaccgatgctcaaaagtgaagtcacttgtcagctctgcctggaacctgctccctgcttccctacccagagctttatgattcatacagcagttcctccagtaggagagcgagaggggatgaatgggggcctagccatctgggatgacggggcaagcagttggatccattttttccaaaaggtgctgttaaaaaaaaaaaaaaaaaaatcacccagagacagataccagaccacacactctgattcctaagagacttgctttttccctaaattgctttctttttcagaggggcctaaagttcccaaagagataacaagagaagtagagggcaagctagtcacagtgagactggcaaactctttttgttttttttttttagacagagttttgctcttttgcccaggctggagtgcagtggcggaatctcggctcactgcaacctctgcctcctgggttcaagcaattctcctgcctcagcctcccgagtagctgggactacaggcacacaccgccacgcccggctaattttttgtatttttagtagagacggggtttcaccacgttagctaggatggtctagatttcctgacctcgtgatccgagactggcaaactctttaagagacagggtctcactttgtcgcccaggctggagtgcagtggcgccatcacagctcactgcagccttgatcttctgggcgcaagtgatccttcagtgtcagcctcctgaggagctgtgactacaagcattcagcatcacatttggctgattttttaatttttgtgtagaaacagggtcttggcatctttcccaggttggtctcgaactcctgagctcaagtgatcctcccacctcagcctctcaaagtgctctcaaagatgtgagccaccacaccagtctgtaaactctacaaagtggcttagcccagcttggttgatcaggaaaggcccacagacgggcaccccaatgcaccagtcgcatgggcctgctccacccctcctaccccacagagcctccaggtggaaaagtctgctcagataccaaagcctcactaagccatgaagacagagcactggtttcctgcctcccagccccagatcacacatgtcttgggtaaccctgaggtctgaggcagaaagcaccctccccaagtccaattgtgcaaatgagattcagtaacagcactgggtacggcatttggctgcaagcaaccacaacctccttccaacactcagcagagttctgggcaccatggcgagctggctttgcggcactagggcccagataagtcctactgacaatggccttgcaatggcagcttaacagaccccactgttcccagcaggagccaatgtctggcatcattaattcgtttagcagagaaaggggcttgtgctttgtcacaataactcagcgtctctcccctgaccacaagccacatgctgcatacttggatgcatttgctgactacaagacatacgttacacacaagaacaaaaaaaactaaactaaaagaacaagatccaaagcagatttctttttctctcatctccaaaaacaaaacaaagcaaaacaaacaaaacaaaacaaaaaacagcagatgtggaaaatgctcctgagtggctcatttgggacaaattatttaattgaagttgtcctgttttctggaccccagacacctcaggaaggtggccaggcaggagagtagagattgcaactttgcagagccctctccccagtactcacatatgaacgcacacacgcaagctcatgtacacatgcacacacactcgccagcatcatcaatgcatacacaccagcagcatcggtgtcagccatccagaatcctgctgctaactgcttgatttcctggattgtgttaaatccccactgagttaagctaatggtgcaaaatgaaaaccccactctgagagcaaagtgctgcctggtgtgatttcatctgggaagccacgcatcttggggagcaagggcttgggcctcagagtggatcagagaagaactgtggcccctccccttcccagtgtgcagcttagcctcttccacccccagccccccaccctcaccaccatcctgcactggagggagagaaagaagaataggagaatcacttaaataaagtccatcactaggattgattgaatcttggctctgagtccaggcaaacctgccaaggcaaacagcttttcctaccatggggtcactggtttttcattcctctccaatctacttcctggtgtttgcccaaatggcaagttgaaatgtgggatggtctcctgggagggaaaagatggggagtgggctacagaaaaggcaaaaactatccctcgctctgagagatgctagagtgagcatcatcagaatcacctggaggattgttaaaaatgcagactgctgggctccacccctggagcttctgagtcagcagccatgagatggggcccaggaatctgcattggtttttatttttagagaccaggtctcactctgtcacccaggtcagagtacagtggtgcaatcacagctcactgcagccttgaactccagggctcaaaggatcttcctgagtaactgggactataagcatgagccaccacaccacctaattaaaaaaatgttctttagttttgtacagatggtgtctcactatgtttccaaggctggtctcaaacttctggcctcaagagatcctcccaccctggcctctcaaagtgccagaattacaagcatgagccactgtgcctggccagaaatgtgcatttctaacaagtccccaagtgatgttaatgctgctggcctggggatcacacttgagaaccactggtttaaagagcctgagggttgggacagggtgggttgtttgatttgtcaccttggttattcacagtggtatcttttaaggactctttcttggatgacgtctaaacatcctagaggcccagagcagccccccaaacccactggagctcaggtggaagccagcaaaattggcacaggcctgtccaagacacagcggagtagggcaaggtggtcagcactacttacagaattgctgaggtctcttccagagctgtgggtgcttgcaaaatcaagaaaacaaaagcttggatagcaagaggcagcacatttcagaggaacggaccccaagtggagagtcagcagaccccagctgaccaatcccaccactcacattttagtggattagactccaccattaacctttagcataaacttgggtaaaatcattttacttctctggatcccagcgtagccatttgcaaaacgaatgtgttcattcattgagatggatccgttcatttcagtctccctgcctgcaatggtgagctacatctgcatcttcctatttcctttccctgtctttgaaatccagtagagaagcccagaccgcacaatgggaacatcccacctctcagatggcaatgctgcccaagccgctccacccccaggggccttgcttgcatgtgcccgaggccagccctgcagggcagacagtagcacaagagcaccatcttggtcacaaagttgtctaagctcaaagacagccccggaaaaacacctgacacactccacaaataataatcagcagatcttcatgccatcccatgtgacagatggggagcagaggcctagggggctgctggcccctttgctgagagacccctgacaaagttagtccaatgcctctgcaaaatcgcagcagttgcacctcactcttctccctttatcatgttctcggtttgtcctctctgaaggaagggggtgcaggtcacctgtgcttcaggccgagctacagaccatcttctccttgatgcctccccagcccagtctagccttggccttcctggctctccttgcctcaacattgatgcagcagagctctgcatgagaatgacccacgagtgttcctacctctcctcctcccctctgtgagctcatgtaggacatggcccaaaacgcatccaatctctgttcaatgactagtgcaatgcctgacatcagggggctcagctaaacacacgtggggcacacaaatgaacagagagatggaaagagctcagccactgcccggatgttcaaagactcactcgccagactggaactctctgcacagaactccgcttcagcactaacaacaacagcaagagccagtggtcaccgagtgcttgcccaggccggggtctggtctacccacctatcagtagatgcactccgggacacctctaacagcctagaaggcagatactccaataatgacacccagtttctagatgtctgggagcagaacctttctgtcccagaaaggttcaagtcccacaactagtccatggcagagcgggactttgatccaagaagcctggctcacaacatataaacactaccagaagcaaaacgaaccacataagcagaacaggaggcctctgtcttgggggttccctttctactggggatagctgcttttcaggcctgggggcagagaagggtctcactggccccctttccctccaagagctttctaggtataaagggatttagagagggaagcatctctctgatccatcatagacagttccaaagtacaaagctaagaaagcaaaaaaaaaaaaaaacctatgtccaaaatccttcatcctcgccatcacatgattctctccaaagcaaaaatagaggcctcatctctctggacctgatagtgtcaacaagcacagttcaaggttcttgcttattcccatttctgaccctacctatttatccaactttctacacctgaatagtctctttctttttttcagctttctaggctttatgtcaatagcaggaaggcttgaagacagaggggccctggtggcctgctctgactccggcccttggcgggcacgaggtccagtctgagcctgggcccaagccacacaccttccccggcataagatgggcagcgctgggcttccctcccaagtccaggggagtgcagggggagggctgacggagctcatacagttttcctttgtggggtgcagggtcgggggatggtgcggcaaagccctgcccgaggcacacaatcatccagtgagatgacaatgtacaccaaacaggatgcagaggaacgctggcctctcaaagctgaaaagtgtcttgacctgagacaggtctggccaaagccaagaatctaaaaagctaagaggaatcagcacccggtcctatgtcaaagctggccttacctctattttctggaattcgcactccctgccctactccgctggcacgcattcaaggcagccaggtggcaccggcctcaagctgaatgccctgactccggcttccaggtcctcagaccctccctgggtctttcctttctctcaagccatctggagcctacacacaagtcacggggcagaggttctgagagctgaagggagcaagcggcaataaaaacccatacgaccccaactctgcacgccctttctacttcttcaggaagccatttcttgagaagaaacaaacaaaaagcttccctgtggctgcaggagctgctgacccatggggccaaattagcacctgcagagggacaaacagccccagccctagaggagaccacagaaggctgctggatgggcaaagactcagggcacacatagacagagctttgcaggaacgggtgctcggcccacattctggagcgcctgccccaactcccagaagcgttcctagcatgcagaaggcaagtgctttctaagtatctctaccaagtggctccacaacagacagattcttttaatgttccaagtactctccagggaccgtgcttctcttcctactgaagatagtcaacatccaggtttgggggccaaggctgagccctgtgggacaggcccgtgagctcctagcaggcatgaccacctctaatgtatgcagctccctctcctctatttccttttcctgcctctcctgccacctgccaagtgctcctacctcgttcatggccttccactccgtgcagggagggagtgggagtcctctctcctgcacctcctccccaaggcctccagtttgcatcaggggtgctgatcacagccccacctcaccagccttcaccagcaagctttgccctgttacacagctgggcacattcgggggccatgcaggcccttcaaggatttgccagtggagtgggagtgcagtgcccctcactccctcagcatggggggattgatgttgcagccacagacaggggaaaatgaaagacaaatgtcagcttgcactcacccatagctagaggcaaagtcccttcagagcacagaagggttaagcccatggctgccatccaaagagttgagacacattgaggatgcggaggcagctagtctgtcctcaggtgctatccaagcacccttgtggctcctatctcttgtgaatggatgtgtacacaggggcataatataaacaagtcacagggtcaatctgtcattgactgagggttcactgtgaagccatccctcatatactgcacacaccctggctaagcaagatcagtaacctgaggagctgcaatgctgtgtgcaggggaaacccccacaccctacagggtgatgaatttcatatacatggccaactgggaaaggcacagtctcaagatctaggatcccctcccaaccttgctgaccactctctggtgttctcgcctaccctgatcgtgatttgtccagagcacctctggcgaatgcatatgtcgtgcctcatggtcaacaaataaacaagtttcaaagggtcctcatttgtctgaagagcctgaaatgagctgctaggacaattcacgagacagctggagaccttcagagcactcagggccaagggcgcaaaaggtggcccctccattcctctcgtcaccctataggactgggttgctaagggccttttgggtagctgtttggttgcctcccacatctgcctctcactgtccctggtttgcctgcatggcaaagggcctctcacccaaggtgttcagatgtgtgcaccttgtagctctgtgttttgtaatgttagaaattaggttttggccatgcagggtgactcaggcctataatcccaacactctgggaggccaaggttgggggatggcttgagcccaggagtttgagaccagcctgggcaacatagcaagactccagctctacattttttttaactagtcgggcttggtcgtgtgggcctgtagtcccagctactcagaaggctgaggtgggagaattacttgagcccaggaggtcaaagctacagtgagctaagattgtgtcactgcactccagcctgggtgacagagaaagaccctgcctccaaaaacacacaaaaaatgcttgtttggaaatctgaaatagaaaaaaataaataaataaaataaaattttaaataaaataaaattttaaataaaataaaaataagctcaagcatgggaaagcattttgaacatggcaacctgttcctcttacttttaattctgtattatttggacattttttattttatacaatgtgaacacattgcctttttgaaactacatattcaaaaatattatatacacaaatatatgtacagagttatatacatgtttaggttttattcatccattcatttattttattttcctggctttctgtacaattttaaagtactgccctgccttcaagaaaagccagagacaagcaaataaagtttttttgcactgatcgggccaaaataactccagctttagaaattttgattcatttccctatgttctttcaagaagctctctgtggctatctacgatctcattcttcttcattccactccaaaagaatgaagattccaacgtatctcacagataagaacactgctgaatttagattcttgcttttattacatgaccttggacaacatgagtctccatcctgtttcttcctctctttctagatgtagatttcaatatctttattaagtttcaggtcagtcatgtccttgtttctccttccctttgctacaataaaaagtacttttccctgacaagtgtcagaattagaccaccaggtaggcgtcacatctatctcctcctccgagtccctttcagagtgtgtgtgtctcccatacaatgggagtaggatgatctttaggccttgtcctgcgaataggtcacattctctgcattagacagagctggtggccagataggaaacccccgtgagaccatctagacagaaaacgtgcaggcccccgattgctgtttcagccatgctcaagatttacttaaagacaatccaatgaagtgatcagaagatcaggccaaagtcagcggctgaacttgtaaaaatcattcagatcaacgctatttttatagaaactaaaaaaaaaaattaaactcctccaactttctttttttttttttttgagacagtttctctctgtcacccaggctggagtgcagtggcacaatctgcctcccaggttcaagtgattctcctgcctcagcctcccgagagtagctgggattacaggcacccaccaccatgcccatcttatttttgtatttttagtagagacggggtttcgccatgttggtcaggctggtctcgaactcctgacctcaggtgatgcacccaccttggcctcccaaagtgctgggattacaggtgtgagccaccacgcccggccaaactcctccaattttcttgtatctattgatgagttgggctaacacaaagagttgattagagcttgttactttgctcagcctgactgttccatccaacctactgctgtacacaaggtgtcctagctgggccaggggactctctgggggattgcctacagctcccaccagcattacctgtttgccatggcaaactttaagattgtcagcaagtaggatccaaacctaggcctgcacatctagagtggctgacaggagcctcatcactgagtgaagatgggaagctggagaatccaagaataataagaaagagtctggttcattagcccagactcagatggaagaggagaaggagaacggcagctccaggtgcagcacagtggctattatggaaaccggccacactgtgggaagaaagtgccaggtaaacaccctgaagagctctttcactagaggctgggacacaccagggcccggccaacattgctggagggcccctcccacattgctggagggccccctcccacattgtctgagcccctcccacattgctggagggcccctcccacagcaaaccccactcatgcactgggcacagtgctctggtggctctgtgatggctgagagcgtcagcagggaccctcagtctggcaatggagctgccactcaggagatgctgggctgcaaatacccacggacctccagcatggctgacaacagccaggacagcagctcagggcagcagcaaatgaagtgacctgcagggaccacacctgctcactccacagagcccagcctgcagggcccacacctgctcgctctacagagcccagggaaggtggcgtagggggaggggtctcccctgcctcctctgaagagcattcttaggtgaggcagaggcaaagcctctgggagctgctggtaagcgcaggcaagtgcaggctggcaggctaacatggcctgccatcatgggtacccccaggctgcaaggccaaggccgatgctccagtccagggagaaagtacagagtcagtgactcattgagttcactctgcccttcttccctcaggtcagacactcactcttccctacgccccacagatgcaccgcaagagtaagtggaggccaagccagcccgacactcagtcccctccgcttccgacctggtggcctgtgctgcctggttttccacaatggagttccgggtgagatttcctctaaagaaaaattgtgcttcgtggcacatgagtgtttaacaaacacgaacttcacatatagatgcacagaatgttaaagcacaatgggatttaagaggccatctaaccaaagtctcattttaccgatcagaaaactggggcccagagagaaaatgaagcccccagcccctcagccgtcagcatctgagctggcaccagaaccaggactcccgacttcctggagccactgctgtcctccgcccctcgttccccacgcactattcccttcacacactcatttccggaagggtgatgccccagcccctcgggttccagccccatgggctcaatcagcctccctcatttcttccacaaatgcaagcaagccactccctacttccctgccagaataaaatgccaaaaaccagagaactaagccccactccaggcggaagaagtgcagccccagcttactatcagataagtcgtttcctaaaaagaaatgcggctgcagtaaggcaggaaagccgggagccagggaccctgaggccagcccacctggcctcacttttcccaggaccacagtcagatacaacagcagggctgtggcccagccccccaacccttccaactcaggaaatgctgagcccccgtgagtgccagggagtgcccctgccatgcctcctctgaagagcattctggggtgaggcagggacctaggacagacaggcgtgctcagttagctcgagcgggatggaggctccaccggatgggatggccaggctcaggctagggtcgggggtgccaatgatccctcccagccgcctcagaagtggccaccctttggtgttctctgcggagttttggggtatgggtccccaggaactctcaggctgagggctccatgggaggaacaggcaacgtttccactccaacccagggtcctcattctatggaactgggcggggggagggggtgggtgggtaaagcagaagctcatagttgccagccggcccagacccgattcctggcatcaccccacttccaaagagcgtcgggaatggggggacagggatggggacgatgaacccaagagagagaaacactctgtgttcctccctgggcttgcctattcccgacttcgagtaatcatccaaaacaaggaaacctgccaggagatacattaagtctgtaagcgaagaagcctccaggcaaagagctgtcagtcacagggaaaacccaacacaatacatggattctactcctgttccgaggcaggggcggttcccgctcaaccttcccaccgcctcccccgccgcacaaacacagggacacaactgtgaaggcaaaaaaggatttgtttttcaaagtcaccaggaaaatcaacaccaagggaggcagagggagtgtggggccagtggctcctccttggataaaggaagcggggcggggggagggggttcagccctgggcctggacttcattccatgtccatgctccttgctgccaactgcaggtccgttcccaaagagtcacagccactagaatgctccaggccatctggccttcctctccaagacacgcaacatggaacgactccaggattctgtctttacacaccctggcgtcatccctttcttcactgaagagggggtccacacacgaggtcgggggcagctaggaactcatttcaagggtaggattcatacgctgctggtgacctaaagagatgggggccctagctggctcctccaccttcttcagaaagatcatcttacatctccaccagaaggaaggttcacccaccaacacagccaacttctggagagaagccagtggccagaaagcacacagtgagtgccccaagcgtggcatctgaagggctgaaaaagagtcctgtgggtcatgcctctggcttcctgcccagtgcaggcctccaggtatcgcagctaagaggctgccaggtctctgaataacgtctacagtgggaccctaccacggaacaaggcagcctgcccctctgctgaacaaggtttcatttcctcaagcccagtttctccggtgccacacaggagtcttccctttgctggactgcacagccttggccctcacatctgttttcttcctgacacctgcagtcctaaaaggtggacatcctgaaacacacaggcttgtccacttgaaggggttatatagggaagagaatggccaggccccaggaaagtgggaaatgcctgggaatgacaggcgtgccagcttgttttctctcacctcacagctcctcttacacaaaatctctgccatcggccaccatggccgaagcgatgctgagcgctcattctaaatgctggcatcggctcggaggaacgtcatggagagtgggtaagagcaccaggtcatgtgccactgcaggctggtggccccgatgcatccatcccacctgcaccagggcctgctgtgggctctgttccctctttaggggtgagcctggctctacatctcaagcctggatttttcaagcatcctttctgatttgatgctttcgatctcagggtcttcagctaatatttgctctccctgtgagtccacagagaaggtgagggaatagattcgtgtgtattataataacctctgaagttctttttaagcttctctgagaaatacattaccattactatcctggcttcaatttggtatatctataaaatgcattcacctgttacagtttaaggaaagtgcagcatgtgtcacaaatgctttgagggaagggaccacaagggatgctgacagcctccacataaacaggaagcccttccagggatgccacatggagctgtaagagagcaactgggactggccgccacagggtgaatgacaagttagaggagaactgcactttgtatgctggacatggcagctcatgcctataggcaggaggataacttgaggccaggagttcaagaccagcctgggccacatagcgagaccccgtttctataaaaaaaaaaaatttaaatttggccaggcacagtggctcacacctgtaatctcagcactttgggaggccaaggcaggcagatcacctgaggtcaggagttcaagatcagcctggacaacatggtgaaaccctgtctctactaaaaataaaaaaattagccagttgttgtgggacgtgcctgtaatcccagctactcaggaggctgaggcagagaatcacttgaacccaggaggcagaggttgcagtgagccaaaatcgtgccattgcactccagcctggatgacagagactccatctccaaaaaaataaaatgaaataaaaataaaaataaaaattagctaggtgtgatgctatgcacctgcagtccctgtacttgggagactgaggcagaaggatcgcttgagcccaggagttcgaggctgcactgagccatgatagtgccaccgcagtccagcctgggcaaagagaccctgtccaaaaaaaaaaaaaaaaaaaaaaaaaaaaaaaaaaaaaactgcaatgcactttgtagtttccaggactcttccatacactctcatgtctacacaccagctctgtgggggatgcatgatggccatcatttggcaaatgagaaaactgtggttccaagcattgcccttggccaaagccatgcgactagtaaattgtggggcaggaatgaaaactcagttctgagttttagaaagtaactgcttccaaactgcttccccatagcaggctctctcctaccctatgcagcggaaggggctcctatgccatccatctctgggtttctgagaacagaagggaagaagcagcagctcagagacacattcaggagaggggctgcaaatgcggggatcagcccaagaagatggcgctggggccaggatgtccagcagtgcccagccctggtcagagaccactgatccacagtttatgcaatgcactgccctttgcagtggtcctacgccctccaatgcacccccaactcaacccttcaatgaatgcgtccaactcagttttcatctgctccaccctctcaggcacatagcgacttctcttccccatgcacccaaggtgaaggccagtgttcccaggggccttgcctggggagcaggaggtgccaaccaagatatcacacctagagagcaagtcacagagtttttgccacagaccaaaaccacctaactgcagagctggaggacactcacagatcacctatggtgaccccttcaactcgcttaaggaaacaagctcagagatttgaactgactggccaaagtcacaaacagttcagtagcagcgcagaaattagatgccaggactccagaatctgtgttatttttttcttactccatattttatcttctaacgcagaagtctttgtttttgtttcttaacaggtgggtaaactgagccaccgagtgcttcagtgacttgcaggcgctgacacagtaggtggtagaaccaggcgctgggctcacgcctgtacagctcctaaggctacacgtgttctttccaatgcactctttaaatcctagagattacagcaccgcctttatgtcaatccctgctaaccgctggaatcctctaaggaagtgactcctgcccagagaaccagcagttctaaatggacttgctgcaaacactgaaacctaaacaaaagaggtctatttggcactcaaagtaataaacaaaataccaagaccataggagtgttccccaaacttacaaagatggcactcagtttgtataatggcatcaatgcagagaaatccctcctgggcttctcagaagctcttctggaggatagtggattagcagcatgctctagacagtgtctctctcaagtgctgggggaggaagtgaccctcgggcctcaccagtggagaccaagtccctgggaagcccaggccagctggaaaaggcagctgcccagcacagccaggctcaccaggcagatgtgctatgcacacacagacagacgcacaggagggcacacgtacacagctcatcacaccacacactacccacatctgtctacacccacacctcacagactgacccatacacaggcaaacacagacacaaacacacatgtgtgcacagcaggtggtcccttgtgtcccccaactacacataggcatcgacagacacccatatctcgcagatataaccccacgtgcacagaggcataaacacacaaaccacacatgcacctccccttgtcccttattgtcactgcagcctctcctgcctccctctttcagggaagctccagacacctgggctaacccagccctgaaggccctcataaatgccattcccagtgcaatgctttggggctggctccggaggcactgctcctgctgcccctggtcaataacaaagtctggagagaaaagtcaggaccatttatgatgggtcctaatgacaactgctcttggtaatggccagctctgcggtgacctaagtatgagctgattacaggctctggctcccgctctgcacacgcagaacacaggtgtcccgggggcactgaccgcagcagatggccccttccctgacggccaggacagctgtgctgacctcatcagccacctcccgagggctccttcaagtgggtggccctgagcaggcccagacccaacaggcaccaccctgagccctctcatacgggacgcggctccagggctcctctctccctcccaccctcactcagagactccctgtccaaaatgtctcaccactgatgtctgcagttctgccattaggacttcattatttgattaatgaggtctttgtcttcttctcctcctcttcctcgtcttttttttttttttttttttttttttttttttttttttgagatggagtcttgttctgtcacccaggctagaatgcagtggcgcgatctcggctcactgcaagctccacctcccaggttcacacctttctcctgcctcagcctcctgagtagctgggactacaggcgcccgccaccaggccccgctatttttttttgtatttttagtggagacggggtttccccatgttagccaggacggtctcgatctccggacctcatgatctgcccacctcagcctcccaaagtgctgggattacaggcatgagtcaccacgcccggccttttttgaggacttttttaaagatataagacagtcatgttttaaaataagttcccagtgtctctgtgttaccaacaaggccaaatctccattctgtaagaaagcagtcaggttgccgcacaagctggcttttgcctgttttgtcatcatttctagatactcaccaccacaccctgataagctagctaaccacaaagagattcgccactccccagtgcagcgtcgcagctcctggtctgatctccactgggattatcttcctaggcccacctttgctgcctgacaaatgcctaccagctccatggaggacagcacagggtctctcatctctgcagctccccttgaccatttccttggagaccagctcccttctgtatgctcccgtggctcccagctcttctctatcacgggcatctctgcatcccctgacctcctctagatggtaaggcctggtagagcagaaccacttcccaatcacaccccatgaccattttctggacactcaccagcgcggagcccagcacacacaccacgcagtcagccttgactgggtctctgacactaacatgaaattaggttaatccaggtgtttccttcccgaggcaggaaacaccatgaggagcagcacaaaggcactgtgatccagggctggagcacggacagaggcaccttggagaagcctgtgacaaacccaaagcttctgcctcaaacaggccccaggagtggggacagcgaggtaccctagtgtggccaggggcaccccaatacagacaccctcaccctctcctccaaaactcaccagctcctacgtggccagcccgaggctcactgcagggcttcccactcataacgcaacttcaaaagcaacacaccccaggcagaattacaccactaaaaacttccactcctggactcaggtgtgcaggtaagagctatctatagccaacagagttttcaccttccttacccagggcttaactcgggttcagagcacttggagggaggagacagctgcagaattctttgcagcgaagatcccatagcagccctttttggctttgtgtccccacccaaatctctctttgaactgtaatccccaggtgttgagggagagacctggtgggaggtgactggaccatagaggcagtttcccccatgctgttctcacgagagtgagttctcacaagagctgatggttttataaggggatcttcccccttcacttccttcacacactctcacctgccaccatataagatgtgcctgcttccctttatgccatgactgtaagtttcctgagatctccccagccatgtggacctgtgagtcaattaaacctcttttctttataaagtattcagtcttgtgtagtgtctttatagcagtgtgagaacaaactaatacaattatggagacttccctcttcccaggccctgggaagaaatgatatcaacacttctgtctacacagctaaaatctctttggatgttgattctagtcaacagatgtggtacagactaagcagggctcagtagaagcccaacgattgttgaatcatctctgcaagagtgcacgtcttctgcaggtggttagattttcaaaagaaaacacatgcacaaacacacatcatgagcctgtttttaaatgaatgtgtgttaagagtaaagaccctgtaaccagagaggctgggtgccggctggcatttggcactgtgcagacatctcagctcttagtgcctctacatctcagaacaaaggtcgagactccttctagccagccctgcatcctgtgagtggaagcagcggctgcgggttacgtggaggtgagaggctgctctcaagactcaagtcttgcctgtgcacttctcagcaccttccttgcccagggctgacaacaagtacttacctgactgaactccttcccctcacagctatgcactccctgggtgtcatatctgactcaggcccatggccacaaccacatgagggacccctgaaacacatgggccattcattccaactgctgcaccacaagaacaggtacagccttgctgggacctcgtcaccctttgagctgggtacacagacagctgcgaattggaaggagcagctccccctcccatgccttgatgcagcctttgagtccccacgctgtgggccagggctaagcagaacatagaatgcgaagcgagttgttataactgacaaatgacaaaccaacattctcctctgtatttatttaccagcttaggtttcgtcaattgaagaattactacttgttttgagtctttactccctttccctgtcctcatctcctgacaccaggaatgccctcctctactttctccattaatcttcagcctgacagttagatcctcatcttctctaggaaagttccctgaatttctccaggccccaccgaagacccctccctccttcagtcctgagtgctagaactacgcacaaaggcatctgaagttaccaaagagcagagacaaaaaagcatggcaaaggcctgtctcgcccaccagattcttgggggttttgtggggggttttgtttttgtttttgtttctgttttgagacaaggtcttgccctgtctcagacccaggctggagtgcagtggcctgaacacagctcactgcagcctcgacctcgcgggctcagacgcacatcccaccaagtagctgggaccacaatgtgccaccatatctggctactttttttttttttttttagagacagggtctggaactcctgggctcaagcaatcttcctgcctcagcctcccgaagcactgggattacaggcatgagccaccatacttggccaccagattcttaaatgtgtcgagggcaggaacagggtcctccatatggggctgagaccaaaggaaaagtggaaggcgcccagactgtctatgagcctgagaggtgagcacagcgggctggcacagccgccctatggagtaccacaggagggaatgcgctctctaggcaccagctgctctcagggtttaaagtgcttatccaggctcgtttctagctctggtgccaccgacatatagttggggatttccttcagccataagccattccccaaagctgaatgcatccattgcggaagacaccgacgtggaaaattttcaaagagctcacaaagagaagagaacacatctgaggtagtcccaaaaggaaatgtcctttggagaaagctgatggaagggctagagaaaacaagagagagaaaatccccctcgtaatcctgcctgaatgagaaagaacatcatttagggaagctggtttctcgttttctccccactgccaaagtactattttggcatctctttacaactcacagacatcctttcagaatttgtaaatgatgtcccttaattcctgccctacagaaaatacctctgttatgcctccaaatatctgccaagccagtaagcatctattacctgcacatcaatccctaagtgctgtcaaatagcctcagccctcatgcttacagccccccaaacctaacagaccaacaccttttacattcaagactcaaatatgtatatggaagctctgcacatgcaccgagatcccaaccccaaaagcccacacagacacaaatgtcaccttctctcaggagtccccagttcctgctcctgccgctttgaggagttgggatgagaaggacccagcgtgcagcatgagttatgggagctacccacaatcatctttaaactcagccctgcaggaagaaccccaaggctagtgtgatatggaaactccagcatctggagctggctgggactgtaagaacaagcagtttataatccagcagtctccctgaaaaaaccactatcaacaatcactacaggccagtgcagtggctcacgcctggaatctcagcactttgggaggccaaggagggcagatcacgaggtcaggagttcaagaccagcctggccaacatggtgaaaccccatctctactaaaaatacaaaaattagccaggcatggtggtgcgtgcctgtaatcccagctactcaggaggctgaggcaggagaattgcttgaacccaggaggcagaggttgcagtgagccaagatcacgcaactgcattccagtctgcgcaacagagggagactccgtctcaaaaaaaaagaaaaaaaaattagccgagcatggtggtgggcgcctgtaatcccaggtactcgggaggccgaggcagaaaaattccttgaacccagtaggcagaggttgcaatgagctaagatcacaccactgcacaccagcctcagcgacaagagcaagaggctgtctcaaaaaaaaaaaaaaattcactacagtaccttccctggaaagacctggaaggctgtatttcatctcgtccccatcatcaccattcatgtgtccatccaccctctcacttaaatatgcgctgcagcactcacagaactcaacttacctaattcccaaatgggtctctcacagccacccactagcaaagccagagacactgggggagtatctgcagcatttttttttttttgccactgtcattaacactcagcagaatccagaagatgacttcaccccctgccaccatgccctggccccagctcccagatcagtcaatacgtccagccccctgccaatgtggatcaacaaatgtctattttcaaagaaacctaagctggctgcttctggttcactttcctcataactcatcaccaactatttgtgggatgcggagggcaaccatcctgagcctgccccctttgaattaggaagtccccaggtgccagcagtaagaggcactcaaacccagggaggctcacgctacaggggtggctcttgcacacactgactatggggcaagtccctcttcttggtcacccagccagacagactgcagtccaggtcctctgggcacagtgggagtgacagcactagtggcaggccagaccccatacacagcaaagctgtagttcaaatatgtattatatgtgtctggctttcacacggagtttgcaacctgccagttagtagtgtttaccttggtaaaaattcacgggaaatcttagtctgaacaggcccagagtttattttactgccagataaacaactttctttgataaatcatccgtgtgacagtgttcctgaaagactaaacaaagatttcaagcacaatctataggcctttgagaagccttccaaagcgaaggcatgtttaattggctgccctaaggtcggggcagggcaatgatctgacatttctttggccatttgttcttctggaaaaaaaaaaaaaaacagattggggcttccagcacatttctgcaaaactggatgaaacttaccaatatttaaaagctcattcgcattataatgcatagcctattttttggttaaaggaagtgaatatcacaaggcaggtgttggggttggggtaggggaagggaaaagtgccccagagatatcgctggagaaaaatggagaacaaagtgaagtaaaacagcacaaaggggctctgaagtccctcaaacataggccctgctaaattaaaaggagaacgcgttaggtagagtgtttctaaaaaacacacaaatgaaaacttcagtggtcctatcctggaacaccaggcagtcacagctcccgcattcagccctcatcactgtctggaggcttccaggtttacgttgacataaggatgtcatctcactaaaacccagatctcctaacttctagttagggtttggctttccgagggggagttgtttgttattgttattgtgaattacagcaccttgaagctgcataaagcagttctctttgtgggttttgttttgtttttgagacagagtttcgctctatcacccaggctggagtgcagcagcgcaatctcagctcactgcaaccttggcctctaggttcaagtgattctcctgcctcggcctctgaagtagctgggattacaagcgcctgccaccatgcccagctaatttttgtatttttagtagagatggggtttcgccattttggccaggctggtcttgaacttctgacctcaggtgatccacccacctcagcctcccaaagtgctgggattacaggtgtgagtcaccgtgcccagcagcctaaagcttttaaaggtcttccaaatgggttttttaaaagacttcttcagtttaatcctccattaaccagagaattaactagcatattccattcttcttcctaaaaaactttccgcccaacaagctgatttcattagtgctggaattttccttcctaggctaaatttcatcctaaaacatttttttccaataagaagacataataattattacagattgaacagccaccatattccaggaactgtccacacttgattaaatccaattctcccaacacagtcacgtaggaattctcatccatagtttgctgatgaggagccaggctcagggaagttaagagactttctggtggtcgcttagcttatagggtagggatttaatccaagtctgtctcgcccagagcctgtgttctttccattctgctacactgccggctttcccaccaagaagggagccaatgattgctgagctccttccgtgtgctgggcacagacatcagtccatttaaattctacaaaccctaagagtaaaggagcacccgatgccccttcccaggaagctcctcaactaccttcctgcttgatgggtgtgagaggatgggaaggagcaagggtgtgcaatctggcctggatgccagggaagtgctggtgggcagtaacagggatccaggtagagtgctcttgggtcactgaatgcctaactcctttatttttttgtcttatttccttcagtcagtaacgtgagggcacggactggctgatctttgaggtcctatccaactcaacacagctttacaatggcaaagtggtacaggggcttgcttcagtagcacacatggtaaaactggaacaatacagagaagattcacatggccaccatgcaaggataacacgtgagttcgtgaagtgttccgtatttttaaagaataagatacagtcttcagtagcacagctaggcaattatagttaacaataatttattgtatatttcaaattaactagaagactagatttggaacatttccaacacaaagatcagtgtttcaggtggtagatatcccaattacacaatttttttttttgagacagtcttgctctgttgcccaggctggagtacagtggtgtgatcatggctcactatagcctcaaattcctgggttcaagcaatcctcccaccacagcctcccaagtagctgggactacaggtgcatgacaccatgcccagttaatatttaatttttaatggggatggggtttcactatgttgcctggggtcttgaggctggtctcaaactcctgacctcaagcaatcctcctgcctcaccctcccaaagcattgagattacagatgtgagacagcatgcccagccccaattacccagtttgatcattacacattggatgcttttatcaaaatatcaaacataccccataaatatgtgcaactattttgtatccattaaaaaaattttaagtggtacaggtgagcaacgcagcacccaaagaaatgggcagttcacatgagctgtgaacagccccctcatcccactcatcccttttccctctttctctacccacctccagaaaaacctcagaaaataaaggtgaacttgagggcaaatccttctctccactccccttcttatgagagtctatagtcatatccaaagatgaggacatgatgcataacacataagccagatgcaaaaggacaaacactggctcggcctccatctcttcaccgcctacccccccaaccccccacctcccatgcacaagaaggctgctcagaaagagacacaggctctcagctgggactcacacctctagtgcactaagcaatgggccaatctcaggtttttacgcacataaaatatcctaacaattagctccattttgtacagatctgtggatagaatatgtatcttcagcaacaataaaacccagttgttttccacctatcaattccatccccagagtaacaattccttccatgtctaattttactttgactgaatgagattctggatgttggggcttcttttaaacatgtatacatgtatatgctcagtcacccaaaacagggcatgtagttttccttgaacttaatacacaagttgccgacatccaccttgaaaagagccttctcctttataaaaaaaaaaaaaaaaaaaaaaaaaaagaagtccatcatgcctgcaatcccagcattttgggaggccaaggtagggggatcgcttgagcccggggggcggagattgcagtgaactgagatcatgcccctgtgctccagcccaggtagagcgagacttagtctcaaaaaaaaaaaaaaaaaaaaaattccaacatccacgtcccacatcccctgtcattcatacagtcagctgacaaactttcattttatgcctaccatgtataagacactgtgccagggactatttgagtgcaaataggccttactttgttcattccaagacacagattttctgcacatttctgcaagaagtatggtttttttattgttttttgttttgtcagtagtacaaactgaacagtgtgtctcacaattaacaggcatctcccaccaggtaaaacacggcattagatacagagcctgctctcaggcagcctgcaggtgccgcagtgactgtgctagcagccatcttgcttcatctttgggaggaaacccaaggtttagtttggaaaggctgagcctactttctgcaagaactcaaactgcccgtcagagtaaaacactgtcccccaaacagcagcacagccaagacatcctgaaagaagttggaggcagagtgagaacagattagtggaggtacggaggtgcgggaaactgaaaatatttctactaggaaatactccctaatgctaactgtgaaagctgatgttcttttccttcctatttgactaaccttagtgttgcatagtacagcttttctctttatgaggaaatatataaatggaaaaaagaatccttccagaaggcaaggaaagtttctaggggcaaagaaatccttttccatagggagaaaatactgggctgaagaaattgccacctgaactctcaagctcaaaacactgaagaaggtagtacaagtggaagctctgaactctcctagcagaagtgtatcaccatgcaaatttcccccaggaaagcttacgggtgtttacagatactgcagaagaagctagagaaagtggccagaggcaggaattaacctcaccacaattataaataaatcagatcctcatatccctgggataaaccaacccaaagggaagacggctgtgggtactgagctgttaacagcaggatgattagtgtggcggctcgcaaatactatattgggctatttaagaggcgagagtggcaccctgttgtcacagagcaggaaaagcagagagagaacaaaaagcagagccctgcaagctgatggaagccagcaggcaggctggtcgccatgttcgatgcggtgactttgccccatctaagtcttggctcccacatctggtgcttgatccaggctgatcagctgcattcctgagcatcagcacacaagcttttctgctcatgtttttttcctgttggggaaaaaatgtgccctgaactgagcaggtacagtgcagggctggagacatgagtgactaagcagatctgccaaggggttaaagcacactgcatgccgagaaggtcaggggtcagacatgcccagctccacagaggctcccggagaccacagatgcagtggcagggggacgagggtgctgcttacccagggaaatgcaccccttgttcccggagctcacagagagccttccagcaacctgatgtcttcccactggggatgtcagggccacttaatgcaaagtttgatccctggaggagggagtcaagcattctctttcttctctgctgtgtgtcagcttgcattgttcaatttctttgtttcctaactgaatcccatcagtgtggctgactgcctcacttacttgaagtgagctgagctaggaaacacgtttctcgacaaggctgcattctctaaggtgctaagaagggcagagctaagctcagcccctacagagagagagaaaaaaaaatccctatatattgttttatgagaacattacagacaaaaaaacaaaaaggtttctcctgcaaccagctcaaagaagcctgccatacaccatacgcacactaaggaggtcagcgcctccgtggcagagcccagcggctgtgcatcaactcttaagtgaggagggcaggtggcagagtgtaaaaggactccagttgagaaagtcaaattccttctttatcaaataagaggactggataagatgacctctgaggtccaggaggaacccaaaagttctgtgaacccaagaggaaaatattgtcagggctaaaggaacccaatcccaaacagctaatcactcagattccacaaaccgtgactggttatcgacatgagatcctctgtcctcttctgtgtacagaacgctggctgatttggcaggtgcctgctgccgtgggaagaagatgtccatcccagatgagttacctgagtgccctctagacccctgccctacaccttaaggtcaaccttgccagattcaaattctttcccaggcttgcctcttcagcctatgtggcaaagggtctgaatcctccaacttctgtcttttttaaaaaacaatactcatgtattacatttatttagaggaagagttccaccctcaatctgtatctatagaactcagaaagcactaggtatacagggaatcctcactgatgaatttgagttaatgcagaaacagacaagtaactcacactgctgcatcacagagaacacatcaatcttccccatgcatggaaacaggatacgcgctctccagtttagctctggtggccatctacatccagcttccatcttcatccacaattgcaataccctgagaatgaccctgtcgtgaggcatgattccctccgacttgcatgtgtcctcccacatgtgtgcagcttactttgacagggcaggaacaagacccttccgtgtactttaccatgttcgattaatgaaaacatggactgggatgcctccgaatggactcacatcacctatctttacgcttttccagataagaattctgtaagaaatccgatctcagggacacaaggcaggaattatgagaaacacgttgttcagcatcacactgagtcttctgaaagtgtggcttggccggagccacttctctgcatccatgtcagatagaggcgagagagagggagctggccctccaaaggggtgccgtttacatttacttttctcagaggagagactctcagggtgtggtgaattcaggtattctgcaggtcagactataacagaccatccctggaaggccccaaggcccctggcatctcccccacctccccctggcccccaccagctcctccttctcctggagctgcgagtgctggttcagaattctctttcgatggagagtgacttgggaagaagagagaaaaaccaccctgctgtggggatgtccatttttctttgcctcgcggaacctgatgaggacccccactctgaatcccctaagcattgaactctcccctccctgggaaggcacccagagggcagccatttaaatcctggacagagtcatgctgacacctaggggtagatgttaaaaaaaaaaaaaaaaaaaaagagccagtccggaaaaaaccgggcccaaccagacacagtagcaggtggcaacttgtactccctgcagcttctgagaaggagctgctgtccttccctgctcctctcgacctgtccccaaatcagcctccctgcatgcctagagaagatgcccaaaaatctgtccagcgatcccccacaaaggagggcaaagtatggccttcatcaaaactggccggttctggaccctgtctagtctcccatctgcctgagaaaagcagccatttggagaggaatgaggtagagaatatggaaagctgcaacgagatacatcagcagggcctccgtctggcagaggcacagaccaggaggttccaaaccttccagaggcagctagaaacgctttcttaccaaactcgctggcacagagatgttcaatgatggcctcagatttcaactcgttgtcacagggaggacacaccgttgtgcctgggaaaggaagtagggagaaacggaactgtaagttacagagcaggaagggagcagcccctggggaaaagatcggccctgggtccaggctgaaagtggctaaaggtcttctggaacttctgaaggggacctgagaattgaaaacaagaagccttgagcccagggtctacaaccagagcaggcgcaggtttcttgaaacattttggcccagagctgctaaatgtgacacagttatttaagccagcataacctgaggctgggtgggtgcaggtcacatgaatgatgacttgtggggcgctgtgagtgccgggaaaagctggcttacaaacccacagagatctcttcctggtgtttgtttcccatcctctcccttctcctttcaataccatcctccgattcctgcccccttcccatttccacactcccagctagcctgctgatccctctgaccaggtctccaggagccaagagagaaagaaactcagccagactcacaaactccagctctcggcccctgaacacctcctctccaaaagggccaccgcagcaggaggccagggcaggcgggcggggtggggcactaacaggcgctgccaaatgggaggacagggctggataggaaggggtccttcagaggctctttcctgggcaactgtgaagtgctttgaagaggaggtttgtgggggcagacgtgcataacgttggaaggcagctccactgcctgggaggagatgtctgaggccagggcagaagcctcctccaagccaatatactgctgaagtcagaaaatccagtggaggtaaaggactccagcttcccaggacagagggagagcaggacggcgctttcctccaagagctgaagtggcttatcatcattgtcatcaccttcacctatcaagcagcctggagcttatcgactgtctaggaaaacatcacgagcacattctaggggcaccccacccccgggcacagcacaggaggccaagccaggctggagctgaagagcacaggaaagtcaccgctgaccctgcactcggggagtgcaggtggggcttggtgtgcttggagcccactgctcttcatcctcctccaccatggcttccgtggcagcatctccctccccatcagccccccttatggctcagacattgaaataggcaaaggctccctaagtggaagagaagaggggacctgcagagcacccccagatcaaggctgccctcaggacacaagtggcccatagaccactccctacttccaaacagggtccctgcagggcccagcagagaccccatccttagtttttattgacacattcctctcccacctttactctgcacccaggagcaaacaccttccagattctcagtgcagttaagaaccacgctcccagcagacgatggcatgactgtccttagcccagatgctggaaatttgctttgcacccagaacttgagactgggttctagaggtggtaattctcacaaaggagacaacttaccacaaattttgcattatggtttttgcttccacatggggaaaaggaagtgtgacaatatggaaaggaccaggttacttgcacaaggagagtgaactgtgcttttgggttttccttgtttaggttattttgaaaaaggaaaagtgggagttacacaaacacacatagcaacgttctgtgaatacaatcttgaccaaatagtgaagtcagggtgatccaaacataaagggcacatctctgcccgctccacacactcactgcatctcctctggacacttgaagttcgcctgaaccaatcggccaaggagggctctgcacttctcagggacattttcctcagtcccgtcaattacatttggacttcagtgcctctcagaatggcaggagctcgttggggtgggctctgtgtgtttttaccacggctttcccctatctcagcttttctaacggctgactctggagcagcctgatccagagagagaaagagaaatgtgtgatgcggtattaacctgcgcctcattggtgcgtcttggggctctacaggctgcctctgcaggagaaatccacccagtcatccttctgagaggtggaactaaatcgctgttttcagttgtatttaaaataatgtttaaagcaaatgaacaaaaaaagcaaaggttttgtgtttattaatatttaagggtgtgtggaggagacagcccaacagctgaatcaggattaagtgatttttgtgatacatcaatccacacacacacaagtgctttctcagtctctctctctttcttctctctttccctttctcacacacaacccccacaatcttccctggccagttcctggggggaccaaaagggagccctaaggaaggctttctggggaacagagggctctgtggcctctgccacactgactaaatgcacaacatgcccaagcaacaacaaaatcaaacccaatgtgctggctcatacaacttcacccagtaaaaccaggcagagagggaaacaacaatgcatcagcctgggagttcacagttctaatggaagtgccaaattcaaaaatgacttccctagaaaaagagcaattgcctcttccctaacaggagcttctatggcttgggtatcagcctttgcaggggaaaaatgtcaagtcatttctcattatcaggtttctccttaataacacatgaccacagacagctggccaataatccaaaactgaatttgcccaagtgtgtgaacagaaaccagtatgcaaagatatgacactgctttgaaaatgcattttaattttaaagaataaaagcataaagaataaacgaataaaagagtagtgcatgcatacttattctcattggaaagtgccagttacgaccccacagccacaagccataaggttatgaggatcagtagtctggtttgtcttgacctgccctctacacacctacacacacacacacacacacacacacgccccaccctcccctccacagggacctcgcaggaaatcacgtggggctcccttacaccagggattgcagtcctggggagggtggtgtgccatctcagggcagagccccccaccaaaaccactgaggggaaaaccagtcccaagccccactcccgaccggccctctccccacttttctctttgctcctcaaagacctgtcttgggagggtgactacctgagcgctgctgggaggagtggaggtgagtgaggacggttccaagccaggctgagaagggcgccgaccagtggaactgcagccaaggggcaaaaggtgtccggaagacagcgattatggggtttccccatcccatcacagccttttgggggctggggtgagggattctttcctctcttcttcaggcaacccgtccaatccccccatgttccctgtggactgcagcaccttttccgcagccgagccccctaaggtgtccactcatgtctgcagacggtcccagaaagagaccatcggaagccattgggaatggactccaggtcagggctgggcacagcctcacagggcagggctgggctaatccccgctggctgaggaaggggagaaggaaattcccgcaggctgcaggggatgggtgcaagccaacagaacacaaggcgctttgtttgctccaggtaactgctcagttctcgctcacaaagtgcagatgcatccgctaccctcactccactcccaacaccagagttgactctgagagcagcggtgcccagacctggccactgcgggcaatcagtgccgttcccatccagccatccaacgacagtcactgtggacccatctccaccctccctagaataagcaaaagcatctaaaatttggggtatccctttcccccacctgcccaaatcctcactctgaggagccaggtgactgcactcccctcttttagcatcaataacagaggttaaagacactttaaggtgagctaagtgtaggcagtctttctcccccaccctaaaggccctcctcaaaaagccctcaggaagcctgcgtctgtgctaagcgcagctggggtacagctccccaatccctgaccctctccacacctcagagcctaaacttcgcttctaaagaattctgggttgaatttacttctatagaagtcaggtctgtgatgtgtatattttatctttatatctatttcattttatttgacttcccaggatttttttttcttccccctcaagaattgctctttaaacataagggggttttgagaggaacctcgggccggtccctcaggctgttaggaaagtctgcattttgcagagctgctctccccgggaggagatgaacaatgagctaattacatttttatctttctaatgagctgaggatttgtgtaaatgagaaaagcagggggtacgctagagggagggagaaaagactttccacccccagccctccgagggcagagctggtacctggaaggggtggagaaacagaagtccccacggttcctaaactttctcagccagttttgcagcaatcccaaggctacttgactgaatgaccagtgaaggaaagggcttggttttattttttaaatctttgtcgaacctatgaaaataaacaaaagctgctccaagcattctctcggcctttctgaactttctacgctttgggtttttgttttttcctcccgtctcagaggttaaaaacttcgatagggactcggagtcctcctagaggagagggaagctcccctgttatttaaagcgcaaggctttgtttcaggtatgggaaaggcgaagttggatcccaggaagagcggctccggggaccacagcgagtccctgcgaggccaaggcgcagagctgccgctcccgggccagccccgccgtgcacctgggtcgcgaggggcgctgagcgatacctgggacagaccagacgcgcttaggaatcacgtgcacagcatgcgagcaacctcgggccctcagtccccagcaccgggacccagcggcgggcgggcgtagggtggcgcgggttctcctgcagctccggccgggggatggagggggcggctcgcgcacgtgggaggaggcagccttaccttggggcttggaggcttcggtggcattgggcggcgtcatggcgatgcagacgtccccctcggggaacttgtcacacttaagcatctcgggccagtagaagccgaagaactgcatgaccggctcgcacgagtcgcgcacggcctcgcagagccagcgacacgggtagatgggccggtccaggcagacgggcgcgaagagcgagcagaggaagacctgggtgccggcgtggcagttcttgttgagcaggggcacccagctgctggcctgctgcttcacctccgccatggtctcgtgctccagcaggttgggcagcaccatcttcttgtagcccacgttgtggcacagccgcaggtccgcggggatgtccacgcactgaggtggcttggtgtagaagcgcccgctctggtacgggccgatgtccgactggaagctcacgtagtcgtactcgctggccgagcccacggccagaagcgccgcgcccagcgccagcagcacgcccagggctgccccgcggcggcccccctcgctgcgcccgatgcccatgccggctctgcgccctgttctccgcgacgtcggggctgcctccgccgcctccccgcgcgcgtcctgccgcaaacttccagggacctccggggacaaaaggcgcagtccccagcgttgcccggctccgcggccgcaagctgctgcccggtccccccggccagtggcggccctcggcctgcggtcggaggcggcgcgggcggggaggcggcgctgcgggctgggtgcgccccggctcccggaggtgcggcgagcaggaaggcgcggggcggcgggcgcgcggcactgactccggaggctgcagggctggagtgc

SEQ ID NO: 2583 - DNA, 10326 bp, Homo sapiens
caatggggagcggaggtgccggaaccacggaccaatggggcgggggcgctggggctcaccatataaggagcggcctcgccataaaaggaaacattgtatctctttatatggggggaagggtcgggggatccctccgccgccagcgcgtggtcccggccccctccacccgccgtctcggccgcggccagcagcccctgccccccgggggacgctgacggccgcccggcgcgccgccctagcagacggacagggggcgctgcgcgcggcctggggcaacccgggccacaggggcaggaaagtgagggcccaggtcggcccgggcgtgcaggggccccgggttcgcagcggcggccgcggcagcgatagcggcactagcagcagcgggagtgccgggttgagccgggaagccgatggcggcggctgcggcggctccgattcctcgctgactgcccgtccgccctcctgcatcgagcgccatgttaccgacccaagctggggccgcggcggctctgggccggggctcggccctggggggcagcctgaaccggaccccgacggggcggccgggcggcggcggcgggacacgcggggctaacgggggccgggtccccgggaatggcgcggggctcgggcccggccgcctggagcgggaggctgcggcagcggcggcaaccaccccggcgcccaccgcgggggccctctacagcggcagcgagggcgactcggagtcgggcgaggaggaggagctgggcgccgagcggcgcggcctgaagcggagcctgagcgagatggagatcggtatggtggtcggtgggcccgaggcgtcggcagcggccaccgggggctacgggccggtgagcggcgcggtgagcggggccaagccgggtaagaagacccggggccgcgtgaagatcaagatggagttcatcgacaacaagctgcggcgctacacgaccttcagcaagaggaagacgggcatcatgaagaaggtaccaagccggggggctggccggccccggggcccggttggggtggggatgtgcaaagggagcccgggaggaccgcagagccgaggcggaggtgagaggctgcgagtccgcaggaggtgtgtgggaggggatggctcctgcccggggagggccgaaggggaggggccgccggggaaatgtggggagaggggagatcccgcgaacgctcgcaaccgtggggaaaggcgcagaggtgggagtgaccggcgccagagaggaagagggcccttgctgagtgaaggggtgaggagcggtgatgggaggctacgaggctgccggggaggtggataatgagaacccgggatcagtaggtccagtgcactccggtgttcggacgagggcgccggaaaagcagggagcaaacgagaaggtatggaggtgaggaggctggagctgcatgacaacaatgagcgaacatgtgtgggaggaagtgggcaccacgagagtagtgctggttggaaggacaggcagggttagggaccaggtaagggagcggggcaggagaactggtgctgccctgagcagcaggaacctagtcctgcgccggccgtgagtcttccatggcatccactgggaaccacatgctcctggcaggacccgctgcagaatctcctgccgttaggacaagtggggtttccagccctagggagaatctatgcttggatggggtttgggggaagtcagggaggcttgcagaggtacctaggaattcctcttctgccagccagtgaaaagtgttgaggaaaggagtcattttggggtgtagacgataagggaagagatgaaagcagaggaactgggagacaaggagctggatccttgggaacactggctggtgtttatttctgtcccatgtagaaaccagagctgcttccaaggtggtttgcagaactttgttgggagagtatggcatctatggggccatccttgaaggtccccttcctgggctcatggcaggatgtttagtgctaatctaggtctcgtctcccatcactccagacactgttgtatcagtgtcccttgtcacttgatcatcagtggagaagattgtggggggaggtaattaaggaaaactctcttctctccttccataaccttcttcccaagacaaaggagtaagggcagtaaagtattacagggcaaaaggagaaactaggctgtggcaacaagttggagcctgtgcagtttctggaaagaaacatgggacagttggagcttaaatggtccattatcactaatgtcttgtacaaattccagtgtgataggtagggatccatcctggtccctgtgacagtgagaaggggtgaggctctgggacattccaggcactaagctgtgttggggagcagctagctgggtccttcgtatcccctgaagttatatgttccatcactgggggctgttactgtttgcttggggtatcttcaggtcaatggggctgctcctcaaaggaggagcatgggtagttttgctgcttccagagatcctgataggacaccctgccctcagagtcattagagacgaaggtcattatgggaatgggggaatgacatcactgtataattctttttccaacttctcaaggaaggtagagataaaaagtttgctgacctgcccatctccctcctcacccctcaggcctatgagctgtccacgctgacagggacacaggtgctgttgctggtggccagtgagacaggccatgtgtatacctttgccacccgaaaactgcagcccatgatcaccagtgagaccggcaaggcactgattcagacctgcctcaactcgccagactctccaccccgttcagaccccacaacagaccagagaatgagtgccactggctttgaagagacagatctcacctaccaggtgtcggagtctgacagcagtggggagaccaaggtgtgtttgggttgcctatgtgagaggagggaagggagtggggtccctctccctttctggcccaggacaggtggataggtgcccaccgatgtggagtggagccggattaacgaccctcgtcctaggggacaggtgtccatcctcactttcctgatagaagaccgcccccctagataagcgggcggcctccgtgcccatataaggccggcttgggctccacgccggcctcccgcccgcagcccgcctgcctggcagggcctttgcattcctcccgccagctgtctccccgctaggggcgggggtgtagtttagcccggccctccgggctgggtcgccagggagtagaaagggagcactccggtcccggggtcctgggaatccagcactcttggcaggcgggctggttgactgggccggggactaccttacaagccagccgctgccctttcagggtgttgggggcctgggcagttagggagcgcatttgcctgctgctagggatgcctgcgctgttactcctcccccttccttttcccggtaaggagagggggtggggcttcctcccttgctgtctggggagctccaccttccgggtggcacttaactgactggccaatgggaggaagcggcactgtttgccttagcaacgcctctgccaatcaagggtcttgggcccagctgctttgcaaacgtctcgtgctgacccaccccgcagcctttgagcctctggttgactcatttcgggtctgggcttggtggcttggttctcagtttccttcttccccttctaagaacgaagtcttccttaggggagagtcagtgctgtaggctacctcctctcttagtggcatatcatctgtaataatttttaaacttttataacagtagggctcatttattcccaggaaattttgttggatgagtacattcttttggtagtttacatcttgggtgtttgacatatagtgtgtcattgccagattctcaagatctctctcaaactcttaagttccctgagaaactcagttcctatctcagaagcctgacaaattagagctggaagaactctttgaaagaaaacgtagtagcccagccccctcatgcttatagaagaggaaaaccgaggttcagaaaaggggactggttatttcagggtcacttagatggtcattaccagagctaggaacagaccttggtgtcctgactccccagccaatgggattaccacagtccgctggagcagagaactcaggggattataataatgacaatgataataattatcataagagcagcaaatatttattttggtttttttatgtgccaggtagtgttttctaagtgatttacatatgctaacctacttaatccttacagcaacctagggggtaggtattatcctccttttaccgatagaaaactgtagctcagtagatcaataacttacctaagagtcaggcatcaggtaaatggtggcgttgggatttgaacccaagctcactggtttcagtctgggttctcagtccacacaaagcttctgcaaaggcaggatctggtaggggctcattgcttcatctttactctgggtataggacacactgaagccggcgttcacagtcaccaacctgccgggtacaacctccaccatccaaacagcacctagcacctctaccaccatgcaagtcagcagcggcccctcctttcccatcaccaactacctggcaccagtgtctgctagtgtcagccccagtgctgtcagcagtgccaatgggactgtgctgaagagtacaggcagcggccctgtctcctctgggggccttatgcagctgcctaccagcttcaccctcatgcctggtgagtcacgaggggcagggagagattcgtccttcctggggcaaatcaagcatgctaagagtgtgtttagggctggcaccaagagaacctctttccctgctcagaaggaaggtgaataggggccagagcctgagcgaagcctcttatatcccgttggcaggcatacctctgcccactgagacccctgctgtccttgtcagtaagtttcaaccatatattctggccctgtctagctaccccagccccgtgccctcattgccacagggcagtagatgtttcaccacttcctgccttgactggaaggcagatcatgtctttgatgggttattgccagctcttgggtcaactgaagaaaagagagacaaggcccagggcaggaggaggagggatgggcaagagtagagcgtggaagcccccagagtggatacttgggcctgaagggcctctttggcttccaggaaagatagtgatgggagttggagaccagtgtgccagaccctgggactggggtgtccatgggtacttggtggaggtggcaattgggtgggacagagcacaaataagactctgtgtcttgcaggtggggcagtggcccagcaggtcccagtgcaggccattcaagtgcaccaggccccacagcaagcgtctccctcccgtgacagcagcacagacctcacgcagacctcctccagcgggacaggtatagctcgcagccctgtcaccctccctccctgccttcccccacgaggcctagcagtaggtgcccaacagtaaccctcctgtaactaaagtcaggggatttcttaaagtggagattgaggctttgggcctaataattatggggaagtcaggtgaggatgactgggttttgaatcccgccctgcagtgggctgcggattccagaagaaaattggggaccattgacctacctcctcattcagatgaggagcctgaggcctagaaataagaagttacttgctcaaagacacatttgcttaattatcaggaaggacttagagagcaattttctctttgtgcgagggtcttacaggttttgagtagccacagttaccctcaggtatctctagacatttcagaaatgatgagatactctcaaagtaaggttaattttaagttcttattatttataacctttttactcaaagtgtggcctatggactgggaacaccagcattacctgggagcttgttggaaatacagaatcttgagtctcaccccaaacctagtgaatcggagtctgtttttttttttttttttgagacggagtctcgctctctgtcgcccaggctggagtgcagtggcaccatctcggctcactgcaagctctgcctcccgggttcacgctattctcctgcctcagcctcccgagtagctgggactacaggtgcccgccaccacacctggctaatttttttgtatttttagtagagacggggtttcaccttgttagccaggatggtctcgatctcctgacctcgtgatccgcccacctcggcctctcaaagtgctgggattacaggcctgagccaccgcacccggcccagagtctgtgttttaacaagattcccatataatgcacgttaacatttgagaagtgcttgtttgaaagatgaatttgttagctgtgcattaagaaggagagagaggccgggtgcggtggctcacgtctgtaatcccagcgctttgggaggccgaggggggcagatcacgaggtcaggagattgagatcatcctggctaacacggtgaaactccatctctactaaaaattcaaaaaattagccgggcttgatggcaggcatctgtagtcccagctactcgggaggctgaggcaggagaatggcatgagcccaggaggcggagcttgcagtgagccaagatcgcgccactgcaccccagcctgggtgacagagtgagactccatctcaaaaaaaaaaaaaaaaaggagggagaatgagaacaaataaaaaataagatgttagagctcctaaaaggggagtatctgagttttctgagagtaggtcagtcataatctttgtttttcccaagatttaggacttagagaattcagtagatagacaattgaataaatagtacaatgtgataggatacaattaaagattgatgctgttgtgttcaagaaaaaataggcttttcttagttgatgatggagctgaggaatagtcgtgtctagcttctgacctgggaaatggcaagagggctctgggggcctggaattcctagggacggaatgggagttatcagtggggaccagtgccgagctgacacatgtctgtgtttgccagtgacgctgcccgccaccatcatgacgtcatccgtgcccacaactgtgggtggccacatgatgtaccctagcccgcatgcggtgatgtatgcccccacctcgggcctgggtgatggcagcctcaccgtgctgaatgccttctcccaggcaccatccaccatgcaggtgtcacacagccaggtccaggagccaggtgagtagaggagcagggctaaggaaaggaggaccgtttccttctttatacacacacacacacacacatacacacacatatgcactgatgcctacaaatatttctacccaaatacaacacagacttggatgctcacacacacatttggacaccccacttggacactcacacccgcatgcaccctcagacacactggcaccctttcccttgggctcttacatctgagactgccccagtcacttgtgcatttgacaccactcctccaatatctggaagtttcaacaaacaatttgagtatctcctgtggttttccaatgtaggtggcgtcccccaggtgttcctgacagcatcatctgggacagtgcagatccctgtttcagcagttcagctccaccaggtaggtagggatatctttcaccccatcccagatagccacttctttgtcttgaccttaggggatcctgttaccagttcatcaaagccaaaatccctagcctggaagcccatctgcttttctgctcaggcctgtggttggcaggcagggaagccaggggagcctgaactggctggccagtccctgcccctcctcatacatccccttccctccagatggctgtgatagggcagcaggccgggagcagcagcaacctcaccgagctacaggtggtgaacctggacaccgcccacagcaccaagagtgaatgatccgcccgccgccctggacagatggcccaagggatggcaccacttatttattgttgccttttcacgttttctttacacacacgttgacgggccgcaggagggaggcggggaggaggaacgggcagccacaggactgagccctctcactccagccaaagaaatgggcctgcctgcctccacccgtcctccctcagcctccccttcttcccgccccacctcccatttctgttgctggaggggctgtcctccttcctgggaccccctcgccagcttggctcgatgtttgccatgagtattagcttacccaatgggaccgtgccccacctccccacacacaggccttctgtggggctgggcaccgtgtcctcctctgaggaagcagttggggccctcttgccagcctccttgctgaccccaggtcagccctgtgtctgtcacaggctgggtcaaaagagccctggctctgcccctcagggggccagctggggagatgggggcttcttcctcacactgctgtcctctcccccttcagctcctgagtagctgggcctgtgcactgggcaggttcctggggccgcctgccctgccttgccgctccccttggacctccaggggctcctgggttggagggaaccaccagcgttcccttctcccccttgtcttcccccctctcctcccagctgctttacttaaagttgattttgaactttttatttgaggagacgaagtgaaaacaaatctataaatatatatttttaaaatatttaacttttttttatggcgtttttctcgtccccctccctgcccaaactccccttccctggggagccctcaggctccccagaactggctgggcccctggggacagagccaccccatgagctcggggtccaccagtgtgtgggggagattctgggtttgcccagtcctgggttgtttccaggagaaagccgggggaggggccctcaggccattccccaacggggtggggagggtgacccacagctctgggcctctttttgccctttagggctgttgctagggagagggaagagggagaccaaatgtcggggttggggtgggagggcgtcaggcagaggcaactgacttcatttgtgccacacgcatgggcattgcagccttgcgctgtcccaggcatgcagctgcctggggcccaagttgcagtgagcagggtggggtctgggagggggtgagaggcaggaatgggggtcagaagaagtgggagcagcttcttgggctgagtgcagccaaaggggagccagaaatgggcagttctcccagggagtgagcagctactgtaacttttttaaattaagacaaaaagccttgaagaaaatgactttatttttctaagtgtaacctcagtatttatgtaatttgtacaggggccatgccccacccccctcctccccctttggggtagaccttgagggtgggccagcataggggggagggtcttttaccctgtgtcagagcctaccttcaccacctatatccagaaggggagctttttcagaaacagggcagcagtggggtgaaattttcttaacccctaagactgccttcagtaggaacaagctggcttctgtgattaggtgaagggatgggggaagattttatgcacagcctagttatcaaggggatgatttgccgacatgtttgagaaccccctaacctctaaccctcattgctgtcttgccccagtttggggtgccaagatggaagtcacctttctgggctttctcctggagatagctggggcttatgggtggctttcaaggctggggcatggcaaatcaggggccagagagcaggggagcttgggactcaggtctgtaactgcccagccccttttctctgctcttgtttcactccaccatcactcactcactccccactcccccacccatggggaggagacctttgatgaattcttcctctccttcccacaaaagacagacccagtgagtgaatcaggcaaagtgcttataatgtgtgttgtgtgagcgtggccttgggaggacatgcgtgtgtcagggatgagttgaggtgatatttttatgtgcagcgacccttggtgtttcccttcctcggtggctctggggtatgtgtgtgtgggtgtgtgcgcctgagtgagtgtgtgtgcttgaatgtgagtgtgtatgtcagtggtttctacttcccctgggatgctgacccaggaatagtggacatggtcacagtcctatgtacagagctttcttttgtattaaaaaaaaatactctttcaataaatgtatcatttttgtgcacaga

SEQ ID NO: 2584 - DNA, 6402 bp, Homo sapiens
cagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaattagcagcgaagctcgcgggcgctggcgggacaggcgcgtgagggtgagttcgcgtgaatgtgtgtatgcgtgtgcgagaggagaacggtaagtgtcccgggtgcaggtgtgcccgtgaaaatgcgtgtgaatgtagcaggggctgaacacattgatgcgattattacctgaccatggatgattgtaaactgtgaaggtcggctatggggagggtgtgagggactgtgtgcgcgaatgtgtttgaacgtggggtgggggaggtggtgtgatcagggacagtaacaatgccagcggctgtgtaaatgtgggggtacgtgggttatgggggtgcagtaggctgcgaagagcccagccaggacagtgggcgtgggatgccccttatgaccgacgtgtcttggccttggggagggtctccgtggctttaacaaaagtagaccaagcaggaggcgggagaggctatgcgcgtccccgccaggcccgggagtgcgcaaggactttctccaacctgcagccagagaggtgggggaaacggacgcaaaaggaaaaattgaagtggtactttggggccaccaagtccccaaacttacctgtccctttctttgccccccgccccccgttttccccacagccacaacacatgcgtgtatcttgcttgggctatcttccctgctctgccacgccgggtctggagaaggggtttcagccccaggacatttactgagagtcggcgaatattgggtaagcaatgggggccaccccacaaccttgacccaggtggggttaggtccagcctagggcacctgatggggtgcggggctggtgggggtgctgtctggcaggaaccgggaagggagggaagggaccctcccagaagagcaaaggcagagtgaaggagcaggttcccaaagacaagttgtgggaggggctctgccaaacctgacaggcgctccaaatgggggcagggagtctgtgcaagttcgtttgtgtgaccgggcttaaggtgttatggggagggggtccttaggcaccgcagagctgtggagaaaggcgcagaatctttcatcttctccagcttcattagctagtggcagccccatgacctgttggctgaggacgcctctgcccaatgggagccgcctgagggacctgagaggaagctctagtgaccgctttcccaacacacctggtccaaacatgggggagaacctccttccccgtaaggaaggttggcagagcagcccttcttctcccctcacaggagctgcagccccgggcaggtgactttggccttagatgcagtagggcatggggatgggcttccccagatcccacatctcaagtcgtgcagtgcaggtcctcctattgcttctctgctgggtttcggtcacagtggagggctgtatgcacacacaggcacatgcctgtgttcttgtgggtgggtcggttcgtgtgaggacttgtgtccttgtgtctgtcaattgtcacaatggacaggaaagcgctttgtaccgtggtggaaaacacgtacaaatgctggttaagagaacaatgaggtctgcagggtctattgtgtccatgtctgggtgcatatgtgtttgtgagtttaggaaatgtgttgtgagcctcctaattgagcatcaggtcctctaaacccctgcagaagttggcggtttgattatgaagccccgcgtctgtttgtattgttgtgtgcctgcatgggcgtgtgtgcgagtgctgtgcgtgggacaaaggttccagggaggacagccagtcacggacaaaaatgtccttcttgggtaggatccatttcaccaggttaaacgaaggcttagaaacacagagaggggtacgtgaggagcccgctggagatgggcgagctgcggagcccacggaggggccagctccagcgtgaaggaaggagtaggaagagaaaaaagggcgatataccgggccgctggaaaaggaaattagggccctgggagggagcatccgttgaacctcgagatttttattgaccttcacttcagagaggctcctggccatagaggaggttaccggagccctggaactagtgctaaacgggcttgcggaggcacagcttgataggggaggtaagctggggttcagtgagtcaccttctttcttcttcacctggcttccatctgcaggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttgaa

SEQ ID NO: 2585 - DNA, 2907 bp, Homo sapiens
tgagacagagtctcgctctgtcgcccaggccggaatgcagtggcactatctcggctcactgcaacctctgcctcccgagattctcctgcctcagcctcctgagtagctgggattacaggcatgcaccaccacgcccggctaatttttgtatttttagcagagacgaggtttcaccatgttggtcaggctggtctcgaactcctgaccttgtgatccgcccgcctgggcctcccaaagtgctgggattattacaggtgtgagccaccgcgcctggtcagtactcttatttatgcctttttttcttgaggcacagagaggttaaatagcttggctaaggacacacagtcagtacataatggagtctgacgctaggacctgcccgcctgacgactacatagaacctgtacaaggaaaggccggaggagggagtataaacagggcctggcttccctgaggagtgatctttcgactggaaattagaaaaggaaagcagcttcttgagggtgtggggctggagagaacatttgtgtgtgtgtgtgtgtgtgtgtgtgtgtgtgtgtgtgtgtgtgtgtgtgtgtgtgtctgtgcgcgcagaagctgaaagatgggaagtagtgagtgttcaggggcttctgactggagggcagccttggggaaggtctccgcagccttaaccggctgctatgctggggatgtttgatgcccatctgggccccggctttcttattctcagaggcccttcccacatctttaggcaagtccattaaatcctccgcgtgccacattaaaatacaagggcaagtacaactctgagtgcagttgcaacagaatcgtttgcacaatgtcgcatgtcttaaacattcaatcaaacatcgattacttccaattttgcagttttctttgcccctgttagcgccaacagatttttttttccagatctcagacatttattttaataggcccctgacaaagtcataagactcagagagaagggagagtgggagaggtgtataggaaggttttgtgccagggactagtcgctcaagaattaggagacgccctgggcactggaaactacgcagcgcgaagtagggacagcgcctgtgttgtgtagtggaccagaggttgctgatacctgggacatagactgggtgggcacgggaagtaaagcctcgggactttggttaagcgcgccccactggcgtatcgcgccgcgggactgcagagccgtgagcagcggtcgccttggtgcagggttccagccacatcttcctcgcccagccagcaccctctgccgttgacccgcctctgcgcccggcaagcggcttccagcagggggcgcgcgcggaccaggcttgggccctagaacagcgcggatggagtcgctggagcaagtccccagatccaaccggtttcaaccctccccaccctcccgacgctccgggttcgcgacgttgaagttaagggtcgatccgcagaaagcggccaggggctccagctctccattcctgggtctgtctggggtcggctccagcctggttagaagccttagtctggattcggcagattctgaatctgggaccctctgcgctagcggcttggaaccttgtcaccctcccctcccccacccctacttccacacacctgattagttgtctgtttctttaatgatcaaagacgtgggcggcggcgggatgaggtcttggttcccggctccacagccctccctaactgtcattattaacgttataaacattagacccgcttctgcgcgccggacggcgccggacgaggtgcgcgcagtcttctagctgagctcggaggcagatccagaagtcgcggctcccaccccaggcctcggcggactctgcctggggcgactcgggctccagccctgcccgggcgggcactgggctctccagggtcgaaggcaggggtaaggggcgtctttcccccagggcagcctccgggaacaaaagcatttgctgtagagtgagctagagcctccgggcccgcgggagtcagctcccgcccaggggtggtcaccgcgtccttaaccaccccaggagccccgtctccctgccgaactccttggcttctgcaaccctgtcaagacagcaaggaaagggggtcttccctggtcctcgggccccgaagtttcggggttgcttataggacgggttcctgcagtccagggaagctctgggcagatagcgagcccattctcccttccattacccagattctgcctccctgcggaaggcaaaaaagaaagaaagaaaataggtaaaaaccggcggagggccttgagcctccccgcctggcgcccctcactcagtcccgaaaagtcccctggacacgccatgccggaccggactcagctcccgctgctgggcccctgcctccaaatatccttcccaggcacaggctcccaagaccgccccctcagggttcccaacacccggacaactgcccaagacgccgctccccgcccccacccccaccttgttcggcagacaaagaagggtgtgctggccccgccgtctgcctccttctcccgaccccacaaggcctagaaacctcagggactcaccccgggctagggacccaatcctggctgtcccaccacaggatccccggcagggacgggtcacagtgctctcacccctcgaccattttcgaagacaccttccctgaaaggcgccttgcgccctccccatgggtcggcggggggggactccaggcccgagcaggcggtgtgaagttctgtgttctgaactggggctgagcaagatgcgatggtctcagcccgctgggccgcccgtagcgacggcaggagtaggggagagggagggacgcttggagtgtgagcgcaccagtctgttcatatttaatttacaaagcagc

SEQ ID NO: 2586 - DNA, 6555 bp, Homo sapiens
tatatcagcccagatccaggcaaaaatggtagggagggtgcggcgctctgctaacactatcaattatgcatcatgttgaacgtggcttcggggaggaggcggctagcagcggggggtgcgggagggaagggtccgcgcgagctcggctgcgcgcagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaattagcagcgaagctcgcgggcgctggcgggacaggcgcgtgagggtgagttcgcgtgaatgtgtgtatgcgtgtgcgagaggagaacggtaagtgtcccgggtgcaggtgtgcccgtgaaaatgcgtgtgaatgtagcaggggctgaacacattgatgcgattattacctgaccatggatgattgtaaactgtgaaggtcggctatggggagggtgtgagggactgtgtgcgcgaatgtgtttgaacgtggggtgggggaggtggtgtgatcagggacagtaacaatgccagcggctgtgtaaatgtgggggtacgtgggttatgggggtgcagtaggctgcgaagagcccagccaggacagtgggcgtgggatgccccttatgaccgacgtgtcttggccttggggagggtctccgtggctttaacaaaagtagaccaagcaggaggcgggagaggctatgcgcgtccccgccaggcccgggagtgcgcaaggactttctccaacctgcagccagagaggtgggggaaacggacgcaaaaggaaaaattgaagtggtactttggggccaccaagtccccaaacttacctgtccctttctttgccccccgccccccgttttccccacagccacaacacatgcgtgtatcttgcttgggctatcttccctgctctgccacgccgggtctggagaaggggtttcagccccaggacatttactgagagtcggcgaatattgggtaagcaatgggggccaccccacaaccttgacccaggtggggttaggtccagcctagggcacctgatggggtgcggggctggtgggggtgctgtctggcaggaaccgggaagggagggaagggaccctcccagaagagcaaaggcagagtgaaggagcaggttcccaaagacaagttgtgggaggggctctgccaaacctgacaggcgctccaaatgggggcagggagtctgtgcaagttcgtttgtgtgaccgggcttaaggtgttatggggagggggtccttaggcaccgcagagctgtggagaaaggcgcagaatctttcatcttctccagcttcattagctagtggcagccccatgacctgttggctgaggacgcctctgcccaatgggagccgcctgagggacctgagaggaagctctagtgaccgctttcccaacacacctggtccaaacatgggggagaacctccttccccgtaaggaaggttggcagagcagcccttcttctcccctcacaggagctgcagccccgggcaggtgactttggccttagatgcagtagggcatggggatgggcttccccagatcccacatctcaagtcgtgcagtgcaggtcctcctattgcttctctgctgggtttcggtcacagtggagggctgtatgcacacacaggcacatgcctgtgttcttgtgggtgggtcggttcgtgtgaggacttgtgtccttgtgtctgtcaattgtcacaatggacaggaaagcgctttgtaccgtggtggaaaacacgtacaaatgctggttaagagaacaatgaggtctgcagggtctattgtgtccatgtctgggtgcatatgtgtttgtgagtttaggaaatgtgttgtgagcctcctaattgagcatcaggtcctctaaacccctgcagaagttggcggtttgattatgaagccccgcgtctgtttgtattgttgtgtgcctgcatgggcgtgtgtgcgagtgctgtgcgtgggacaaaggttccagggaggacagccagtcacggacaaaaatgtccttcttgggtaggatccatttcaccaggttaaacgaaggcttagaaacacagagaggggtacgtgaggagcccgctggagatgggcgagctgcggagcccacggaggggccagctccagcgtgaaggaaggagtaggaagagaaaaaagggcgatataccgggccgctggaaaaggaaattagggccctgggagggagcatccgttgaacctcgagatttttattgaccttcacttcagagaggctcctggccatagaggaggttaccggagccctggaactagtgctaaacgggcttgcggaggcacagcttgataggggaggtaagctggggttcagtgagtcaccttctttcttcttcacctggcttccatctgcaggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttgaa

SEQ ID NO: 2587 - DNA, 7149 bp, Homo sapiens
tgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcaggcaagacctggagtgaggtgcttgggtgcgctcgagagagcttccccctgctccacctgtcccgcggtgcgcgcaggccaacgcgtcgggcagtgggcttcaagcgctggtttagccacaaaagaccagaagtaaagagttccggcttaagaggctgggcagggctgcggtgggctggggaggggggtgtcccttcccagcacgccctgcagggctgtgcgttctggtgtcgggttagactagcaggcggggcgggggggttggggcggcggggcgggggagactagggcttatatcagcccagatccaggcaaaaatggtagggagggtgcggcgctctgctaacactatcaattatgcatcatgttgaacgtggcttcggggaggaggcggctagcagcggggggtgcgggagggaagggtccgcgcgagctcggctgcgcgcagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaattagcagcgaagctcgcgggcgctggcgggacaggcgcgtgagggtgagttcgcgtgaatgtgtgtatgcgtgtgcgagaggagaacggtaagtgtcccgggtgcaggtgtgcccgtgaaaatgcgtgtgaatgtagcaggggctgaacacattgatgcgattattacctgaccatggatgattgtaaactgtgaaggtcggctatggggagggtgtgagggactgtgtgcgcgaatgtgtttgaacgtggggtgggggaggtggtgtgatcagggacagtaacaatgccagcggctgtgtaaatgtgggggtacgtgggttatgggggtgcagtaggctgcgaagagcccagccaggacagtgggcgtgggatgccccttatgaccgacgtgtcttggccttggggagggtctccgtggctttaacaaaagtagaccaagcaggaggcgggagaggctatgcgcgtccccgccaggcccgggagtgcgcaaggactttctccaacctgcagccagagaggtgggggaaacggacgcaaaaggaaaaattgaagtggtactttggggccaccaagtccccaaacttacctgtccctttctttgccccccgccccccgttttccccacagccacaacacatgcgtgtatcttgcttgggctatcttccctgctctgccacgccgggtctggagaaggggtttcagccccaggacatttactgagagtcggcgaatattgggtaagcaatgggggccaccccacaaccttgacccaggtggggttaggtccagcctagggcacctgatggggtgcggggctggtgggggtgctgtctggcaggaaccgggaagggagggaagggaccctcccagaagagcaaaggcagagtgaaggagcaggttcccaaagacaagttgtgggaggggctctgccaaacctgacaggcgctccaaatgggggcagggagtctgtgcaagttcgtttgtgtgaccgggcttaaggtgttatggggagggggtccttaggcaccgcagagctgtggagaaaggcgcagaatctttcatcttctccagcttcattagctagtggcagccccatgacctgttggctgaggacgcctctgcccaatgggagccgcctgagggacctgagaggaagctctagtgaccgctttcccaacacacctggtccaaacatgggggagaacctccttccccgtaaggaaggttggcagagcagcccttcttctcccctcacaggagctgcagccccgggcaggtgactttggccttagatgcagtagggcatggggatgggcttccccagatcccacatctcaagtcgtgcagtgcaggtcctcctattgcttctctgctgggtttcggtcacagtggagggctgtatgcacacacaggcacatgcctgtgttcttgtgggtgggtcggttcgtgtgaggacttgtgtccttgtgtctgtcaattgtcacaatggacaggaaagcgctttgtaccgtggtggaaaacacgtacaaatgctggttaagagaacaatgaggtctgcagggtctattgtgtccatgtctgggtgcatatgtgtttgtgagtttaggaaatgtgttgtgagcctcctaattgagcatcaggtcctctaaacccctgcagaagttggcggtttgattatgaagccccgcgtctgtttgtattgttgtgtgcctgcatgggcgtgtgtgcgagtgctgtgcgtgggacaaaggttccagggaggacagccagtcacggacaaaaatgtccttcttgggtaggatccatttcaccaggttaaacgaaggcttagaaacacagagaggggtacgtgaggagcccgctggagatgggcgagctgcggagcccacggaggggccagctccagcgtgaaggaaggagtaggaagagaaaaaagggcgatataccgggccgctggaaaaggaaattagggccctgggagggagcatccgttgaacctcgagatttttattgaccttcacttcagagaggctcctggccatagaggaggttaccggagccctggaactagtgctaaacgggcttgcggaggcacagcttgataggggaggtaagctggggttcagtgagtcaccttctttcttcttcacctggcttccatctgcaggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttgaa

SEQ ID NO: 2588 - DNA, 7430 bp, Homo sapiens
actcaaatcggggtattgatctccacggaagccccaaaccctcgccatcgagagacccccatggcccggggtgatggctgtggggcttggtgctcccagagagctcagtggctacagaatgggtggggattctgcgtgtctcccggagcctgaacccctttcctggttatggccggtagctgtctccagggctaacgtgggcagcgcaggggggcggaaaccgggttttagccaaatgcctcgacatcgccgcgcctccgcctcctcgtcgctgaaagaaatgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcaggcaagacctggagtgaggtgcttgggtgcgctcgagagagcttccccctgctccacctgtcccgcggtgcgcgcaggccaacgcgtcgggcagtgggcttcaagcgctggtttagccacaaaagaccagaagtaaagagttccggcttaagaggctgggcagggctgcggtgggctggggaggggggtgtcccttcccagcacgccctgcagggctgtgcgttctggtgtcgggttagactagcaggcggggcgggggggttggggcggcggggcgggggagactagggcttatatcagcccagatccaggcaaaaatggtagggagggtgcggcgctctgctaacactatcaattatgcatcatgttgaacgtggcttcggggaggaggcggctagcagcggggggtgcgggagggaagggtccgcgcgagctcggctgcgcgcagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaattagcagcgaagctcgcgggcgctggcgggacaggcgcgtgagggtgagttcgcgtgaatgtgtgtatgcgtgtgcgagaggagaacggtaagtgtcccgggtgcaggtgtgcccgtgaaaatgcgtgtgaatgtagcaggggctgaacacattgatgcgattattacctgaccatggatgattgtaaactgtgaaggtcggctatggggagggtgtgagggactgtgtgcgcgaatgtgtttgaacgtggggtgggggaggtggtgtgatcagggacagtaacaatgccagcggctgtgtaaatgtgggggtacgtgggttatgggggtgcagtaggctgcgaagagcccagccaggacagtgggcgtgggatgccccttatgaccgacgtgtcttggccttggggagggtctccgtggctttaacaaaagtagaccaagcaggaggcgggagaggctatgcgcgtccccgccaggcccgggagtgcgcaaggactttctccaacctgcagccagagaggtgggggaaacggacgcaaaaggaaaaattgaagtggtactttggggccaccaagtccccaaacttacctgtccctttctttgccccccgccccccgttttccccacagccacaacacatgcgtgtatcttgcttgggctatcttccctgctctgccacgccgggtctggagaaggggtttcagccccaggacatttactgagagtcggcgaatattgggtaagcaatgggggccaccccacaaccttgacccaggtggggttaggtccagcctagggcacctgatggggtgcggggctggtgggggtgctgtctggcaggaaccgggaagggagggaagggaccctcccagaagagcaaaggcagagtgaaggagcaggttcccaaagacaagttgtgggaggggctctgccaaacctgacaggcgctccaaatgggggcagggagtctgtgcaagttcgtttgtgtgaccgggcttaaggtgttatggggagggggtccttaggcaccgcagagctgtggagaaaggcgcagaatctttcatcttctccagcttcattagctagtggcagccccatgacctgttggctgaggacgcctctgcccaatgggagccgcctgagggacctgagaggaagctctagtgaccgctttcccaacacacctggtccaaacatgggggagaacctccttccccgtaaggaaggttggcagagcagcccttcttctcccctcacaggagctgcagccccgggcaggtgactttggccttagatgcagtagggcatggggatgggcttccccagatcccacatctcaagtcgtgcagtgcaggtcctcctattgcttctctgctgggtttcggtcacagtggagggctgtatgcacacacaggcacatgcctgtgttcttgtgggtgggtcggttcgtgtgaggacttgtgtccttgtgtctgtcaattgtcacaatggacaggaaagcgctttgtaccgtggtggaaaacacgtacaaatgctggttaagagaacaatgaggtctgcagggtctattgtgtccatgtctgggtgcatatgtgtttgtgagtttaggaaatgtgttgtgagcctcctaattgagcatcaggtcctctaaacccctgcagaagttggcggtttgattatgaagccccgcgtctgtttgtattgttgtgtgcctgcatgggcgtgtgtgcgagtgctgtgcgtgggacaaaggttccagggaggacagccagtcacggacaaaaatgtccttcttgggtaggatccatttcaccaggttaaacgaaggcttagaaacacagagaggggtacgtgaggagcccgctggagatgggcgagctgcggagcccacggaggggccagctccagcgtgaaggaaggagtaggaagagaaaaaagggcgatataccgggccgctggaaaaggaaattagggccctgggagggagcatccgttgaacctcgagatttttattgaccttcacttcagagaggctcctggccatagaggaggttaccggagccctggaactagtgctaaacgggcttgcggaggcacagcttgataggggaggtaagctggggttcagtgagtcaccttctttcttcttcacctggcttccatctgcaggagccgcgatgttcccccttcgggccctgtggttggtctgggcgcttctaggagtggccggatcatgcccggagccgtgcgcctgcgtggacaagtacgctcaccagttcgcggactgcgcttacaaagagttgcgtgaggtgccggaaggactgcctgccaacgtgacgacgcttagtctgtccgcgaacaagatcactgtgctgcggcgcggggccttcgccgacgtcacacaggtcacgtcgctgtggctggcgcacaatgaggtgcgcaccgtggagccaggcgcactggccgtgctgagtcagctcaagaacctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttgaa

SEQ ID NO: 2589 - DNA, 28589 bp, Homo sapiens
tttctcaggaacaagtttattgcagggaacacactaacctctttcataatagccaaaggcataaaaactacaaaaatatctggctctcgagtgtgggcagctcagtgtgggacctggtctgagtcatgacttgggctgccctgcaggccagaggcccgggagctttccggccactccccagagaggtccgtggcgctgagggggtgaggaagtgccttggctgcttccacagcgtgaaggccaaggctgaggtggagctgggctggagtggttccagagaaggcttcatcgaggcccttcaaggctgatggcagagccagggtagggagacgcctggatgtggctgccctggctcaactggctcctggaccaaggccctaacccaccagtttctttctccagaacccctgctggctctcccatagccaagtgggtggagcagagccctcctgaggctcccagtgcagacagacctccacccaaccacagtgatccggaggacctgctggctgcatggctggtgtgatgctgggaggagagccggggagggaggaggatggtaggcaggaacatgcctcagcacagatgggcaggtgggttgaccttccctgccctcagggctgggcaccattggcacccaacagggccgtcttgcggaagacctgcagggttgggttgtgcagcagcgtgtaggccagaccccagcgagccctgccgcggctggccccgggcctagctcccttggccatggagtcctttgtctgtagcagctgcatccctgagagagacggactttctgtgagtcactcagcaaacacccagccaaccctccctggccctcagacctgatcagagagcctgaaaatcccaggcgtgtgcaggtcgtgaggcttaggatgtcccctgcaggcagcacatggaagtggggggtgaggtctgtggatggactggaagctgggtgggacaagggtctggagctggcttagtgtcccctccctacacacacttctgggcagaaggaaaggaggagtcatactccctgccccaagggagaagcgggggcagtgacggagccccttaggaaggcagctgtttcattctctctgtgtgcacacatatggtgtgtgtatgtgtgtgttcatatcatggaaaaaatcaccctgagatcagaccaggaggggtgaccaaaggcagccaaggaagagaggaagtgagaattttcctggcgctcactctgtgtgctggggaggggcacacatccttcctagaagaagctgggtaggctctattcccccattcccagtgggagggcgcaccttcgtcttcctcccctggtctgaggctgtcctggggggctgccatggtcctgggtaggaggctctgcgcttgcaggagcagggagcagaaggctgtcatggctggatgcgactggctgacttcaatcttcaagaagtttcggtacgtgtagtagcctggggtggggtggcggatggcaatgctgggggagcaggggccacactggaggcatccagacatcccctaacacacacacagggagtgcacgtgcactccctgcatccaagcatgtcgacacaccaagcacgtggcacattggctgcatgggcacgtgtggacctgctagaacaccccacatccactgcacgtgctgcagggccacaggaggcacagcgcaggggcacacaggtggcacatgcagctacaggcatcggtgtgaactgatcagctggcacggccctggggcagggcagatgccttcctcactgcttgggtagcctgagcaatcctccagccccgcccagtgaccttaccggggtcgagagtggcggctctcggtggcagcaggctgaggtccatctggccaaggtggatggcgttgtagagggcagagaggagcactcgccaggtggccaccatggcacccaccagcacattgagggggaagagaagaaaggtggctgcatagagcactcgcctaggatgggagaagaaagctgaggcaggccgttccccagagctccctccccagggtcagtgtcagacctggatgcccagaactgctgtgtatttactgagtgcctaccatttattgctatgtcttctgtgcaccccaccctgggcaaggccttctctctttcaacccaccatgctgggagatgggaaactgaggcccagagagattgggagacttagccaaggctgtcagctattcagtggcagagctgggctttaactctaggtccatctgagtctttctatgaccctgatgcctcccacctcccttttctgggtcccctgtctgctaattccaagttcccctgggagccaaggttctcccacagacttgtcatctgacagggaactcccttgctacaaagtggggaggggcatggttttaaggaaacagaggatccaggggagagcagtaccgattcccaaagcaagaaaggttcacgggggtacttccagccccatgccgggtatgtagagaggtactttggagtgggctgagccattgtcccttttctctatgggtaaggcaagctctttctactatcatctgggttccttgatagagagaagggatagatggcagtggagggaggacacaaaaagagagagacaccgaagaagaggcgagggcctgagggagccacaagcccagatgccacctcaccggttggtcagctgtgggtgtccatcatgagtctccaggaagacccaatgggctgccatgttctgcaggatcacagccagggccaaagtcagccagaagggcctgccagtggggtggggaggtggtcgctgttagcggacctctaaggagtccctgagccctccatgtcttgtttcactcaccacgaggactccagggaacggaagagcaggaggttcctgccatggagcacaggcatgagcaccaggaaggccagggccgtggttcccaggaagaagatgatctgctgcaccaggagccctgccaggggcgggagtggcagggggacagaaaacaggttccatgaaaactggccatccccgctgcccccagaaccaagggctttgggattgggcaggcctggttttagatctctgctctgccactgcctagctatgctgccttgaacaaatcactttacttcattgagcctcagtttcttcctctgtaaaatggggataatagtccctacctcagaggctgttgtaaggatccaatgagataatgtctgtggaaactcttaaaatcacaaaatactttgcaaatgttatttccctccagtttctcctgagtttgagttactgggggataaggctacatattaaactgatgtttgcattccttcaagccagagcctggcatacggtaggtgcccaaggactgtctattgaaataatctggccaactgattagagaatgatgtctacaaaagggcctggaggcataagggctaccaagaagagacgctatgacttttgtcctagtaattcatctactcctttaccatccttctcctcccgcaaggaggtgagaatggaaggaactggagggagagatacaaggcccttggatgtgcaacccaggccacagcccctcaccattcagagtgcttttctcactgcagtacccaaggggagagtcagaaacttggggctggtaggggtcctggaaggttatctggtccaactctctcagggcaggaccccctttgcagactgcaacaatatccatggaactctgcttgcatacccccagtgacagggatctcattacctttgtaggtagccaaatgtgacacagccctttcttaagctggagcgcagtggtgcaatctcggctcactgcaacctccacctcctgggttcaagcgattctcctgcctcatcctcccgaatagctggaactgcaggtgcacaccaccatacccggctaatttttgtatttttagtagagacggggtctcaccatgttggccaggctggtcttcatctcctgacttcgtgatccacctgcctcagcctcccaaagtgctgggattacaggtgtgagccactgagcccagccaggaatgtaccattttgaatttgacacctccagacctgggtccacccccatgtgaatacttggtggcacccagggttcatctccatgtggagggtacacactcaatttcccgagggctcctgtacccccatcctgaataagcttcttaagggcagggaaggcaggggggtccctccttcttgctgctgccccagagcattcccagacaaactctgagggcagtacttgctgagcactcttctccccaactgaggccagtgtctgaggggaggcccaggccaaggctgggtgtggcgggcaagggaggctcaccaaggcagataaaggctgtctggtaggcactgaagctcatccaacagaatatggcttggcgggagggatggggactccgatgcaagggactcaagtccagggcagctcctcggtgcagagctcgaaggttggtcctggggtgggagccagggaggcagagacctcagggagcaacacactcttcctaaatcctcctctgggccagcaactggccaaactcccaatagaatttcaactcacagccatcagcagggaagcccagaactgtgggagccaggaggaggccactaacccaagatatctggaagaggtgatatctgggtagtcttaaacagtgaacgaggaatacaaaacgaggcagaaggctcaacctgagccaagtcagaaaagtgagaaacaacagtgagaatggaagtgacacacagcacagccaacaggtaaagaggcaaggcaagcacaggctgaggagccttgaatgccagaagaaggaggggtgacctgtggaaaaagatccctgggaagagctctgagacctggcaagtgcgcaggagacatgggccagttctctgacatgggtaagtgctcgggctgccccttccacctgccctgggccttcagtgctcctcaccactcaccgctgcagggcaagcaaggtggcatggcgagacccgtaccacctctccagtgtgctatgccaccaggctacccctcacctacactctcacatggcagggccaccccagcctctgttctcgtccacacagtcctcacctcctatctccttccattcccgggcaggtgcagcttccccaggccaccttccctctcatccagcccacccggtggcccctactcagggggcaagctccactagctgccctgagttggtggtgccctatgtccctcacactcacagacgtttccccaaccagacaggaaggcccaagggcaggacccagccccaccttctcccactgcagcgcagccacgcacaggtgggctccatgacagcccgggccggcagagcccttccctccctccaggcccagggcctccccgcaggcccacaggactcccactccttccccacctcggcgctgggtgagccagagtctgtcactcacctgtgtgtcaccagtgagcgcatcaggaccaggaaggtgagtaagcaggacaagaccaaggctgagatgtagcacactggtgggcagagaatgagcaaagtgagaggtcagggtctggagagtctcctggaggcctcagaacccctgccagggtggtgccttgtggggagttccccctgccccaaactgaactctgtgtggaagcctcttggccccacccccaggtctcagatgcagtgtaagccaatgacttcggccaccccattcttcccagtgacatacagtggtcaagagatgaaaccagctctgagtctgcagacctagtcctcaccctgctgttgctgcttctattgctgtgggacctccatccaacctggcatctgcctccagcttcactgcttcttggccatgtggccttcaggagggcactccttctccccaggcccccatttgctcgtgaacataccgcacgccgttatgctgcccagctctcaggataatgtgagccataaggccccatccacgtctgcactaatggtcttcgttcagggcatagagggtgtgagtccacatcggtgtggactgagtccatcagaatagggaggcagccgctgtcacccagctccctcaccctctccctggccatgcacacaatgagtgtgtgcatgatggtgtgtcatgaacaagcctgggtgtttaagaatttcaggggtgcaggctgcaactctcccaccttacgtccacatccagtcttgctctggactgtaacagcaaccccgcaaggttagacagaagaactgttcccactgggctgaagaggaagctgaggctcagagagagggcttcgcccagacagccatgctgctaggaatgatagagtgaggtgtgtaaccatttctaagcagatccagaatgagcctgagatgcctgcaccctgatctcatcagtcagtccagggaagtgttcctggtgcccgtgtcaccaccagaatctcaaggacggggagagcaaacacagaaaaggtgagtgctagttccacatagccacagggattagagtggtggatctcagcaccgatagcgcctttaggatcacctggagctgctaaaactcgcccatagcccagcctgcacccaaaccagttaaatcagaatttctgtgggtgggacccagccttagcctgtgaaagcaacactggtgattcagtgtgcagtcaggactgacagccactgctctgggggctttccaaaggcagagccttcatgatttatttccatcagaaatgaattgaaatcaaccaaccaaccaatatttattgggtgcctactacagtggtgatcaaactttgcttgcatgagaatcactgggactgtgatcccaacactttggaaggctgaggcggtggatcacctggggtcagaagttcgagaccagcctgaccaatatggtgaaactccgtctctactaaaaatacaaaaattagccaggcctggtggcgggcccctgtaatcccagctactcgggaggctgagatgggagaatcacttgaacctgagagacggaggttgcagtgagccgagattgtgccacggcactccaccctgggagacagaatgagactccgtctcaaaacaaaacaaaattagccgggcctggtggtatgtgcctgtaatcccagctactcgggaggctgaaatgggagaattgcttgaacccaggaggtggaggttgcagtgagccgagattgcaccactgcactccagcctgggcgacagagcacaactccatctcaaaagaaaaaaaaaatcactgggagggctgttcactcaaagaggctgggccccactctgagagtttctgattcagtaggtctggcacagggcttgagcaacgggaatgttaaagccaccaggtgcttcccagattcagccagggctaaaaatgatgctacagaaacctaggcccttctgctggtccctagctccctcctccagggccctcgcagggacacttttctcagaagcaaggttgggagaaagcactgtgcatgcatagctccagcctctgtggtcccccttctggagccagctgggctgcagcgagggcacattctggaccatttgctgccaggaggtgaacagcccgcctgctgagcctggcctggtgagtgtacaggctaacacagggttgaagggttagcagcccccttggccacaggcctggcctttgatctccatccatctacctcctacctctctctccctccactggttcccaacttgggcacccccaaaccccagcactcacacaatcttcctgctctttgccacctctgggatcctgtgcctgccttcttctgggccctgctttgggggatagatctgtcttccctcatgtgattgagggcctcaagggcaagtgttcctttttcactccagcactcattttgcagttggggaaattgaggtcaggagaggtaatgcactttgcccaaggtcactcagcttgtaagtgatggaacagagattctaatctagtttgcctgactcagtctgagctctctgtgagtgatgccaggcttatggtccaagtgctgggtggcagtcctaacagaagctctgagctcagaagacattagctccttaggcgaaggacagaccaagggacactggagcccaggttgcgggatggctttggccgtatctgtaatcctcctgggcctcagtattcctcatctgcaaatttaaagagtaactgttgctctgtttggcccaagaagattcaaagtgggagcctttgagcttggaaactgcaacatgcaattaaaaatataagacatgatgagtggaagcagagtcctttgccctggatgtgtctcattttgtctttgagcctcaatgtcctgccctgtgagctgggatcaatgatgctgacctacagggtcactgtgagcaagggtctgaggttggttgtgggctgacctggaccatgtctgcacctgcctatgaaccagattgcaaccagctcagaaaatctcctgggagaggacattttcagctcacccggaacttgtcacctgtccagtttgttgccctcagcagcagttccagggcagcctctagtacgggaactgaggtgctcacggagatggtggaggtggtcagggaaggaagtggtcactccgtgcacctctgcccaccccccactccctgccccgccatgaccagcatgcccaggtctgtaggataaggatgatgttaatggtcaggtacagctgcggagcagctacacctccacctgcaacgctggcagcccacgctctgaccacatgttactcctcagaagccgggggcccatccgtcccagcctggggtccccaagtaagcagaaggcgcatgcctcctgagtcctcagcaccgggctttgtcccaaggtgatggagaaggcccccgcctaggcttcaggagccctgcgttctcttggctgcactctgccctgctggatggcctcaggcaaatccttccccatgtgtcaagtggggacacttctcagtcccctccacagcgctgttgggagcgcccaggaggcagagtaagtaggtggctgcaggaggcatcagaccacagaaggggaagccaagatggttccctggttcaggagctcattgtcagaggagggaaggagaaaggagacggccccaaaagacagggagtggggaagagaaagcctgtgccctgcccaacgccagacccctgccacgaggattcgctcagaaatcctcaccatctcccttcgccgtctcttccctccttccccaccctcagctcccccatcccatggccttcctcatctccatgcctggatagttggtcagagacactgggggtggtgggggaagatgccacagaagcaggcaagggacaggagctgctgagatgtcccttcaggtttcatggaagctcagaactggaagcgccaactgccacaatttggagatgaggcaatcgagacccagagagaggaaggaatgtgtccaagggcccccagtgtgtccatggctgactagggcatagaccttgggtctccccgctttcattccccactgcagccctcaggggctccctggaggcctcaccttccagagcccacagatggtgcttcaccagctccaccacctcctgcttgtcctcggagagcacgattccaaagccggccagcaggtaggagacatccgtggtgacccctgccctcaccttctggatagtgggtaccacgcccaccagcagcagcagggccacctggaagagccccacagtgagggccccatcccaggaaagggttttctgtgctaacaggggagacgctggggaagaaactggcagcacacaggccccagccacatgcccattgcccatcagtgttcttatctgccccttagagcagggatctcacgcctctaaatgaggacattacagacaggtgcaatcacagcctaataggccaaaggcatgccttcgagcaccgtaacttcatatagtcagccctgcgtatctgtgggttccacatccacaaccaaccaattcaatcaagcgcagatcaaaaatatttggggaaaaaccctcaataaaaaataacaattcaatacaaataatacaaataaaaaataatacagtaggacaacttcttcttttttttttttttttgagatggagtcttgctctgtggccaggctggagtgcagtggcgcgatctcggctcactgcaacctccacctcccaggttcaagcaattctcctgcctcagcctcctgagtagctgggactacaggcccgcgccaccaccgccagctaatttttatatttttagtagagacagggtttcactacattggctgggatggtctcaatctcttgacattgtgatccgcccgcctcagcctcccaaagtgctgggattacaggtgtgagccaccacacccagacataggacaactgtttacatagcacttatgttcgatattataagtactttagagataacgaggtatactggagaatgtgtgtaggctatatgcaaatactacaccatcgtatatcagaaatttgagcctttggattttggtatggaggggtgttcctggaaccaacccacctcagatactgagggatgactgtgtctgcacctctatctatttacccatcatctatctatctaaactttggaatgtaaaatttctggtttttctatgttgtgaaagtaaatgagcacaggaattaaagctggacagacttggattcaaacttaggctacgctgagatattagctgtgcagaaacttggccaagtcaaattcacctctccaagcttccattctccccatctgtaaagtggagaataatcatacccatctcccaggattttaattgttgttgttggttttttcggggttttttttttttcggaggtggtgaggcagagtttatcaaacatgttgtcttgctaaatcttcccaattactcaaagaggaaaattattctattttctcctttttacagatgagctaacaggttcagagaggttatataacttgcccaaggccacacaggaggtaaatagtggagctaggatttaaattcgtgtttatgtggcctccaaaattaatgctccgagtcacttcatgagtccaagagtgaacaccccggcccttctgggtaggccagaactcccaagatggcctgcagcacctggtcagggttctggatggagcacctggagagctgggttgggccggaactgctccaggcttgggggttgagggcagggctccagaggcagatggcagtacagggtgagggacatacctggtaaatggccgtccctgtcagtgtagctgaaagcaccagcttcagcgggagatggaatcctgtagtcctcaaaggaaggagtatggtgaacagcaccactcaggcccgggagccctcctccctcccaaggggcccaggaaaagggccagcaggaccctaaatgaccaaggccaggccagggtcttcccgctgtcccaagctggtagttgtccctcttgatgacaaggattctggggagcaggagccagtcctccactgcagccattctgtgcaagggagggtaacgtcccctgtcacgctcggcctcagctcccaaccccatacctggctgtggagtgtagatgcagtgtctcaagcagacgcgggcccaggacaggaagccatgcttggaggtgtggtagctgcagaaagacccaggcaggtgcggggtcctcaggggaagcccattccctgagggccagccccagaggctggtcattcttcccctctgcccctgccatgctgcccagtgccagcttcccaagcacggctgctaaccagcccaatccattggcccacaaagggtgtgtcagagaccccacctgcttcccagcttcttcctgcaaaggaggttcctcagatattcctcagagtagctgctctgcagcccctgtggagacagacaattgaacaagcagatgagatctgcctcgacccattcgtgggtccctggctcagggaactagagtgttcaccaagcaggtgctccataaaaacctgttggccatggcggtggtggtgagtgtggatggggctgacctgtggggatgaggtccgtgccctccaaagcttcccttttctctctcacaaatacaaggccagtctcctatcaaagaaccatcaatgccaggaagttcttcctaagatctgtctccaactctcgcctgctttactcagtcacatctcttcaccgtttcttcccacccctagccctctggcctctgctagctgaaactggggcaaagggaagcttgtgtcccacgggcacatcctagaccaggacacagaagagggtcattccaggtcagacaccctcaggcttctcctgctgccactgcgcaagggagatcacaagggtgaccagatttgtctaagccacattccaggccttaagctgcctgtgaagtagcagaggcccatgggaagatggggtgagcccctgcctggaatcactgggagaacacaggctgttgtcacttgttgccatgacaaccctgggatcccgggcaggagtgggtcagctcaaagcttgatgggggtcctttgagacttaaacctctttgaccaaagtccaaagaggattgtacacctctcaagcctgggaggaaaggctggcaatggagagagagatggggtggtggaaaccctggaagagaaggtaaaggggcatgcctcaggcactgtgtcgtcccggggggccgctcccttttcagagccagctgtaaacaggaggggacacaggcttcctcgaggggtgttggcctcaataggcaggagctacaagcgctcagaactccctgcctgccacgtgggagccgagtctggagtccgtgggccttctcggaccagagtagcccaaaagggacccggggttctccatcctgcctagggatctcactcactctctggattcagtctgaccttgccgagttaacacccggtcccagcccctctgctgagctccagactttgagcagtacaccctcaggaccaagcatcatcccaggagcacctgctcctccctccaccttccctgggccagcagctggcaccaccacctacctgctggctggccaggtgcctcccatcaagcctttccttcccctgccctgtctgaagagaagccacgccctttggcctctatgtcttaagactttctcctgagtctgttcttctttcccctttgagggtctctgcagagctttcttcctcctcctctctcaccagaaagaagtagtggaccccgccccctgcaccacagtcccaacacccggtgcaggtttcacattgcactgcaggtgttttgtgccgcatctgtctcccccaccacactgggagctcctggagatcagacacaagtccatcagctccaagtccacagcactgagcccggggcctgacatatggtaggtgcttagaaggctttttagtgagattgaagtatcttctaagaattctcttttaccatgatgcattcatccatccatccttccttccatacatctttccttcgatccatccatccattcatccatctattcaaaaattcaaaaatatttgctgagtatctattaagggccaagacccacccagtgctgcaaatataatgaacaaaacagacacaaaactatctcttcccctttactcatgctctttcccgtgcctacaatgcctgctccttattctctcatcactctagatctccctgtccttcaggcccttgtagagtctacctcctctaggaagccctctcagccctcccctttatctgaaattattcaaccacatccaacctagagttgactcataatggagttctgccctgggtgcttcctgaatcatctcattatgtgcagaactcggattaggcacaaggctccaggctgtctctccagccagatctcagtgtttcacagacagagatatgactctcctggcttctgactcagttctgctttgttaagtccctactattcacacagcccagtgccgcgggtatcctgggtgccagtcaagggcccagtccagcttttgcctagggagggaggactaagcagtcactcagcaaacattttctgagcatctattctgtgctgggccctacatcaagcacggccatgtatctgggaccacagatacgggggagtagggctgtcttgggtgctgaggaagagctcatcccaggcctgcccctttaccttggagcctgctcctgtcctacggctgaagcttctcaccagctgcacagggtaccaaaggctcaggaatccgaggcccagcaggagaggcagggaggccagcagggagtagtacttgtagatctggacagacaaacacccagacagactactttccaccttcttcccccagccaagaaccagaatccgttgcccttcccacctcacactgggccctgagggtggtctggggggccatgggaaggcttcagctctatggttcccaacctgccacccagcgcaaacctgcccacttccccttctcgagccctgcagagatgctcacccctcccccaggctcctggatccccacgggcctgagaggagccaagaggaggagatcacttgattccctcctgccccccactggaaaggacacctctttctgtttctgtgttcccggagcattaggaacagttctgaaaatcacacgaaagcctgcctttgcctacatatagttttcaacctgagcatcaggaaagtctatgccctactcctcagggctgaggccttcctgggggtgggctttttgtatactcattcatttatttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatacaccataatccttgacaaagcccccctcctgggggaggaggccccagcaccattggcggcctgagccctgcaagggtgtggccaggagccacccccacccccgcacctgacttcacacacatacctgccttcagcgcctgccccagagctcccaagcccctgcccgccacatctgcagtgccgcacacagacaggagaccagcattacagcaacaaccgagtgagacggaccgctggggctgggctggggcggaggcagggaaggggaatctgtccgtttcttctcctagggtttccatgaaggaggcaacatgtgtctcattggtaaaccctttttgttcctacaagttgatttcacaaggagataactcacccccacaaggcggaaattagctctttaaacacaaaccagacccacgggtaggcaagaggagccccgcctgcctcctgctcctcctggagtgaggttgagggtgagcaagggaaggtctgggccagggaggagggctcctccgcattctccctccccaggagcaggaccctgccccagcctggaggaaggggcgagaggcagaagaaggtagaaagcagttctcaggccactgtccctggtggaggtttaggcccctaaaactgtgagggtctctgtccttccaataccctacaaggggcttcggcttggaccctgtcagctaaggcagtcattcaacagcttttttaagaagacattattcatttagtcttttaacttaaatttattgaacacacactatgtgccagcactgttctgagccctgaggcaggagagatgacagttcagcggggacacagccagataactaaatcccctccaaagtctgagggttacaaagggaatcacaggttgagctggtctgtaccatgggaaaccaaatttagtccaagagcatttggggatggggggagattcctgaagaaaagaacctttccgtggtgatctgaagggcaggggaaagtccgctgagcagagggtggcaggctcaggatggggatgggggtgggggaaagtgtgttccccacagaggaaacagcacgggtgaagtctcagagtagacagggcttgaaatcctggaggctctctttcaaattcccaagcctgcagggcaggattaggggctgagcaccctgctagcctgagttcctcccccttcttcccaaatggcccttcttgcaggaagagggctctgttgctctccaccatcccacagagatatcagcatctgctgactcagagctgaacccgagctttatttgatgtaatgaggagcccacactggcccttctgatcccagggatgcgggaaacttgccttccaggcgcgagtgtgagctcccggagggcgggactctatccctcccacccctcctcctgccttcccctgatgctcagcgcctggcccttgggtaagagggacttcagaaattgagcttggcaaagccattgcttgttctggcggccagtattcatttgtgggcctgtcctatacaggcggctgctgtgccctgaggttcaccagctgggcttcccagagtccccgtgcccacaccagaggccagcaagcccttccctgctcaggggtctcagactgttaccttagggagcagccaactcccatctgattttaaatccacctccaaccattggagtccagttccagacagggagcccactccctctacaaggcagcagtgtcaggggttagacatccttgcctatcagaaaccatgccctttggccaggtgtggtggcttacacttgtaatcctagcactttgggaggccgaggcaggtggatcacctgaggtcaggagttagagacccagcctggccaacaaggcaaaatcccatctctactaaaaatacaaaaaattagccggacgtggtggcgcacacctgtaatcccagctactagggaggctgaggcaggagaatcgcttgaacccagggggcagaggttgcagtgagccaagatcgtgccactgcactccagcctggacaaaagaggcaaactccatctcaaaaaaaaagaaagaaagaaagaaaagaaaccatcctcttccttggaggaagcctaactctgccttccccaggctggtttggcagcgagcaagatgagtcaaggcctgcaccaaatggaacctgatgtatggtagggcttaggggagacaacaccagaggggaagtgaagtgggggaagagaagagagacgggagttggctgtttgagacaaggtggtcagggaaggcctcactgagaaggtggtgtgttgctgataccagaggggagagagggaggtaccagttgggcactgtgttcatctgtttcgcattgctgtgaaggaaaacctgactctgggtaacttagaaggaaagggggtttatgtggctcacagttctgcaggctgtgcaggaagcagcacggcaccagcatcagcttctggggagggcctcaggaaacccacaatcgtgatggaaggtgaaggggggtcaggcaggacacttggcaagagagggagcaggagagatgccaggcacttacaaatagccagctctcacatgaactgatagagcgagaactcactcattaccacagggagggcaccaagccattcaggagggataccccgcaatgacccaaacaccacacaccaggcctcacttccaacactggggtcacatttcaacatgagatttggagggcacacacatccaaaccatatcgggcactgaagaaaggcaatcaggttgcctgaaggagcctccatctgcccaggggctgcagccaggctggcagaaagggaccccagctgagcccaggcacagtcccttccccaccccccacggagagcccagtgccaacaataccacctccctcctcatgggaagacacagaggccaccaagggaggccctaagcagaggggaggaaatggtgagcttcgtccttttcccctggtgggggcctagcaagcagagcgcagccttgtgcctggtactttggccagggcatagctggaaggtccagaggtaagggccaggtttctgcatggcagtggagaacgcctggttggggaggccacctagccggatttgaaccctgggactggctatgtggccttgagtgagtcttttcctctctgtgggtctcactgtcctctctcaaatccggcctggagattctccagttgtgaactctccccacaaggcccccgtccctgcacaccagtaaccagttgtaacaagaaggtcacagagagtggttgtgacttcctaggtgcccccattgcctcccacctgccccctcctggcccccagctgccctgcccagtctggtgcgggcagggtgggcaggctgggttgaagatccatggatagcgggtggccgcgtggctcaagctgcaaggtgagcccacttcttgagcccaaggtacctcctcagcttggggctagaatcgcttggagctcccatctgcaaaatgggaggctcggctctgagctgttaagaaagatgctacctgggaagacggcaggaggcaagaagtgttaggaagagaaggatggtaatgatgtgcccctgaagaatttctccaaaggcctgggcagcagagtcaagggcctgccctctggagctggctttaaaggggcactgatacccaggaaggcccagccctgccctcaggagagcaaaagtgctcaaaagacagaactgccaaagcctgaggagcggggagggaaaggaggagatggcttgggcagtcttgcaggctccctggaggagggggcctggagcagggccctgaagccatggaagatctggaatggtaacaagaatgaattgacacgtgtctcaggagtgccaagaagggaagtctgagagacaaggagagagtagcataagggtcagggcagggctccctcgctgtgaccagcatgaacccacgtgggcactcagatgaggctgatgccagtatccaaggagcagctcaaaccagcaggtctcccaactgggcacagattggcgggtggctaagccctgctcactatgggaggaggtcctaaaaagcttctggactctgagccagtgaaggccatctgccatttgggcttggcacagagctgctatgcccctcgggttggagctggcccatgaaggccttgggacagggcttccttcctctcatgtttttgttcaagttgattaaacctgaggaatttttgcatccaggagcagaggcccacgtgcatttctgcgggagcctgtgattatcaaatcctcaaagggcaaagtgccaagcttagaagaagctaacagcaggccagaaggaatggggaaggccagcagcatccccagaacctcagaaacatcccctcaaggactcccagatctcccagagaacctccagaatctcagcaacatttctgagtttcagtaatgccataagaagccctgcaacctcagtattgcccccaagaagccccagaccttcagtaacacatcagaaccactgcaacacctcaggacactcaaactctggcaaactcaaactctggcaaatcaaccacagattggaacaagatgttcaaaagcctgtgaccatttgcagaaaggccagagacccccgttgctctccaccctcccatctcagcccttgactctgagtccagcagcaaacccaatagtttacaatactcaaacctcaggtacacccccaacttcgatagcacggaagagaacacgcaagagaggcgttccaggagtggggggatggccactgtgcccacctgtgcagcccagtccccttgagagtccatgaataagcagccgagagagtcaacctcatgcgggcccgtgagcttggggtgtgccctcagtggcacagcacactcacacacacatccaactgcccttcgcacacatacgtgcttaattctggcaccagaccaagtctgactccacacagtgggctggaaggcagtgtcgtcggctgccgtgctcacggcaggaagagtatgggtgactctccacctcctgtctctctacctcctacctcccctgccatgtgggagggtcagaagcaccatctgatgtgcccttcctgcaattctcatgcccccctcaccaacagcatcatcataacat

SEQ ID NO: 2590 - DNA, 29565 bp, Homo sapiens
tttctcaggaacaagtttattgcagggaacacactaacctctttcataatagccaaaggcataaaaactacaaaaatatctggctctcgagtgtgggcagctcagtgtgggacctggtctgagtcatgacttgggctgccctgcaggccagaggcccgggagctttccggccactccccagagaggtccgtggcgctgagggggtgaggaagtgccttggctgcttccacagcgtgaaggccaaggctgaggtggagctgggctggagtggttccagagaaggcttcatcgaggcccttcaaggctgatggcagagccagggtagggagacgcctggatgtggctgccctggctcaactggctcctggaccaaggccctaacccaccagtttctttctccagaacccctgctggctctcccatagccaagtgggtggagcagagccctcctgaggctcccagtgcagacagacctccacccaaccacagtgatccggaggacctgctggctgcatggctggtgtgatgctgggaggagagccggggagggaggaggatggtaggcaggaacatgcctcagcacagatgggcaggtgggttgaccttccctgccctcagggctgggcaccattggcacccaacagggccgtcttgcggaagacctgcagggttgggttgtgcagcagcgtgtaggccagaccccagcgagccctgccgcggctggccccgggcctagctcccttggccatggagtcctttgtctgtagcagctgcatccctgagagagacggactttctgtgagtcactcagcaaacacccagccaaccctccctggccctcagacctgatcagagagcctgaaaatcccaggcgtgtgcaggtcgtgaggcttaggatgtcccctgcaggcagcacatggaagtggggggtgaggtctgtggatggactggaagctgggtgggacaagggtctggagctggcttagtgtcccctccctacacacacttctgggcagaaggaaaggaggagtcatactccctgccccaagggagaagcgggggcagtgacggagccccttaggaaggcagctgtttcattctctctgtgtgcacacatatggtgtgtgtatgtgtgtgttcatatcatggaaaaaatcaccctgagatcagaccaggaggggtgaccaaaggcagccaaggaagagaggaagtgagaattttcctggcgctcactctgtgtgctggggaggggcacacatccttcctagaagaagctgggtaggctctattcccccattcccagtgggagggcgcaccttcgtcttcctcccctggtctgaggctgtcctggggggctgccatggtcctgggtaggaggctctgcgcttgcaggagcagggagcagaaggctgtcatggctggatgcgactggctgacttcaatcttcaagaagtttcggtacgtgtagtagcctggggtggggtggcggatggcaatgctgggggagcaggggccacactggaggcatccagacatcccctaacacacacacagggagtgcacgtgcactccctgcatccaagcatgtcgacacaccaagcacgtggcacattggctgcatgggcacgtgtggacctgctagaacaccccacatccactgcacgtgctgcagggccacaggaggcacagcgcaggggcacacaggtggcacatgcagctacaggcatcggtgtgaactgatcagctggcacggccctggggcagggcagatgccttcctcactgcttgggtagcctgagcaatcctccagccccgcccagtgaccttaccggggtcgagagtggcggctctcggtggcagcaggctgaggtccatctggccaaggtggatggcgttgtagagggcagagaggagcactcgccaggtggccaccatggcacccaccagcacattgagggggaagagaagaaaggtggctgcatagagcactcgcctaggatgggagaagaaagctgaggcaggccgttccccagagctccctccccagggtcagtgtcagacctggatgcccagaactgctgtgtatttactgagtgcctaccatttattgctatgtcttctgtgcaccccaccctgggcaaggccttctctctttcaacccaccatgctgggagatgggaaactgaggcccagagagattgggagacttagccaaggctgtcagctattcagtggcagagctgggctttaactctaggtccatctgagtctttctatgaccctgatgcctcccacctcccttttctgggtcccctgtctgctaattccaagttcccctgggagccaaggttctcccacagacttgtcatctgacagggaactcccttgctacaaagtggggaggggcatggttttaaggaaacagaggatccaggggagagcagtaccgattcccaaagcaagaaaggttcacgggggtacttccagccccatgccgggtatgtagagaggtactttggagtgggctgagccattgtcccttttctctatgggtaaggcaagctctttctactatcatctgggttccttgatagagagaagggatagatggcagtggagggaggacacaaaaagagagagacaccgaagaagaggcgagggcctgagggagccacaagcccagatgccacctcaccggttggtcagctgtgggtgtccatcatgagtctccaggaagacccaatgggctgccatgttctgcaggatcacagccagggccaaagtcagccagaagggcctgccagtggggtggggaggtggtcgctgttagcggacctctaaggagtccctgagccctccatgtcttgtttcactcaccacgaggactccagggaacggaagagcaggaggttcctgccatggagcacaggcatgagcaccaggaaggccagggccgtggttcccaggaagaagatgatctgctgcaccaggagccctgccaggggcgggagtggcagggggacagaaaacaggttccatgaaaactggccatccccgctgcccccagaaccaagggctttgggattgggcaggcctggttttagatctctgctctgccactgcctagctatgctgccttgaacaaatcactttacttcattgagcctcagtttcttcctctgtaaaatggggataatagtccctacctcagaggctgttgtaaggatccaatgagataatgtctgtggaaactcttaaaatcacaaaatactttgcaaatgttatttccctccagtttctcctgagtttgagttactgggggataaggctacatattaaactgatgtttgcattccttcaagccagagcctggcatacggtaggtgcccaaggactgtctattgaaataatctggccaactgattagagaatgatgtctacaaaagggcctggaggcataagggctaccaagaagagacgctatgacttttgtcctagtaattcatctactcctttaccatccttctcctcccgcaaggaggtgagaatggaaggaactggagggagagatacaaggcccttggatgtgcaacccaggccacagcccctcaccattcagagtgcttttctcactgcagtacccaaggggagagtcagaaacttggggctggtaggggtcctggaaggttatctggtccaactctctcagggcaggaccccctttgcagactgcaacaatatccatggaactctgcttgcatacccccagtgacagggatctcattacctttgtaggtagccaaatgtgacacagccctttcttaagctggagcgcagtggtgcaatctcggctcactgcaacctccacctcctgggttcaagcgattctcctgcctcatcctcccgaatagctggaactgcaggtgcacaccaccatacccggctaatttttgtatttttagtagagacggggtctcaccatgttggccaggctggtcttcatctcctgacttcgtgatccacctgcctcagcctcccaaagtgctgggattacaggtgtgagccactgagcccagccaggaatgtaccattttgaatttgacacctccagacctgggtccacccccatgtgaatacttggtggcacccagggttcatctccatgtggagggtacacactcaatttcccgagggctcctgtacccccatcctgaataagcttcttaagggcagggaaggcaggggggtccctccttcttgctgctgccccagagcattcccagacaaactctgagggcagtacttgctgagcactcttctccccaactgaggccagtgtctgaggggaggcccaggccaaggctgggtgtggcgggcaagggaggctcaccaaggcagataaaggctgtctggtaggcactgaagctcatccaacagaatatggcttggcgggagggatggggactccgatgcaagggactcaagtccagggcagctcctcggtgcagagctcgaaggttggtcctggggtgggagccagggaggcagagacctcagggagcaacacactcttcctaaatcctcctctgggccagcaactggccaaactcccaatagaatttcaactcacagccatcagcagggaagcccagaactgtgggagccaggaggaggccactaacccaagatatctggaagaggtgatatctgggtagtcttaaacagtgaacgaggaatacaaaacgaggcagaaggctcaacctgagccaagtcagaaaagtgagaaacaacagtgagaatggaagtgacacacagcacagccaacaggtaaagaggcaaggcaagcacaggctgaggagccttgaatgccagaagaaggaggggtgacctgtggaaaaagatccctgggaagagctctgagacctggcaagtgcgcaggagacatgggccagttctctgacatgggtaagtgctcgggctgccccttccacctgccctgggccttcagtgctcctcaccactcaccgctgcagggcaagcaaggtggcatggcgagacccgtaccacctctccagtgtgctatgccaccaggctacccctcacctacactctcacatggcagggccaccccagcctctgttctcgtccacacagtcctcacctcctatctccttccattcccgggcaggtgcagcttccccaggccaccttccctctcatccagcccacccggtggcccctactcagggggcaagctccactagctgccctgagttggtggtgccctatgtccctcacactcacagacgtttccccaaccagacaggaaggcccaagggcaggacccagccccaccttctcccactgcagcgcagccacgcacaggtgggctccatgacagcccgggccggcagagcccttccctccctccaggcccagggcctccccgcaggcccacaggactcccactccttccccacctcggcgctgggtgagccagagtctgtcactcacctgtgtgtcaccagtgagcgcatcaggaccaggaaggtgagtaagcaggacaagaccaaggctgagatgtagcacactggtgggcagagaatgagcaaagtgagaggtcagggtctggagagtctcctggaggcctcagaacccctgccagggtggtgccttgtggggagttccccctgccccaaactgaactctgtgtggaagcctcttggccccacccccaggtctcagatgcagtgtaagccaatgacttcggccaccccattcttcccagtgacatacagtggtcaagagatgaaaccagctctgagtctgcagacctagtcctcaccctgctgttgctgcttctattgctgtgggacctccatccaacctggcatctgcctccagcttcactgcttcttggccatgtggccttcaggagggcactccttctccccaggcccccatttgctcgtgaacataccgcacgccgttatgctgcccagctctcaggataatgtgagccataaggccccatccacgtctgcactaatggtcttcgttcagggcatagagggtgtgagtccacatcggtgtggactgagtccatcagaatagggaggcagccgctgtcacccagctccctcaccctctccctggccatgcacacaatgagtgtgtgcatgatggtgtgtcatgaacaagcctgggtgtttaagaatttcaggggtgcaggctgcaactctcccaccttacgtccacatccagtcttgctctggactgtaacagcaaccccgcaaggttagacagaagaactgttcccactgggctgaagaggaagctgaggctcagagagagggcttcgcccagacagccatgctgctaggaatgatagagtgaggtgtgtaaccatttctaagcagatccagaatgagcctgagatgcctgcaccctgatctcatcagtcagtccagggaagtgttcctggtgcccgtgtcaccaccagaatctcaaggacggggagagcaaacacagaaaaggtgagtgctagttccacatagccacagggattagagtggtggatctcagcaccgatagcgcctttaggatcacctggagctgctaaaactcgcccatagcccagcctgcacccaaaccagttaaatcagaatttctgtgggtgggacccagccttagcctgtgaaagcaacactggtgattcagtgtgcagtcaggactgacagccactgctctgggggctttccaaaggcagagccttcatgatttatttccatcagaaatgaattgaaatcaaccaaccaaccaatatttattgggtgcctactacagtggtgatcaaactttgcttgcatgagaatcactgggactgtgatcccaacactttggaaggctgaggcggtggatcacctggggtcagaagttcgagaccagcctgaccaatatggtgaaactccgtctctactaaaaatacaaaaattagccaggcctggtggcgggcccctgtaatcccagctactcgggaggctgagatgggagaatcacttgaacctgagagacggaggttgcagtgagccgagattgtgccacggcactccaccctgggagacagaatgagactccgtctcaaaacaaaacaaaattagccgggcctggtggtatgtgcctgtaatcccagctactcgggaggctgaaatgggagaattgcttgaacccaggaggtggaggttgcagtgagccgagattgcaccactgcactccagcctgggcgacagagcacaactccatctcaaaagaaaaaaaaaatcactgggagggctgttcactcaaagaggctgggccccactctgagagtttctgattcagtaggtctggcacagggcttgagcaacgggaatgttaaagccaccaggtgcttcccagattcagccagggctaaaaatgatgctacagaaacctaggcccttctgctggtccctagctccctcctccagggccctcgcagggacacttttctcagaagcaaggttgggagaaagcactgtgcatgcatagctccagcctctgtggtcccccttctggagccagctgggctgcagcgagggcacattctggaccatttgctgccaggaggtgaacagcccgcctgctgagcctggcctggtgagtgtacaggctaacacagggttgaagggttagcagcccccttggccacaggcctggcctttgatctccatccatctacctcctacctctctctccctccactggttcccaacttgggcacccccaaaccccagcactcacacaatcttcctgctctttgccacctctgggatcctgtgcctgccttcttctgggccctgctttgggggatagatctgtcttccctcatgtgattgagggcctcaagggcaagtgttcctttttcactccagcactcattttgcagttggggaaattgaggtcaggagaggtaatgcactttgcccaaggtcactcagcttgtaagtgatggaacagagattctaatctagtttgcctgactcagtctgagctctctgtgagtgatgccaggcttatggtccaagtgctgggtggcagtcctaacagaagctctgagctcagaagacattagctccttaggcgaaggacagaccaagggacactggagcccaggttgcgggatggctttggccgtatctgtaatcctcctgggcctcagtattcctcatctgcaaatttaaagagtaactgttgctctgtttggcccaagaagattcaaagtgggagcctttgagcttggaaactgcaacatgcaattaaaaatataagacatgatgagtggaagcagagtcctttgccctggatgtgtctcattttgtctttgagcctcaatgtcctgccctgtgagctgggatcaatgatgctgacctacagggtcactgtgagcaagggtctgaggttggttgtgggctgacctggaccatgtctgcacctgcctatgaaccagattgcaaccagctcagaaaatctcctgggagaggacattttcagctcacccggaacttgtcacctgtccagtttgttgccctcagcagcagttccagggcagcctctagtacgggaactgaggtgctcacggagatggtggaggtggtcagggaaggaagtggtcactccgtgcacctctgcccaccccccactccctgccccgccatgaccagcatgcccaggtctgtaggataaggatgatgttaatggtcaggtacagctgcggagcagctacacctccacctgcaacgctggcagcccacgctctgaccacatgttactcctcagaagccgggggcccatccgtcccagcctggggtccccaagtaagcagaaggcgcatgcctcctgagtcctcagcaccgggctttgtcccaaggtgatggagaaggcccccgcctaggcttcaggagccctgcgttctcttggctgcactctgccctgctggatggcctcaggcaaatccttccccatgtgtcaagtggggacacttctcagtcccctccacagcgctgttgggagcgcccaggaggcagagtaagtaggtggctgcaggaggcatcagaccacagaaggggaagccaagatggttccctggttcaggagctcattgtcagaggagggaaggagaaaggagacggccccaaaagacagggagtggggaagagaaagcctgtgccctgcccaacgccagacccctgccacgaggattcgctcagaaatcctcaccatctcccttcgccgtctcttccctccttccccaccctcagctcccccatcccatggccttcctcatctccatgcctggatagttggtcagagacactgggggtggtgggggaagatgccacagaagcaggcaagggacaggagctgctgagatgtcccttcaggtttcatggaagctcagaactggaagcgccaactgccacaatttggagatgaggcaatcgagacccagagagaggaaggaatgtgtccaagggcccccagtgtgtccatggctgactagggcatagaccttgggtctccccgctttcattccccactgcagccctcaggggctccctggaggcctcaccttccagagcccacagatggtgcttcaccagctccaccacctcctgcttgtcctcggagagcacgattccaaagccggccagcaggtaggagacatccgtggtgacccctgccctcaccttctggatagtgggtaccacgcccaccagcagcagcagggccacctggaagagccccacagtgagggccccatcccaggaaagggttttctgtgctaacaggggagacgctggggaagaaactggcagcacacaggccccagccacatgcccattgcccatcagtgttcttatctgccccttagagcagggatctcacgcctctaaatgaggacattacagacaggtgcaatcacagcctaataggccaaaggcatgccttcgagcaccgtaacttcatatagtcagccctgcgtatctgtgggttccacatccacaaccaaccaattcaatcaagcgcagatcaaaaatatttggggaaaaaccctcaataaaaaataacaattcaatacaaataatacaaataaaaaataatacagtaggacaacttcttcttttttttttttttttgagatggagtcttgctctgtggccaggctggagtgcagtggcgcgatctcggctcactgcaacctccacctcccaggttcaagcaattctcctgcctcagcctcctgagtagctgggactacaggcccgcgccaccaccgccagctaatttttatatttttagtagagacagggtttcactacattggctgggatggtctcaatctcttgacattgtgatccgcccgcctcagcctcccaaagtgctgggattacaggtgtgagccaccacacccagacataggacaactgtttacatagcacttatgttcgatattataagtactttagagataacgaggtatactggagaatgtgtgtaggctatatgcaaatactacaccatcgtatatcagaaatttgagcctttggattttggtatggaggggtgttcctggaaccaacccacctcagatactgagggatgactgtgtctgcacctctatctatttacccatcatctatctatctaaactttggaatgtaaaatttctggtttttctatgttgtgaaagtaaatgagcacaggaattaaagctggacagacttggattcaaacttaggctacgctgagatattagctgtgcagaaacttggccaagtcaaattcacctctccaagcttccattctccccatctgtaaagtggagaataatcatacccatctcccaggattttaattgttgttgttggttttttcggggttttttttttttcggaggtggtgaggcagagtttatcaaacatgttgtcttgctaaatcttcccaattactcaaagaggaaaattattctattttctcctttttacagatgagctaacaggttcagagaggttatataacttgcccaaggccacacaggaggtaaatagtggagctaggatttaaattcgtgtttatgtggcctccaaaattaatgctccgagtcacttcatgagtccaagagtgaacaccccggcccttctgggtaggccagaactcccaagatggcctgcagcacctggtcagggttctggatggagcacctggagagctgggttgggccggaactgctccaggcttgggggttgagggcagggctccagaggcagatggcagtacagggtgagggacatacctggtaaatggccgtccctgtcagtgtagctgaaagcaccagcttcagcgggagatggaatcctgtagtcctcaaaggaaggagtatggtgaacagcaccactcaggcccgggagccctcctccctcccaaggggcccaggaaaagggccagcaggaccctaaatgaccaaggccaggccagggtcttcccgctgtcccaagctggtagttgtccctcttgatgacaaggattctggggagcaggagccagtcctccactgcagccattctgtgcaagggagggtaacgtcccctgtcacgctcggcctcagctcccaaccccatacctggctgtggagtgtagatgcagtgtctcaagcagacgcgggcccaggacaggaagccatgcttggaggtgtggtagctgcagaaagacccaggcaggtgcggggtcctcaggggaagcccattccctgagggccagccccagaggctggtcattcttcccctctgcccctgccatgctgcccagtgccagcttcccaagcacggctgctaaccagcccaatccattggcccacaaagggtgtgtcagagaccccacctgcttcccagcttcttcctgcaaaggaggttcctcagatattcctcagagtagctgctctgcagcccctgtggagacagacaattgaacaagcagatgagatctgcctcgacccattcgtgggtccctggctcagggaactagagtgttcaccaagcaggtgctccataaaaacctgttggccatggcggtggtggtgagtgtggatggggctgacctgtggggatgaggtccgtgccctccaaagcttcccttttctctctcacaaatacaaggccagtctcctatcaaagaaccatcaatgccaggaagttcttcctaagatctgtctccaactctcgcctgctttactcagtcacatctcttcaccgtttcttcccacccctagccctctggcctctgctagctgaaactggggcaaagggaagcttgtgtcccacgggcacatcctagaccaggacacagaagagggtcattccaggtcagacaccctcaggcttctcctgctgccactgcgcaagggagatcacaagggtgaccagatttgtctaagccacattccaggccttaagctgcctgtgaagtagcagaggcccatgggaagatggggtgagcccctgcctggaatcactgggagaacacaggctgttgtcacttgttgccatgacaaccctgggatcccgggcaggagtgggtcagctcaaagcttgatgggggtcctttgagacttaaacctctttgaccaaagtccaaagaggattgtacacctctcaagcctgggaggaaaggctggcaatggagagagagatggggtggtggaaaccctggaagagaaggtaaaggggcatgcctcaggcactgtgtcgtcccggggggccgctcccttttcagagccagctgtaaacaggaggggacacaggcttcctcgaggggtgttggcctcaataggcaggagctacaagcgctcagaactccctgcctgccacgtgggagccgagtctggagtccgtgggccttctcggaccagagtagcccaaaagggacccggggttctccatcctgcctagggatctcactcactctctggattcagtctgaccttgccgagttaacacccggtcccagcccctctgctgagctccagactttgagcagtacaccctcaggaccaagcatcatcccaggagcacctgctcctccctccaccttccctgggccagcagctggcaccaccacctacctgctggctggccaggtgcctcccatcaagcctttccttcccctgccctgtctgaagagaagccacgccctttggcctctatgtcttaagactttctcctgagtctgttcttctttcccctttgagggtctctgcagagctttcttcctcctcctctctcaccagaaagaagtagtggaccccgccccctgcaccacagtcccaacacccggtgcaggtttcacattgcactgcaggtgttttgtgccgcatctgtctcccccaccacactgggagctcctggagatcagacacaagtccatcagctccaagtccacagcactgagcccggggcctgacatatggtaggtgcttagaaggctttttagtgagattgaagtatcttctaagaattctcttttaccatgatgcattcatccatccatccttccttccatacatctttccttcgatccatccatccattcatccatctattcaaaaattcaaaaatatttgctgagtatctattaagggccaagacccacccagtgctgcaaatataatgaacaaaacagacacaaaactatctcttcccctttactcatgctctttcccgtgcctacaatgcctgctccttattctctcatcactctagatctccctgtccttcaggcccttgtagagtctacctcctctaggaagccctctcagccctcccctttatctgaaattattcaaccacatccaacctagagttgactcataatggagttctgccctgggtgcttcctgaatcatctcattatgtgcagaactcggattaggcacaaggctccaggctgtctctccagccagatctcagtgtttcacagacagagatatgactctcctggcttctgactcagttctgctttgttaagtccctactattcacacagcccagtgccgcgggtatcctgggtgccagtcaagggcccagtccagcttttgcctagggagggaggactaagcagtcactcagcaaacattttctgagcatctattctgtgctgggccctacatcaagcacggccatgtatctgggaccacagatacgggggagtagggctgtcttgggtgctgaggaagagctcatcccaggcctgcccctttaccttggagcctgctcctgtcctacggctgaagcttctcaccagctgcacagggtaccaaaggctcaggaatccgaggcccagcaggagaggcagggaggccagcagggagtagtacttgtagatctggacagacaaacacccagacagactactttccaccttcttcccccagccaagaaccagaatccgttgcccttcccacctcacactgggccctgagggtggtctggggggccatgggaaggcttcagctctatggttcccaacctgccacccagcgcaaacctgcccacttccccttctcgagccctgcagagatgctcacccctcccccaggctcctggatccccacgggcctgagaggagccaagaggaggagatcacttgattccctcctgccccccactggaaaggacacctctttctgtttctgtgttcccggagcattaggaacagttctgaaaatcacacgaaagcctgcctttgcctacatatagttttcaacctgagcatcaggaaagtctatgccctactcctcagggctgaggccttcctgggggtgggctttttgtatactcattcatttatttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatacaccataatccttgacaaagcccccctcctgggggaggaggccccagcaccattggcggcctgagccctgcaagggtgtggccaggagccacccccacccccgcacctgacttcacacacatacctgccttcagcgcctgccccagagctcccaagcccctgcccgccacatctgcagtgccgcacacagacaggagaccagcattacagcaacaaccgagtgagacggaccgctggggctgggctggggcggaggcagggaaggggaatctgtccgtttcttctcctagggtttccatgaaggaggcaacatgtgtctcattggtaaaccctttttgttcctacaagttgatttcacaaggagataactcacccccacaaggcggaaattagctctttaaacacaaaccagacccacgggtaggcaagaggagccccgcctgcctcctgctcctcctggagtgaggttgagggtgagcaagggaaggtctgggccagggaggagggctcctccgcattctccctccccaggagcaggaccctgccccagcctggaggaaggggcgagaggcagaagaaggtagaaagcagttctcaggccactgtccctggtggaggtttaggcccctaaaactgtgagggtctctgtccttccaataccctacaaggggcttcggcttggaccctgtcagctaaggcagtcattcaacagcttttttaagaagacattattcatttagtcttttaacttaaatttattgaacacacactatgtgccagcactgttctgagccctgaggcaggagagatgacagttcagcggggacacagccagataactaaatcccctccaaagtctgagggttacaaagggaatcacaggttgagctggtctgtaccatgggaaaccaaatttagtccaagagcatttggggatggggggagattcctgaagaaaagaacctttccgtggtgatctgaagggcaggggaaagtccgctgagcagagggtggcaggctcaggatggggatgggggtgggggaaagtgtgttccccacagaggaaacagcacgggtgaagtctcagagtagacagggcttgaaatcctggaggctctctttcaaattcccaagcctgcagggcaggattaggggctgagcaccctgctagcctgagttcctcccccttcttcccaaatggcccttcttgcaggaagagggctctgttgctctccaccatcccacagagatatcagcatctgctgactcagagctgaacccgagctttatttgatgtaatgaggagcccacactggcccttctgatcccagggatgcgggaaacttgccttccaggcgcgagtgtgagctcccggagggcgggactctatccctcccacccctcctcctgccttcccctgatgctcagcgcctggcccttgggtaagagggacttcagaaattgagcttggcaaagccattgcttgttctggcggccagtattcatttgtgggcctgtcctatacaggcggctgctgtgccctgaggttcaccagctgggcttcccagagtccccgtgcccacaccagaggccagcaagcccttccctgctcaggggtctcagactgttaccttagggagcagccaactcccatctgattttaaatccacctccaaccattggagtccagttccagacagggagcccactccctctacaaggcagcagtgtcaggggttagacatccttgcctatcagaaaccatgccctttggccaggtgtggtggcttacacttgtaatcctagcactttgggaggccgaggcaggtggatcacctgaggtcaggagttagagacccagcctggccaacaaggcaaaatcccatctctactaaaaatacaaaaaattagccggacgtggtggcgcacacctgtaatcccagctactagggaggctgaggcaggagaatcgcttgaacccagggggcagaggttgcagtgagccaagatcgtgccactgcactccagcctggacaaaagaggcaaactccatctcaaaaaaaaagaaagaaagaaagaaaagaaaccatcctcttccttggaggaagcctaactctgccttccccaggctggtttggcagcgagcaagatgagtcaaggcctgcaccaaatggaacctgatgtatggtagggcttaggggagacaacaccagaggggaagtgaagtgggggaagagaagagagacgggagttggctgtttgagacaaggtggtcagggaaggcctcactgagaaggtggtgtgttgctgataccagaggggagagagggaggtaccagttgggcactgtgttcatctgtttcgcattgctgtgaaggaaaacctgactctgggtaacttagaaggaaagggggtttatgtggctcacagttctgcaggctgtgcaggaagcagcacggcaccagcatcagcttctggggagggcctcaggaaacccacaatcgtgatggaaggtgaaggggggtcaggcaggacacttggcaagagagggagcaggagagatgccaggcacttacaaatagccagctctcacatgaactgatagagcgagaactcactcattaccacagggagggcaccaagccattcaggagggataccccgcaatgacccaaacaccacacaccaggcctcacttccaacactggggtcacatttcaacatgagatttggagggcacacacatccaaaccatatcgggcactgaagaaaggcaatcaggttgcctgaaggagcctccatctgcccaggggctgcagccaggctggcagaaagggaccccagctgagcccaggcacagtcccttccccaccccccacggagagcccagtgccaacaataccacctccctcctcatgggaagacacagaggccaccaagggaggccctaagcagaggggaggaaatggtgagcttcgtccttttcccctggtgggggcctagcaagcagagcgcagccttgtgcctggtactttggccagggcatagctggaaggtccagaggtaagggccaggtttctgcatggcagtggagaacgcctggttggggaggccacctagccggatttgaaccctgggactggctatgtggccttgagtgagtcttttcctctctgtgggtctcactgtcctctctcaaatccggcctggagattctccagttgtgaactctccccacaaggcccccgtccctgcacaccagtaaccagttgtaacaagaaggtcacagagagtggttgtgacttcctaggtgcccccattgcctcccacctgccccctcctggcccccagctgccctgcccagtctggtgcgggcagggtgggcaggctgggttgaagatccatggatagcgggtggccgcgtggctcaagctgcaaggtgagcccacttcttgagcccaaggtacctcctcagcttggggctagaatcgcttggagctcccatctgcaaaatgggaggctcggctctgagctgttaagaaagatgctacctgggaagacggcaggaggcaagaagtgttaggaagagaaggatggtaatgatgtgcccctgaagaatttctccaaaggcctgggcagcagagtcaagggcctgccctctggagctggctttaaaggggcactgatacccaggaaggcccagccctgccctcaggagagcaaaagtgctcaaaagacagaactgccaaagcctgaggagcggggagggaaaggaggagatggcttgggcagtcttgcaggctccctggaggagggggcctggagcagggccctgaagccatggaagatctggaatggtaacaagaatgaattgacacgtgtctcaggagtgccaagaagggaagtctgagagacaaggagagagtagcataagggtcagggcagggctccctcgctgtgaccagcatgaacccacgtgggcactcagatgaggctgatgccagtatccaaggagcagctcaaaccagcaggtctcccaactgggcacagattggcgggtggctaagccctgctcactatgggaggaggtcctaaaaagcttctggactctgagccagtgaaggccatctgccatttgggcttggcacagagctgctatgcccctcgggttggagctggcccatgaaggccttgggacagggcttccttcctctcatgtttttgttcaagttgattaaacctgaggaatttttgcatccaggagcagaggcccacgtgcatttctgcgggagcctgtgattatcaaatcctcaaagggcaaagtgccaagcttagaagaagctaacagcaggccagaaggaatggggaaggccagcagcatccccagaacctcagaaacatcccctcaaggactcccagatctcccagagaacctccagaatctcagcaacatttctgagtttcagtaatgccataagaagccctgcaacctcagtattgcccccaagaagccccagaccttcagtaacacatcagaaccactgcaacacctcaggacactcaaactctggcaaactcaaactctggcaaatcaaccacagattggaacaagatgttcaaaagcctgtgaccatttgcagaaaggccagagacccccgttgctctccaccctcccatctcagcccttgactctgagtccagcagcaaacccaatagtttacaatactcaaacctcaggtacacccccaacttcgatagcacggaagagaacacgcaagagaggcgttccaggagtggggggatggccactgtgcccacctgtgcagcccagtccccttgagagtccatgaataagcagccgagagagtcaacctcatgcgggcccgtgagcttggggtgtgccctcagtggcacagcacactcacacacacatccaactgcccttcgcacacatacgtgcttaattctggcaccagaccaagtctgactccacacagtgggctggaaggcagtgtcgtcggctgccgtgctcacggcaggaagagtatgggtgactctccacctcctgtctctctacctcctacctcccctgccatgtgggagggtcagaagcaccatctgatgtgcccttcctgcaattctcatgcccccctcaccaacagcatcatcataacataaaggatttagaccaggctgttctggtatgagggtggacactggtgaggaggaggagggtagccggctgtgccaggggagcagcatgttctttccctcccagagggctaggctagtactgacctggaggagggaggcagatttcagctcagaacaaaggtagccttctagagtagtgaggcccccatcaagggaggcaatcaagaagaggctgttaacatcaagatgcaacagagggcttcctgccttcggaggactagacacaaggccatgaagattccccagctataagagccccacgttctccgttcccagcacgttcctccctgggctggccaccgtggtgtggccttgagatgtaggctttgtgctgccctccttcctcactgaggacattgactgctgggcagatcccctgacttctctctccttgttcccttgctgaccacaggacagggctctccaccaaccttttgcccacagccagtcagatccaactcagacaggactctgcgaatgtctcctgccttttggagctcctgctagccccccagtgtcccctgagggcagcccaccccaggtctccaaacttactcatcagaattgctccagcccatcactctgctcacttcctgcccctaggctctgactcctgctcacttcccaccgcacaccccatgtgccttctcgctgttccccgacctgttccaatcccacctggcctcccagacttggctccagcctacctccaatcaagcgctctcctgacctctcccttccttgtctctttcctttcctttattgatctctcccggaaacttgtccctccaggcaagcagggtgctcccaacacggggccttctcctctgagcccagcaccagctgggctgggatcctagaggggtggctggttgtgtggtctcggcagttggccctgagaagtgtccccagcacctgctttaaaaggtgtttgatct

SEQ ID NO: 2591 - DNA, 30240 bp, Homo sapiens
tttctcaggaacaagtttattgcagggaacacactaacctctttcataatagccaaaggcataaaaactacaaaaatatctggctctcgagtgtgggcagctcagtgtgggacctggtctgagtcatgacttgggctgccctgcaggccagaggcccgggagctttccggccactccccagagaggtccgtggcgctgagggggtgaggaagtgccttggctgcttccacagcgtgaaggccaaggctgaggtggagctgggctggagtggttccagagaaggcttcatcgaggcccttcaaggctgatggcagagccagggtagggagacgcctggatgtggctgccctggctcaactggctcctggaccaaggccctaacccaccagtttctttctccagaacccctgctggctctcccatagccaagtgggtggagcagagccctcctgaggctcccagtgcagacagacctccacccaaccacagtgatccggaggacctgctggctgcatggctggtgtgatgctgggaggagagccggggagggaggaggatggtaggcaggaacatgcctcagcacagatgggcaggtgggttgaccttccctgccctcagggctgggcaccattggcacccaacagggccgtcttgcggaagacctgcagggttgggttgtgcagcagcgtgtaggccagaccccagcgagccctgccgcggctggccccgggcctagctcccttggccatggagtcctttgtctgtagcagctgcatccctgagagagacggactttctgtgagtcactcagcaaacacccagccaaccctccctggccctcagacctgatcagagagcctgaaaatcccaggcgtgtgcaggtcgtgaggcttaggatgtcccctgcaggcagcacatggaagtggggggtgaggtctgtggatggactggaagctgggtgggacaagggtctggagctggcttagtgtcccctccctacacacacttctgggcagaaggaaaggaggagtcatactccctgccccaagggagaagcgggggcagtgacggagccccttaggaaggcagctgtttcattctctctgtgtgcacacatatggtgtgtgtatgtgtgtgttcatatcatggaaaaaatcaccctgagatcagaccaggaggggtgaccaaaggcagccaaggaagagaggaagtgagaattttcctggcgctcactctgtgtgctggggaggggcacacatccttcctagaagaagctgggtaggctctattcccccattcccagtgggagggcgcaccttcgtcttcctcccctggtctgaggctgtcctggggggctgccatggtcctgggtaggaggctctgcgcttgcaggagcagggagcagaaggctgtcatggctggatgcgactggctgacttcaatcttcaagaagtttcggtacgtgtagtagcctggggtggggtggcggatggcaatgctgggggagcaggggccacactggaggcatccagacatcccctaacacacacacagggagtgcacgtgcactccctgcatccaagcatgtcgacacaccaagcacgtggcacattggctgcatgggcacgtgtggacctgctagaacaccccacatccactgcacgtgctgcagggccacaggaggcacagcgcaggggcacacaggtggcacatgcagctacaggcatcggtgtgaactgatcagctggcacggccctggggcagggcagatgccttcctcactgcttgggtagcctgagcaatcctccagccccgcccagtgaccttaccggggtcgagagtggcggctctcggtggcagcaggctgaggtccatctggccaaggtggatggcgttgtagagggcagagaggagcactcgccaggtggccaccatggcacccaccagcacattgagggggaagagaagaaaggtggctgcatagagcactcgcctaggatgggagaagaaagctgaggcaggccgttccccagagctccctccccagggtcagtgtcagacctggatgcccagaactgctgtgtatttactgagtgcctaccatttattgctatgtcttctgtgcaccccaccctgggcaaggccttctctctttcaacccaccatgctgggagatgggaaactgaggcccagagagattgggagacttagccaaggctgtcagctattcagtggcagagctgggctttaactctaggtccatctgagtctttctatgaccctgatgcctcccacctcccttttctgggtcccctgtctgctaattccaagttcccctgggagccaaggttctcccacagacttgtcatctgacagggaactcccttgctacaaagtggggaggggcatggttttaaggaaacagaggatccaggggagagcagtaccgattcccaaagcaagaaaggttcacgggggtacttccagccccatgccgggtatgtagagaggtactttggagtgggctgagccattgtcccttttctctatgggtaaggcaagctctttctactatcatctgggttccttgatagagagaagggatagatggcagtggagggaggacacaaaaagagagagacaccgaagaagaggcgagggcctgagggagccacaagcccagatgccacctcaccggttggtcagctgtgggtgtccatcatgagtctccaggaagacccaatgggctgccatgttctgcaggatcacagccagggccaaagtcagccagaagggcctgccagtggggtggggaggtggtcgctgttagcggacctctaaggagtccctgagccctccatgtcttgtttcactcaccacgaggactccagggaacggaagagcaggaggttcctgccatggagcacaggcatgagcaccaggaaggccagggccgtggttcccaggaagaagatgatctgctgcaccaggagccctgccaggggcgggagtggcagggggacagaaaacaggttccatgaaaactggccatccccgctgcccccagaaccaagggctttgggattgggcaggcctggttttagatctctgctctgccactgcctagctatgctgccttgaacaaatcactttacttcattgagcctcagtttcttcctctgtaaaatggggataatagtccctacctcagaggctgttgtaaggatccaatgagataatgtctgtggaaactcttaaaatcacaaaatactttgcaaatgttatttccctccagtttctcctgagtttgagttactgggggataaggctacatattaaactgatgtttgcattccttcaagccagagcctggcatacggtaggtgcccaaggactgtctattgaaataatctggccaactgattagagaatgatgtctacaaaagggcctggaggcataagggctaccaagaagagacgctatgacttttgtcctagtaattcatctactcctttaccatccttctcctcccgcaaggaggtgagaatggaaggaactggagggagagatacaaggcccttggatgtgcaacccaggccacagcccctcaccattcagagtgcttttctcactgcagtacccaaggggagagtcagaaacttggggctggtaggggtcctggaaggttatctggtccaactctctcagggcaggaccccctttgcagactgcaacaatatccatggaactctgcttgcatacccccagtgacagggatctcattacctttgtaggtagccaaatgtgacacagccctttcttaagctggagcgcagtggtgcaatctcggctcactgcaacctccacctcctgggttcaagcgattctcctgcctcatcctcccgaatagctggaactgcaggtgcacaccaccatacccggctaatttttgtatttttagtagagacggggtctcaccatgttggccaggctggtcttcatctcctgacttcgtgatccacctgcctcagcctcccaaagtgctgggattacaggtgtgagccactgagcccagccaggaatgtaccattttgaatttgacacctccagacctgggtccacccccatgtgaatacttggtggcacccagggttcatctccatgtggagggtacacactcaatttcccgagggctcctgtacccccatcctgaataagcttcttaagggcagggaaggcaggggggtccctccttcttgctgctgccccagagcattcccagacaaactctgagggcagtacttgctgagcactcttctccccaactgaggccagtgtctgaggggaggcccaggccaaggctgggtgtggcgggcaagggaggctcaccaaggcagataaaggctgtctggtaggcactgaagctcatccaacagaatatggcttggcgggagggatggggactccgatgcaagggactcaagtccagggcagctcctcggtgcagagctcgaaggttggtcctggggtgggagccagggaggcagagacctcagggagcaacacactcttcctaaatcctcctctgggccagcaactggccaaactcccaatagaatttcaactcacagccatcagcagggaagcccagaactgtgggagccaggaggaggccactaacccaagatatctggaagaggtgatatctgggtagtcttaaacagtgaacgaggaatacaaaacgaggcagaaggctcaacctgagccaagtcagaaaagtgagaaacaacagtgagaatggaagtgacacacagcacagccaacaggtaaagaggcaaggcaagcacaggctgaggagccttgaatgccagaagaaggaggggtgacctgtggaaaaagatccctgggaagagctctgagacctggcaagtgcgcaggagacatgggccagttctctgacatgggtaagtgctcgggctgccccttccacctgccctgggccttcagtgctcctcaccactcaccgctgcagggcaagcaaggtggcatggcgagacccgtaccacctctccagtgtgctatgccaccaggctacccctcacctacactctcacatggcagggccaccccagcctctgttctcgtccacacagtcctcacctcctatctccttccattcccgggcaggtgcagcttccccaggccaccttccctctcatccagcccacccggtggcccctactcagggggcaagctccactagctgccctgagttggtggtgccctatgtccctcacactcacagacgtttccccaaccagacaggaaggcccaagggcaggacccagccccaccttctcccactgcagcgcagccacgcacaggtgggctccatgacagcccgggccggcagagcccttccctccctccaggcccagggcctccccgcaggcccacaggactcccactccttccccacctcggcgctgggtgagccagagtctgtcactcacctgtgtgtcaccagtgagcgcatcaggaccaggaaggtgagtaagcaggacaagaccaaggctgagatgtagcacactggtgggcagagaatgagcaaagtgagaggtcagggtctggagagtctcctggaggcctcagaacccctgccagggtggtgccttgtggggagttccccctgccccaaactgaactctgtgtggaagcctcttggccccacccccaggtctcagatgcagtgtaagccaatgacttcggccaccccattcttcccagtgacatacagtggtcaagagatgaaaccagctctgagtctgcagacctagtcctcaccctgctgttgctgcttctattgctgtgggacctccatccaacctggcatctgcctccagcttcactgcttcttggccatgtggccttcaggagggcactccttctccccaggcccccatttgctcgtgaacataccgcacgccgttatgctgcccagctctcaggataatgtgagccataaggccccatccacgtctgcactaatggtcttcgttcagggcatagagggtgtgagtccacatcggtgtggactgagtccatcagaatagggaggcagccgctgtcacccagctccctcaccctctccctggccatgcacacaatgagtgtgtgcatgatggtgtgtcatgaacaagcctgggtgtttaagaatttcaggggtgcaggctgcaactctcccaccttacgtccacatccagtcttgctctggactgtaacagcaaccccgcaaggttagacagaagaactgttcccactgggctgaagaggaagctgaggctcagagagagggcttcgcccagacagccatgctgctaggaatgatagagtgaggtgtgtaaccatttctaagcagatccagaatgagcctgagatgcctgcaccctgatctcatcagtcagtccagggaagtgttcctggtgcccgtgtcaccaccagaatctcaaggacggggagagcaaacacagaaaaggtgagtgctagttccacatagccacagggattagagtggtggatctcagcaccgatagcgcctttaggatcacctggagctgctaaaactcgcccatagcccagcctgcacccaaaccagttaaatcagaatttctgtgggtgggacccagccttagcctgtgaaagcaacactggtgattcagtgtgcagtcaggactgacagccactgctctgggggctttccaaaggcagagccttcatgatttatttccatcagaaatgaattgaaatcaaccaaccaaccaatatttattgggtgcctactacagtggtgatcaaactttgcttgcatgagaatcactgggactgtgatcccaacactttggaaggctgaggcggtggatcacctggggtcagaagttcgagaccagcctgaccaatatggtgaaactccgtctctactaaaaatacaaaaattagccaggcctggtggcgggcccctgtaatcccagctactcgggaggctgagatgggagaatcacttgaacctgagagacggaggttgcagtgagccgagattgtgccacggcactccaccctgggagacagaatgagactccgtctcaaaacaaaacaaaattagccgggcctggtggtatgtgcctgtaatcccagctactcgggaggctgaaatgggagaattgcttgaacccaggaggtggaggttgcagtgagccgagattgcaccactgcactccagcctgggcgacagagcacaactccatctcaaaagaaaaaaaaaatcactgggagggctgttcactcaaagaggctgggccccactctgagagtttctgattcagtaggtctggcacagggcttgagcaacgggaatgttaaagccaccaggtgcttcccagattcagccagggctaaaaatgatgctacagaaacctaggcccttctgctggtccctagctccctcctccagggccctcgcagggacacttttctcagaagcaaggttgggagaaagcactgtgcatgcatagctccagcctctgtggtcccccttctggagccagctgggctgcagcgagggcacattctggaccatttgctgccaggaggtgaacagcccgcctgctgagcctggcctggtgagtgtacaggctaacacagggttgaagggttagcagcccccttggccacaggcctggcctttgatctccatccatctacctcctacctctctctccctccactggttcccaacttgggcacccccaaaccccagcactcacacaatcttcctgctctttgccacctctgggatcctgtgcctgccttcttctgggccctgctttgggggatagatctgtcttccctcatgtgattgagggcctcaagggcaagtgttcctttttcactccagcactcattttgcagttggggaaattgaggtcaggagaggtaatgcactttgcccaaggtcactcagcttgtaagtgatggaacagagattctaatctagtttgcctgactcagtctgagctctctgtgagtgatgccaggcttatggtccaagtgctgggtggcagtcctaacagaagctctgagctcagaagacattagctccttaggcgaaggacagaccaagggacactggagcccaggttgcgggatggctttggccgtatctgtaatcctcctgggcctcagtattcctcatctgcaaatttaaagagtaactgttgctctgtttggcccaagaagattcaaagtgggagcctttgagcttggaaactgcaacatgcaattaaaaatataagacatgatgagtggaagcagagtcctttgccctggatgtgtctcattttgtctttgagcctcaatgtcctgccctgtgagctgggatcaatgatgctgacctacagggtcactgtgagcaagggtctgaggttggttgtgggctgacctggaccatgtctgcacctgcctatgaaccagattgcaaccagctcagaaaatctcctgggagaggacattttcagctcacccggaacttgtcacctgtccagtttgttgccctcagcagcagttccagggcagcctctagtacgggaactgaggtgctcacggagatggtggaggtggtcagggaaggaagtggtcactccgtgcacctctgcccaccccccactccctgccccgccatgaccagcatgcccaggtctgtaggataaggatgatgttaatggtcaggtacagctgcggagcagctacacctccacctgcaacgctggcagcccacgctctgaccacatgttactcctcagaagccgggggcccatccgtcccagcctggggtccccaagtaagcagaaggcgcatgcctcctgagtcctcagcaccgggctttgtcccaaggtgatggagaaggcccccgcctaggcttcaggagccctgcgttctcttggctgcactctgccctgctggatggcctcaggcaaatccttccccatgtgtcaagtggggacacttctcagtcccctccacagcgctgttgggagcgcccaggaggcagagtaagtaggtggctgcaggaggcatcagaccacagaaggggaagccaagatggttccctggttcaggagctcattgtcagaggagggaaggagaaaggagacggccccaaaagacagggagtggggaagagaaagcctgtgccctgcccaacgccagacccctgccacgaggattcgctcagaaatcctcaccatctcccttcgccgtctcttccctccttccccaccctcagctcccccatcccatggccttcctcatctccatgcctggatagttggtcagagacactgggggtggtgggggaagatgccacagaagcaggcaagggacaggagctgctgagatgtcccttcaggtttcatggaagctcagaactggaagcgccaactgccacaatttggagatgaggcaatcgagacccagagagaggaaggaatgtgtccaagggcccccagtgtgtccatggctgactagggcatagaccttgggtctccccgctttcattccccactgcagccctcaggggctccctggaggcctcaccttccagagcccacagatggtgcttcaccagctccaccacctcctgcttgtcctcggagagcacgattccaaagccggccagcaggtaggagacatccgtggtgacccctgccctcaccttctggatagtgggtaccacgcccaccagcagcagcagggccacctggaagagccccacagtgagggccccatcccaggaaagggttttctgtgctaacaggggagacgctggggaagaaactggcagcacacaggccccagccacatgcccattgcccatcagtgttcttatctgccccttagagcagggatctcacgcctctaaatgaggacattacagacaggtgcaatcacagcctaataggccaaaggcatgccttcgagcaccgtaacttcatatagtcagccctgcgtatctgtgggttccacatccacaaccaaccaattcaatcaagcgcagatcaaaaatatttggggaaaaaccctcaataaaaaataacaattcaatacaaataatacaaataaaaaataatacagtaggacaacttcttcttttttttttttttttgagatggagtcttgctctgtggccaggctggagtgcagtggcgcgatctcggctcactgcaacctccacctcccaggttcaagcaattctcctgcctcagcctcctgagtagctgggactacaggcccgcgccaccaccgccagctaatttttatatttttagtagagacagggtttcactacattggctgggatggtctcaatctcttgacattgtgatccgcccgcctcagcctcccaaagtgctgggattacaggtgtgagccaccacacccagacataggacaactgtttacatagcacttatgttcgatattataagtactttagagataacgaggtatactggagaatgtgtgtaggctatatgcaaatactacaccatcgtatatcagaaatttgagcctttggattttggtatggaggggtgttcctggaaccaacccacctcagatactgagggatgactgtgtctgcacctctatctatttacccatcatctatctatctaaactttggaatgtaaaatttctggtttttctatgttgtgaaagtaaatgagcacaggaattaaagctggacagacttggattcaaacttaggctacgctgagatattagctgtgcagaaacttggccaagtcaaattcacctctccaagcttccattctccccatctgtaaagtggagaataatcatacccatctcccaggattttaattgttgttgttggttttttcggggttttttttttttcggaggtggtgaggcagagtttatcaaacatgttgtcttgctaaatcttcccaattactcaaagaggaaaattattctattttctcctttttacagatgagctaacaggttcagagaggttatataacttgcccaaggccacacaggaggtaaatagtggagctaggatttaaattcgtgtttatgtggcctccaaaattaatgctccgagtcacttcatgagtccaagagtgaacaccccggcccttctgggtaggccagaactcccaagatggcctgcagcacctggtcagggttctggatggagcacctggagagctgggttgggccggaactgctccaggcttgggggttgagggcagggctccagaggcagatggcagtacagggtgagggacatacctggtaaatggccgtccctgtcagtgtagctgaaagcaccagcttcagcgggagatggaatcctgtagtcctcaaaggaaggagtatggtgaacagcaccactcaggcccgggagccctcctccctcccaaggggcccaggaaaagggccagcaggaccctaaatgaccaaggccaggccagggtcttcccgctgtcccaagctggtagttgtccctcttgatgacaaggattctggggagcaggagccagtcctccactgcagccattctgtgcaagggagggtaacgtcccctgtcacgctcggcctcagctcccaaccccatacctggctgtggagtgtagatgcagtgtctcaagcagacgcgggcccaggacaggaagccatgcttggaggtgtggtagctgcagaaagacccaggcaggtgcggggtcctcaggggaagcccattccctgagggccagccccagaggctggtcattcttcccctctgcccctgccatgctgcccagtgccagcttcccaagcacggctgctaaccagcccaatccattggcccacaaagggtgtgtcagagaccccacctgcttcccagcttcttcctgcaaaggaggttcctcagatattcctcagagtagctgctctgcagcccctgtggagacagacaattgaacaagcagatgagatctgcctcgacccattcgtgggtccctggctcagggaactagagtgttcaccaagcaggtgctccataaaaacctgttggccatggcggtggtggtgagtgtggatggggctgacctgtggggatgaggtccgtgccctccaaagcttcccttttctctctcacaaatacaaggccagtctcctatcaaagaaccatcaatgccaggaagttcttcctaagatctgtctccaactctcgcctgctttactcagtcacatctcttcaccgtttcttcccacccctagccctctggcctctgctagctgaaactggggcaaagggaagcttgtgtcccacgggcacatcctagaccaggacacagaagagggtcattccaggtcagacaccctcaggcttctcctgctgccactgcgcaagggagatcacaagggtgaccagatttgtctaagccacattccaggccttaagctgcctgtgaagtagcagaggcccatgggaagatggggtgagcccctgcctggaatcactgggagaacacaggctgttgtcacttgttgccatgacaaccctgggatcccgggcaggagtgggtcagctcaaagcttgatgggggtcctttgagacttaaacctctttgaccaaagtccaaagaggattgtacacctctcaagcctgggaggaaaggctggcaatggagagagagatggggtggtggaaaccctggaagagaaggtaaaggggcatgcctcaggcactgtgtcgtcccggggggccgctcccttttcagagccagctgtaaacaggaggggacacaggcttcctcgaggggtgttggcctcaataggcaggagctacaagcgctcagaactccctgcctgccacgtgggagccgagtctggagtccgtgggccttctcggaccagagtagcccaaaagggacccggggttctccatcctgcctagggatctcactcactctctggattcagtctgaccttgccgagttaacacccggtcccagcccctctgctgagctccagactttgagcagtacaccctcaggaccaagcatcatcccaggagcacctgctcctccctccaccttccctgggccagcagctggcaccaccacctacctgctggctggccaggtgcctcccatcaagcctttccttcccctgccctgtctgaagagaagccacgccctttggcctctatgtcttaagactttctcctgagtctgttcttctttcccctttgagggtctctgcagagctttcttcctcctcctctctcaccagaaagaagtagtggaccccgccccctgcaccacagtcccaacacccggtgcaggtttcacattgcactgcaggtgttttgtgccgcatctgtctcccccaccacactgggagctcctggagatcagacacaagtccatcagctccaagtccacagcactgagcccggggcctgacatatggtaggtgcttagaaggctttttagtgagattgaagtatcttctaagaattctcttttaccatgatgcattcatccatccatccttccttccatacatctttccttcgatccatccatccattcatccatctattcaaaaattcaaaaatatttgctgagtatctattaagggccaagacccacccagtgctgcaaatataatgaacaaaacagacacaaaactatctcttcccctttactcatgctctttcccgtgcctacaatgcctgctccttattctctcatcactctagatctccctgtccttcaggcccttgtagagtctacctcctctaggaagccctctcagccctcccctttatctgaaattattcaaccacatccaacctagagttgactcataatggagttctgccctgggtgcttcctgaatcatctcattatgtgcagaactcggattaggcacaaggctccaggctgtctctccagccagatctcagtgtttcacagacagagatatgactctcctggcttctgactcagttctgctttgttaagtccctactattcacacagcccagtgccgcgggtatcctgggtgccagtcaagggcccagtccagcttttgcctagggagggaggactaagcagtcactcagcaaacattttctgagcatctattctgtgctgggccctacatcaagcacggccatgtatctgggaccacagatacgggggagtagggctgtcttgggtgctgaggaagagctcatcccaggcctgcccctttaccttggagcctgctcctgtcctacggctgaagcttctcaccagctgcacagggtaccaaaggctcaggaatccgaggcccagcaggagaggcagggaggccagcagggagtagtacttgtagatctggacagacaaacacccagacagactactttccaccttcttcccccagccaagaaccagaatccgttgcccttcccacctcacactgggccctgagggtggtctggggggccatgggaaggcttcagctctatggttcccaacctgccacccagcgcaaacctgcccacttccccttctcgagccctgcagagatgctcacccctcccccaggctcctggatccccacgggcctgagaggagccaagaggaggagatcacttgattccctcctgccccccactggaaaggacacctctttctgtttctgtgttcccggagcattaggaacagttctgaaaatcacacgaaagcctgcctttgcctacatatagttttcaacctgagcatcaggaaagtctatgccctactcctcagggctgaggccttcctgggggtgggctttttgtatactcattcatttatttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatacaccataatccttgacaaagcccccctcctgggggaggaggccccagcaccattggcggcctgagccctgcaagggtgtggccaggagccacccccacccccgcacctgacttcacacacatacctgccttcagcgcctgccccagagctcccaagcccctgcccgccacatctgcagtgccgcacacagacaggagaccagcattacagcaacaaccgagtgagacggaccgctggggctgggctggggcggaggcagggaaggggaatctgtccgtttcttctcctagggtttccatgaaggaggcaacatgtgtctcattggtaaaccctttttgttcctacaagttgatttcacaaggagataactcacccccacaaggcggaaattagctctttaaacacaaaccagacccacgggtaggcaagaggagccccgcctgcctcctgctcctcctggagtgaggttgagggtgagcaagggaaggtctgggccagggaggagggctcctccgcattctccctccccaggagcaggaccctgccccagcctggaggaaggggcgagaggcagaagaaggtagaaagcagttctcaggccactgtccctggtggaggtttaggcccctaaaactgtgagggtctctgtccttccaataccctacaaggggcttcggcttggaccctgtcagctaaggcagtcattcaacagcttttttaagaagacattattcatttagtcttttaacttaaatttattgaacacacactatgtgccagcactgttctgagccctgaggcaggagagatgacagttcagcggggacacagccagataactaaatcccctccaaagtctgagggttacaaagggaatcacaggttgagctggtctgtaccatgggaaaccaaatttagtccaagagcatttggggatggggggagattcctgaagaaaagaacctttccgtggtgatctgaagggcaggggaaagtccgctgagcagagggtggcaggctcaggatggggatgggggtgggggaaagtgtgttccccacagaggaaacagcacgggtgaagtctcagagtagacagggcttgaaatcctggaggctctctttcaaattcccaagcctgcagggcaggattaggggctgagcaccctgctagcctgagttcctcccccttcttcccaaatggcccttcttgcaggaagagggctctgttgctctccaccatcccacagagatatcagcatctgctgactcagagctgaacccgagctttatttgatgtaatgaggagcccacactggcccttctgatcccagggatgcgggaaacttgccttccaggcgcgagtgtgagctcccggagggcgggactctatccctcccacccctcctcctgccttcccctgatgctcagcgcctggcccttgggtaagagggacttcagaaattgagcttggcaaagccattgcttgttctggcggccagtattcatttgtgggcctgtcctatacaggcggctgctgtgccctgaggttcaccagctgggcttcccagagtccccgtgcccacaccagaggccagcaagcccttccctgctcaggggtctcagactgttaccttagggagcagccaactcccatctgattttaaatccacctccaaccattggagtccagttccagacagggagcccactccctctacaaggcagcagtgtcaggggttagacatccttgcctatcagaaaccatgccctttggccaggtgtggtggcttacacttgtaatcctagcactttgggaggccgaggcaggtggatcacctgaggtcaggagttagagacccagcctggccaacaaggcaaaatcccatctctactaaaaatacaaaaaattagccggacgtggtggcgcacacctgtaatcccagctactagggaggctgaggcaggagaatcgcttgaacccagggggcagaggttgcagtgagccaagatcgtgccactgcactccagcctggacaaaagaggcaaactccatctcaaaaaaaaagaaagaaagaaagaaaagaaaccatcctcttccttggaggaagcctaactctgccttccccaggctggtttggcagcgagcaagatgagtcaaggcctgcaccaaatggaacctgatgtatggtagggcttaggggagacaacaccagaggggaagtgaagtgggggaagagaagagagacgggagttggctgtttgagacaaggtggtcagggaaggcctcactgagaaggtggtgtgttgctgataccagaggggagagagggaggtaccagttgggcactgtgttcatctgtttcgcattgctgtgaaggaaaacctgactctgggtaacttagaaggaaagggggtttatgtggctcacagttctgcaggctgtgcaggaagcagcacggcaccagcatcagcttctggggagggcctcaggaaacccacaatcgtgatggaaggtgaaggggggtcaggcaggacacttggcaagagagggagcaggagagatgccaggcacttacaaatagccagctctcacatgaactgatagagcgagaactcactcattaccacagggagggcaccaagccattcaggagggataccccgcaatgacccaaacaccacacaccaggcctcacttccaacactggggtcacatttcaacatgagatttggagggcacacacatccaaaccatatcgggcactgaagaaaggcaatcaggttgcctgaaggagcctccatctgcccaggggctgcagccaggctggcagaaagggaccccagctgagcccaggcacagtcccttccccaccccccacggagagcccagtgccaacaataccacctccctcctcatgggaagacacagaggccaccaagggaggccctaagcagaggggaggaaatggtgagcttcgtccttttcccctggtgggggcctagcaagcagagcgcagccttgtgcctggtactttggccagggcatagctggaaggtccagaggtaagggccaggtttctgcatggcagtggagaacgcctggttggggaggccacctagccggatttgaaccctgggactggctatgtggccttgagtgagtcttttcctctctgtgggtctcactgtcctctctcaaatccggcctggagattctccagttgtgaactctccccacaaggcccccgtccctgcacaccagtaaccagttgtaacaagaaggtcacagagagtggttgtgacttcctaggtgcccccattgcctcccacctgccccctcctggcccccagctgccctgcccagtctggtgcgggcagggtgggcaggctgggttgaagatccatggatagcgggtggccgcgtggctcaagctgcaaggtgagcccacttcttgagcccaaggtacctcctcagcttggggctagaatcgcttggagctcccatctgcaaaatgggaggctcggctctgagctgttaagaaagatgctacctgggaagacggcaggaggcaagaagtgttaggaagagaaggatggtaatgatgtgcccctgaagaatttctccaaaggcctgggcagcagagtcaagggcctgccctctggagctggctttaaaggggcactgatacccaggaaggcccagccctgccctcaggagagcaaaagtgctcaaaagacagaactgccaaagcctgaggagcggggagggaaaggaggagatggcttgggcagtcttgcaggctccctggaggagggggcctggagcagggccctgaagccatggaagatctggaatggtaacaagaatgaattgacacgtgtctcaggagtgccaagaagggaagtctgagagacaaggagagagtagcataagggtcagggcagggctccctcgctgtgaccagcatgaacccacgtgggcactcagatgaggctgatgccagtatccaaggagcagctcaaaccagcaggtctcccaactgggcacagattggcgggtggctaagccctgctcactatgggaggaggtcctaaaaagcttctggactctgagccagtgaaggccatctgccatttgggcttggcacagagctgctatgcccctcgggttggagctggcccatgaaggccttgggacagggcttccttcctctcatgtttttgttcaagttgattaaacctgaggaatttttgcatccaggagcagaggcccacgtgcatttctgcgggagcctgtgattatcaaatcctcaaagggcaaagtgccaagcttagaagaagctaacagcaggccagaaggaatggggaaggccagcagcatccccagaacctcagaaacatcccctcaaggactcccagatctcccagagaacctccagaatctcagcaacatttctgagtttcagtaatgccataagaagccctgcaacctcagtattgcccccaagaagccccagaccttcagtaacacatcagaaccactgcaacacctcaggacactcaaactctggcaaactcaaactctggcaaatcaaccacagattggaacaagatgttcaaaagcctgtgaccatttgcagaaaggccagagacccccgttgctctccaccctcccatctcagcccttgactctgagtccagcagcaaacccaatagtttacaatactcaaacctcaggtacacccccaacttcgatagcacggaagagaacacgcaagagaggcgttccaggagtggggggatggccactgtgcccacctgtgcagcccagtccccttgagagtccatgaataagcagccgagagagtcaacctcatgcgggcccgtgagcttggggtgtgccctcagtggcacagcacactcacacacacatccaactgcccttcgcacacatacgtgcttaattctggcaccagaccaagtctgactccacacagtgggctggaaggcagtgtcgtcggctgccgtgctcacggcaggaagagtatgggtgactctccacctcctgtctctctacctcctacctcccctgccatgtgggagggtcagaagcaccatctgatgtgcccttcctgcaattctcatgcccccctcaccaacagcatcatcataacataaaggatttagaccaggctgttctggtatgagggtggacactggtgaggaggaggagggtagccggctgtgccaggggagcagcatgttctttccctcccagagggctaggctagtactgacctggaggagggaggcagatttcagctcagaacaaaggtagccttctagagtagtgaggcccccatcaagggaggcaatcaagaagaggctgttaacatcaagatgcaacagagggcttcctgccttcggaggactagacacaaggccatgaagattccccagctataagagccccacgttctccgttcccagcacgttcctccctgggctggccaccgtggtgtggccttgagatgtaggctttgtgctgccctccttcctcactgaggacattgactgctgggcagatcccctgacttctctctccttgttcccttgctgaccacaggacagggctctccaccaaccttttgcccacagccagtcagatccaactcagacaggactctgcgaatgtctcctgccttttggagctcctgctagccccccagtgtcccctgagggcagcccaccccaggtctccaaacttactcatcagaattgctccagcccatcactctgctcacttcctgcccctaggctctgactcctgctcacttcccaccgcacaccccatgtgccttctcgctgttccccgacctgttccaatcccacctggcctcccagacttggctccagcctacctccaatcaagcgctctcctgacctctcccttccttgtctctttcctttcctttattgatctctcccggaaacttgtccctccaggcaagcagggtgctcccaacacggggccttctcctctgagcccagcaccagctgggctgggatcctagaggggtggctggttgtgtggtctcggcagttggccctgagaagtgtccccagcacctgctttaaaaggtgtttgatctgctcctcccggaaggcagctccccccttctccagtctggctctgcccctcctcctgccctcacagacctcccgcccttgattccgggatcagaggaacccaccccacccccatctccagctcaggcacagagcaggggctggggccccacacaacacacagggcggcttgtctccagcggtatagcctctccacacccccaaaccgtttgctcgaaacttgatctccttggccctcagagtcacctcagtggagaagcctgcacagggctttgatggctgagtttccccagatgtggccttagagaagctgaggaaccccctacttacctccatttgtccccatccatcactcccagggggccactgcctgatgaattgccagaggggaaccaccagctcggctcttaataaccggatctgcatcctgctgctgcccagctgggctgagggccctgaccacagctaaggggagtcatcacagggcttcagggctggaattccaggtatgatctattcccaggggaagtgaaaaaggccccctcggagctttctcttctatttctcacttctcacagacaggctggggttctggagtcctgctcttcaccccaagtacatgcctgcaacctccaacgctgctggacagtcggctgcatcccccctcacctgagcac

SEQ ID NO: 2592 - DNA, 23750 bp, Homo sapiens
tttctcaggaacaagtttattgcagggaacacactaacctctttcataatagccaaaggcataaaaactacaaaaatatctggctctcgagtgtgggcagctcagtgtgggacctggtctgagtcatgacttgggctgccctgcaggccagaggcccgggagctttccggccactccccagagaggtccgtggcgctgagggggtgaggaagtgccttggctgcttccacagcgtgaaggccaaggctgaggtggagctgggctggagtggttccagagaaggcttcatcgaggcccttcaaggctgatggcagagccagggtagggagacgcctggatgtggctgccctggctcaactggctcctggaccaaggccctaacccaccagtttctttctccagaacccctgctggctctcccatagccaagtgggtggagcagagccctcctgaggctcccagtgcagacagacctccacccaaccacagtgatccggaggacctgctggctgcatggctggtgtgatgctgggaggagagccggggagggaggaggatggtaggcaggaacatgcctcagcacagatgggcaggtgggttgaccttccctgccctcagggctgggcaccattggcacccaacagggccgtcttgcggaagacctgcagggttgggttgtgcagcagcgtgtaggccagaccccagcgagccctgccgcggctggccccgggcctagctcccttggccatggagtcctttgtctgtagcagctgcatccctgagagagacggactttctgtgagtcactcagcaaacacccagccaaccctccctggccctcagacctgatcagagagcctgaaaatcccaggcgtgtgcaggtcgtgaggcttaggatgtcccctgcaggcagcacatggaagtggggggtgaggtctgtggatggactggaagctgggtgggacaagggtctggagctggcttagtgtcccctccctacacacacttctgggcagaaggaaaggaggagtcatactccctgccccaagggagaagcgggggcagtgacggagccccttaggaaggcagctgtttcattctctctgtgtgcacacatatggtgtgtgtatgtgtgtgttcatatcatggaaaaaatcaccctgagatcagaccaggaggggtgaccaaaggcagccaaggaagagaggaagtgagaattttcctggcgctcactctgtgtgctggggaggggcacacatccttcctagaagaagctgggtaggctctattcccccattcccagtgggagggcgcaccttcgtcttcctcccctggtctgaggctgtcctggggggctgccatggtcctgggtaggaggctctgcgcttgcaggagcagggagcagaaggctgtcatggctggatgcgactggctgacttcaatcttcaagaagtttcggtacgtgtagtagcctggggtggggtggcggatggcaatgctgggggagcaggggccacactggaggcatccagacatcccctaacacacacacagggagtgcacgtgcactccctgcatccaagcatgtcgacacaccaagcacgtggcacattggctgcatgggcacgtgtggacctgctagaacaccccacatccactgcacgtgctgcagggccacaggaggcacagcgcaggggcacacaggtggcacatgcagctacaggcatcggtgtgaactgatcagctggcacggccctggggcagggcagatgccttcctcactgcttgggtagcctgagcaatcctccagccccgcccagtgaccttaccggggtcgagagtggcggctctcggtggcagcaggctgaggtccatctggccaaggtggatggcgttgtagagggcagagaggagcactcgccaggtggccaccatggcacccaccagcacattgagggggaagagaagaaaggtggctgcatagagcactcgcctaggatgggagaagaaagctgaggcaggccgttccccagagctccctccccagggtcagtgtcagacctggatgcccagaactgctgtgtatttactgagtgcctaccatttattgctatgtcttctgtgcaccccaccctgggcaaggccttctctctttcaacccaccatgctgggagatgggaaactgaggcccagagagattgggagacttagccaaggctgtcagctattcagtggcagagctgggctttaactctaggtccatctgagtctttctatgaccctgatgcctcccacctcccttttctgggtcccctgtctgctaattccaagttcccctgggagccaaggttctcccacagacttgtcatctgacagggaactcccttgctacaaagtggggaggggcatggttttaaggaaacagaggatccaggggagagcagtaccgattcccaaagcaagaaaggttcacgggggtacttccagccccatgccgggtatgtagagaggtactttggagtgggctgagccattgtcccttttctctatgggtaaggcaagctctttctactatcatctgggttccttgatagagagaagggatagatggcagtggagggaggacacaaaaagagagagacaccgaagaagaggcgagggcctgagggagccacaagcccagatgccacctcaccggttggtcagctgtgggtgtccatcatgagtctccaggaagacccaatgggctgccatgttctgcaggatcacagccagggccaaagtcagccagaagggcctgccagtggggtggggaggtggtcgctgttagcggacctctaaggagtccctgagccctccatgtcttgtttcactcaccacgaggactccagggaacggaagagcaggaggttcctgccatggagcacaggcatgagcaccaggaaggccagggccgtggttcccaggaagaagatgatctgctgcaccaggagccctgccaggggcgggagtggcagggggacagaaaacaggttccatgaaaactggccatccccgctgcccccagaaccaagggctttgggattgggcaggcctggttttagatctctgctctgccactgcctagctatgctgccttgaacaaatcactttacttcattgagcctcagtttcttcctctgtaaaatggggataatagtccctacctcagaggctgttgtaaggatccaatgagataatgtctgtggaaactcttaaaatcacaaaatactttgcaaatgttatttccctccagtttctcctgagtttgagttactgggggataaggctacatattaaactgatgtttgcattccttcaagccagagcctggcatacggtaggtgcccaaggactgtctattgaaataatctggccaactgattagagaatgatgtctacaaaagggcctggaggcataagggctaccaagaagagacgctatgacttttgtcctagtaattcatctactcctttaccatccttctcctcccgcaaggaggtgagaatggaaggaactggagggagagatacaaggcccttggatgtgcaacccaggccacagcccctcaccattcagagtgcttttctcactgcagtacccaaggggagagtcagaaacttggggctggtaggggtcctggaaggttatctggtccaactctctcagggcaggaccccctttgcagactgcaacaatatccatggaactctgcttgcatacccccagtgacagggatctcattacctttgtaggtagccaaatgtgacacagccctttcttaagctggagcgcagtggtgcaatctcggctcactgcaacctccacctcctgggttcaagcgattctcctgcctcatcctcccgaatagctggaactgcaggtgcacaccaccatacccggctaatttttgtatttttagtagagacggggtctcaccatgttggccaggctggtcttcatctcctgacttcgtgatccacctgcctcagcctcccaaagtgctgggattacaggtgtgagccactgagcccagccaggaatgtaccattttgaatttgacacctccagacctgggtccacccccatgtgaatacttggtggcacccagggttcatctccatgtggagggtacacactcaatttcccgagggctcctgtacccccatcctgaataagcttcttaagggcagggaaggcaggggggtccctccttcttgctgctgccccagagcattcccagacaaactctgagggcagtacttgctgagcactcttctccccaactgaggccagtgtctgaggggaggcccaggccaaggctgggtgtggcgggcaagggaggctcaccaaggcagataaaggctgtctggtaggcactgaagctcatccaacagaatatggcttggcgggagggatggggactccgatgcaagggactcaagtccagggcagctcctcggtgcagagctcgaaggttggtcctggggtgggagccagggaggcagagacctcagggagcaacacactcttcctaaatcctcctctgggccagcaactggccaaactcccaatagaatttcaactcacagccatcagcagggaagcccagaactgtgggagccaggaggaggccactaacccaagatatctggaagaggtgatatctgggtagtcttaaacagtgaacgaggaatacaaaacgaggcagaaggctcaacctgagccaagtcagaaaagtgagaaacaacagtgagaatggaagtgacacacagcacagccaacaggtaaagaggcaaggcaagcacaggctgaggagccttgaatgccagaagaaggaggggtgacctgtggaaaaagatccctgggaagagctctgagacctggcaagtgcgcaggagacatgggccagttctctgacatgggtaagtgctcgggctgccccttccacctgccctgggccttcagtgctcctcaccactcaccgctgcagggcaagcaaggtggcatggcgagacccgtaccacctctccagtgtgctatgccaccaggctacccctcacctacactctcacatggcagggccaccccagcctctgttctcgtccacacagtcctcacctcctatctccttccattcccgggcaggtgcagcttccccaggccaccttccctctcatccagcccacccggtggcccctactcagggggcaagctccactagctgccctgagttggtggtgccctatgtccctcacactcacagacgtttccccaaccagacaggaaggcccaagggcaggacccagccccaccttctcccactgcagcgcagccacgcacaggtgggctccatgacagcccgggccggcagagcccttccctccctccaggcccagggcctccccgcaggcccacaggactcccactccttccccacctcggcgctgggtgagccagagtctgtcactcacctgtgtgtcaccagtgagcgcatcaggaccaggaaggtgagtaagcaggacaagaccaaggctgagatgtagcacactggtgggcagagaatgagcaaagtgagaggtcagggtctggagagtctcctggaggcctcagaacccctgccagggtggtgccttgtggggagttccccctgccccaaactgaactctgtgtggaagcctcttggccccacccccaggtctcagatgcagtgtaagccaatgacttcggccaccccattcttcccagtgacatacagtggtcaagagatgaaaccagctctgagtctgcagacctagtcctcaccctgctgttgctgcttctattgctgtgggacctccatccaacctggcatctgcctccagcttcactgcttcttggccatgtggccttcaggagggcactccttctccccaggcccccatttgctcgtgaacataccgcacgccgttatgctgcccagctctcaggataatgtgagccataaggccccatccacgtctgcactaatggtcttcgttcagggcatagagggtgtgagtccacatcggtgtggactgagtccatcagaatagggaggcagccgctgtcacccagctccctcaccctctccctggccatgcacacaatgagtgtgtgcatgatggtgtgtcatgaacaagcctgggtgtttaagaatttcaggggtgcaggctgcaactctcccaccttacgtccacatccagtcttgctctggactgtaacagcaaccccgcaaggttagacagaagaactgttcccactgggctgaagaggaagctgaggctcagagagagggcttcgcccagacagccatgctgctaggaatgatagagtgaggtgtgtaaccatttctaagcagatccagaatgagcctgagatgcctgcaccctgatctcatcagtcagtccagggaagtgttcctggtgcccgtgtcaccaccagaatctcaaggacggggagagcaaacacagaaaaggtgagtgctagttccacatagccacagggattagagtggtggatctcagcaccgatagcgcctttaggatcacctggagctgctaaaactcgcccatagcccagcctgcacccaaaccagttaaatcagaatttctgtgggtgggacccagccttagcctgtgaaagcaacactggtgattcagtgtgcagtcaggactgacagccactgctctgggggctttccaaaggcagagccttcatgatttatttccatcagaaatgaattgaaatcaaccaaccaaccaatatttattgggtgcctactacagtggtgatcaaactttgcttgcatgagaatcactgggactgtgatcccaacactttggaaggctgaggcggtggatcacctggggtcagaagttcgagaccagcctgaccaatatggtgaaactccgtctctactaaaaatacaaaaattagccaggcctggtggcgggcccctgtaatcccagctactcgggaggctgagatgggagaatcacttgaacctgagagacggaggttgcagtgagccgagattgtgccacggcactccaccctgggagacagaatgagactccgtctcaaaacaaaacaaaattagccgggcctggtggtatgtgcctgtaatcccagctactcgggaggctgaaatgggagaattgcttgaacccaggaggtggaggttgcagtgagccgagattgcaccactgcactccagcctgggcgacagagcacaactccatctcaaaagaaaaaaaaaatcactgggagggctgttcactcaaagaggctgggccccactctgagagtttctgattcagtaggtctggcacagggcttgagcaacgggaatgttaaagccaccaggtgcttcccagattcagccagggctaaaaatgatgctacagaaacctaggcccttctgctggtccctagctccctcctccagggccctcgcagggacacttttctcagaagcaaggttgggagaaagcactgtgcatgcatagctccagcctctgtggtcccccttctggagccagctgggctgcagcgagggcacattctggaccatttgctgccaggaggtgaacagcccgcctgctgagcctggcctggtgagtgtacaggctaacacagggttgaagggttagcagcccccttggccacaggcctggcctttgatctccatccatctacctcctacctctctctccctccactggttcccaacttgggcacccccaaaccccagcactcacacaatcttcctgctctttgccacctctgggatcctgtgcctgccttcttctgggccctgctttgggggatagatctgtcttccctcatgtgattgagggcctcaagggcaagtgttcctttttcactccagcactcattttgcagttggggaaattgaggtcaggagaggtaatgcactttgcccaaggtcactcagcttgtaagtgatggaacagagattctaatctagtttgcctgactcagtctgagctctctgtgagtgatgccaggcttatggtccaagtgctgggtggcagtcctaacagaagctctgagctcagaagacattagctccttaggcgaaggacagaccaagggacactggagcccaggttgcgggatggctttggccgtatctgtaatcctcctgggcctcagtattcctcatctgcaaatttaaagagtaactgttgctctgtttggcccaagaagattcaaagtgggagcctttgagcttggaaactgcaacatgcaattaaaaatataagacatgatgagtggaagcagagtcctttgccctggatgtgtctcattttgtctttgagcctcaatgtcctgccctgtgagctgggatcaatgatgctgacctacagggtcactgtgagcaagggtctgaggttggttgtgggctgacctggaccatgtctgcacctgcctatgaaccagattgcaaccagctcagaaaatctcctgggagaggacattttcagctcacccggaacttgtcacctgtccagtttgttgccctcagcagcagttccagggcagcctctagtacgggaactgaggtgctcacggagatggtggaggtggtcagggaaggaagtggtcactccgtgcacctctgcccaccccccactccctgccccgccatgaccagcatgcccaggtctgtaggataaggatgatgttaatggtcaggtacagctgcggagcagctacacctccacctgcaacgctggcagcccacgctctgaccacatgttactcctcagaagccgggggcccatccgtcccagcctggggtccccaagtaagcagaaggcgcatgcctcctgagtcctcagcaccgggctttgtcccaaggtgatggagaaggcccccgcctaggcttcaggagccctgcgttctcttggctgcactctgccctgctggatggcctcaggcaaatccttccccatgtgtcaagtggggacacttctcagtcccctccacagcgctgttgggagcgcccaggaggcagagtaagtaggtggctgcaggaggcatcagaccacagaaggggaagccaagatggttccctggttcaggagctcattgtcagaggagggaaggagaaaggagacggccccaaaagacagggagtggggaagagaaagcctgtgccctgcccaacgccagacccctgccacgaggattcgctcagaaatcctcaccatctcccttcgccgtctcttccctccttccccaccctcagctcccccatcccatggccttcctcatctccatgcctggatagttggtcagagacactgggggtggtgggggaagatgccacagaagcaggcaagggacaggagctgctgagatgtcccttcaggtttcatggaagctcagaactggaagcgccaactgccacaatttggagatgaggcaatcgagacccagagagaggaaggaatgtgtccaagggcccccagtgtgtccatggctgactagggcatagaccttgggtctccccgctttcattccccactgcagccctcaggggctccctggaggcctcaccttccagagcccacagatggtgcttcaccagctccaccacctcctgcttgtcctcggagagcacgattccaaagccggccagcaggtaggagacatccgtggtgacccctgccctcaccttctggatagtgggtaccacgcccaccagcagcagcagggccacctggaagagccccacagtgagggccccatcccaggaaagggttttctgtgctaacaggggagacgctggggaagaaactggcagcacacaggccccagccacatgcccattgcccatcagtgttcttatctgccccttagagcagggatctcacgcctctaaatgaggacattacagacaggtgcaatcacagcctaataggccaaaggcatgccttcgagcaccgtaacttcatatagtcagccctgcgtatctgtgggttccacatccacaaccaaccaattcaatcaagcgcagatcaaaaatatttggggaaaaaccctcaataaaaaataacaattcaatacaaataatacaaataaaaaataatacagtaggacaacttcttcttttttttttttttttgagatggagtcttgctctgtggccaggctggagtgcagtggcgcgatctcggctcactgcaacctccacctcccaggttcaagcaattctcctgcctcagcctcctgagtagctgggactacaggcccgcgccaccaccgccagctaatttttatatttttagtagagacagggtttcactacattggctgggatggtctcaatctcttgacattgtgatccgcccgcctcagcctcccaaagtgctgggattacaggtgtgagccaccacacccagacataggacaactgtttacatagcacttatgttcgatattataagtactttagagataacgaggtatactggagaatgtgtgtaggctatatgcaaatactacaccatcgtatatcagaaatttgagcctttggattttggtatggaggggtgttcctggaaccaacccacctcagatactgagggatgactgtgtctgcacctctatctatttacccatcatctatctatctaaactttggaatgtaaaatttctggtttttctatgttgtgaaagtaaatgagcacaggaattaaagctggacagacttggattcaaacttaggctacgctgagatattagctgtgcagaaacttggccaagtcaaattcacctctccaagcttccattctccccatctgtaaagtggagaataatcatacccatctcccaggattttaattgttgttgttggttttttcggggttttttttttttcggaggtggtgaggcagagtttatcaaacatgttgtcttgctaaatcttcccaattactcaaagaggaaaattattctattttctcctttttacagatgagctaacaggttcagagaggttatataacttgcccaaggccacacaggaggtaaatagtggagctaggatttaaattcgtgtttatgtggcctccaaaattaatgctccgagtcacttcatgagtccaagagtgaacaccccggcccttctgggtaggccagaactcccaagatggcctgcagcacctggtcagggttctggatggagcacctggagagctgggttgggccggaactgctccaggcttgggggttgagggcagggctccagaggcagatggcagtacagggtgagggacatacctggtaaatggccgtccctgtcagtgtagctgaaagcaccagcttcagcgggagatggaatcctgtagtcctcaaaggaaggagtatggtgaacagcaccactcaggcccgggagccctcctccctcccaaggggcccaggaaaagggccagcaggaccctaaatgaccaaggccaggccagggtcttcccgctgtcccaagctggtagttgtccctcttgatgacaaggattctggggagcaggagccagtcctccactgcagccattctgtgcaagggagggtaacgtcccctgtcacgctcggcctcagctcccaaccccatacctggctgtggagtgtagatgcagtgtctcaagcagacgcgggcccaggacaggaagccatgcttggaggtgtggtagctgcagaaagacccaggcaggtgcggggtcctcaggggaagcccattccctgagggccagccccagaggctggtcattcttcccctctgcccctgccatgctgcccagtgccagcttcccaagcacggctgctaaccagcccaatccattggcccacaaagggtgtgtcagagaccccacctgcttcccagcttcttcctgcaaaggaggttcctcagatattcctcagagtagctgctctgcagcccctgtggagacagacaattgaacaagcagatgagatctgcctcgacccattcgtgggtccctggctcagggaactagagtgttcaccaagcaggtgctccataaaaacctgttggccatggcggtggtggtgagtgtggatggggctgacctgtggggatgaggtccgtgccctccaaagcttcccttttctctctcacaaatacaaggccagtctcctatcaaagaaccatcaatgccaggaagttcttcctaagatctgtctccaactctcgcctgctttactcagtcacatctcttcaccgtttcttcccacccctagccctctggcctctgctagctgaaactggggcaaagggaagcttgtgtcccacgggcacatcctagaccaggacacagaagagggtcattccaggtcagacaccctcaggcttctcctgctgccactgcgcaagggagatcacaagggtgaccagatttgtctaagccacattccaggccttaagctgcctgtgaagtagcagaggcccatgggaagatggggtgagcccctgcctggaatcactgggagaacacaggctgttgtcacttgttgccatgacaaccctgggatcccgggcaggagtgggtcagctcaaagcttgatgggggtcctttgagacttaaacctctttgaccaaagtccaaagaggattgtacacctctcaagcctgggaggaaaggctggcaatggagagagagatggggtggtggaaaccctggaagagaaggtaaaggggcatgcctcaggcactgtgtcgtcccggggggccgctcccttttcagagccagctgtaaacaggaggggacacaggcttcctcgaggggtgttggcctcaataggcaggagctacaagcgctcagaactccctgcctgccacgtgggagccgagtctggagtccgtgggccttctcggaccagagtagcccaaaagggacccggggttctccatcctgcctagggatctcactcactctctggattcagtctgaccttgccgagttaacacccggtcccagcccctctgctgagctccagactttgagcagtacaccctcaggaccaagcatcatcccaggagcacctgctcctccctccaccttccctgggccagcagctggcaccaccacctacctgctggctggccaggtgcctcccatcaagcctttccttcccctgccctgtctgaagagaagccacgccctttggcctctatgtcttaagactttctcctgagtctgttcttctttcccctttgagggtctctgcagagctttcttcctcctcctctctcaccagaaagaagtagtggaccccgccccctgcaccacagtcccaacacccggtgcaggtttcacattgcactgcaggtgttttgtgccgcatctgtctcccccaccacactgggagctcctggagatcagacacaagtccatcagctccaagtccacagcactgagcccggggcctgacatatggtaggtgcttagaaggctttttagtgagattgaagtatcttctaagaattctcttttaccatgatgcattcatccatccatccttccttccatacatctttccttcgatccatccatccattcatccatctattcaaaaattcaaaaatatttgctgagtatctattaagggccaagacccacccagtgctgcaaatataatgaacaaaacagacacaaaactatctcttcccctttactcatgctctttcccgtgcctacaatgcctgctccttattctctcatcactctagatctccctgtccttcaggcccttgtagagtctacctcctctaggaagccctctcagccctcccctttatctgaaattattcaaccacatccaacctagagttgactcataatggagttctgccctgggtgcttcctgaatcatctcattatgtgcagaactcggattaggcacaaggctccaggctgtctctccagccagatctcagtgtttcacagacagagatatgactctcctggcttctgactcagttctgctttgttaagtccctactattcacacagcccagtgccgcgggtatcctgggtgccagtcaagggcccagtccagcttttgcctagggagggaggactaagcagtcactcagcaaacattttctgagcatctattctgtgctgggccctacatcaagcacggccatgtatctgggaccacagatacgggggagtagggctgtcttgggtgctgaggaagagctcatcccaggcctgcccctttaccttggagcctgctcctgtcctacggctgaagcttctcaccagctgcacagggtaccaaaggctcaggaatccgaggcccagcaggagaggcagggaggccagcagggagtagtacttgtagatctggacagacaaacacccagacagactactttccaccttcttcccccagccaagaaccagaatccgttgcccttcccacctcacactgggccctgagggtggtctggggggccatgggaaggcttcagctctatggttcccaacctgccacccagcgcaaacctgcccacttccccttctcgagccctgcagagatgctcacccctcccccaggctcctggatccccacgggcctgagaggagccaagaggaggagatcacttgattccctcctgccccccactggaaaggacacctctttctgtttctgtgttcccggagcattaggaacagttctgaaaatcacacgaaagcctgcctttgcctacatatagttttcaacctgagcatcaggaaagtctatgccctactcctcagggctgaggccttcctgggggtgggctttttgtatactcattcatttatttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatacaccataatccttgacaaagcccccctcctgggggaggaggccccagcaccattggcggcctgagccctgcaagggtgtggccaggagccacccccacccccgcacctgacttcacacacatacctgccttcagcgcctgccccagagctcccaagcccctgcccgccacatctgcagtgccgcacacagacaggagaccagcattacagcaacaaccgagtgagacggaccgctggggctgggctggggcggaggcagggaaggggaatctgtccgtttcttctcctagggtttccatgaaggaggcaacatgtgtctcattggtaaacccttttt

SEQ ID NO: 2593 - DNA, 29565 bp, Homo sapiens; identical to SEQ ID NO: 2590

SEQ ID NO: 2594 - DNA, 23414 bp, Homo sapiens
tttctcaggaacaagtttattgcagggaacacactaacctctttcataatagccaaaggcataaaaactacaaaaatatctggctctcgagtgtgggcagctcagtgtgggacctggtctgagtcatgacttgggctgccctgcaggccagaggcccgggagctttccggccactccccagagaggtccgtggcgctgagggggtgaggaagtgccttggctgcttccacagcgtgaaggccaaggctgaggtggagctgggctggagtggttccagagaaggcttcatcgaggcccttcaaggctgatggcagagccagggtagggagacgcctggatgtggctgccctggctcaactggctcctggaccaaggccctaacccaccagtttctttctccagaacccctgctggctctcccatagccaagtgggtggagcagagccctcctgaggctcccagtgcagacagacctccacccaaccacagtgatccggaggacctgctggctgcatggctggtgtgatgctgggaggagagccggggagggaggaggatggtaggcaggaacatgcctcagcacagatgggcaggtgggttgaccttccctgccctcagggctgggcaccattggcacccaacagggccgtcttgcggaagacctgcagggttgggttgtgcagcagcgtgtaggccagaccccagcgagccctgccgcggctggccccgggcctagctcccttggccatggagtcctttgtctgtagcagctgcatccctgagagagacggactttctgtgagtcactcagcaaacacccagccaaccctccctggccctcagacctgatcagagagcctgaaaatcccaggcgtgtgcaggtcgtgaggcttaggatgtcccctgcaggcagcacatggaagtggggggtgaggtctgtggatggactggaagctgggtgggacaagggtctggagctggcttagtgtcccctccctacacacacttctgggcagaaggaaaggaggagtcatactccctgccccaagggagaagcgggggcagtgacggagccccttaggaaggcagctgtttcattctctctgtgtgcacacatatggtgtgtgtatgtgtgtgttcatatcatggaaaaaatcaccctgagatcagaccaggaggggtgaccaaaggcagccaaggaagagaggaagtgagaattttcctggcgctcactctgtgtgctggggaggggcacacatccttcctagaagaagctgggtaggctctattcccccattcccagtgggagggcgcaccttcgtcttcctcccctggtctgaggctgtcctggggggctgccatggtcctgggtaggaggctctgcgcttgcaggagcagggagcagaaggctgtcatggctggatgcgactggctgacttcaatcttcaagaagtttcggtacgtgtagtagcctggggtggggtggcggatggcaatgctgggggagcaggggccacactggaggcatccagacatcccctaacacacacacagggagtgcacgtgcactccctgcatccaagcatgtcgacacaccaagcacgtggcacattggctgcatgggcacgtgtggacctgctagaacaccccacatccactgcacgtgctgcagggccacaggaggcacagcgcaggggcacacaggtggcacatgcagctacaggcatcggtgtgaactgatcagctggcacggccctggggcagggcagatgccttcctcactgcttgggtagcctgagcaatcctccagccccgcccagtgaccttaccggggtcgagagtggcggctctcggtggcagcaggctgaggtccatctggccaaggtggatggcgttgtagagggcagagaggagcactcgccaggtggccaccatggcacccaccagcacattgagggggaagagaagaaaggtggctgcatagagcactcgcctaggatgggagaagaaagctgaggcaggccgttccccagagctccctccccagggtcagtgtcagacctggatgcccagaactgctgtgtatttactgagtgcctaccatttattgctatgtcttctgtgcaccccaccctgggcaaggccttctctctttcaacccaccatgctgggagatgggaaactgaggcccagagagattgggagacttagccaaggctgtcagctattcagtggcagagctgggctttaactctaggtccatctgagtctttctatgaccctgatgcctcccacctcccttttctgggtcccctgtctgctaattccaagttcccctgggagccaaggttctcccacagacttgtcatctgacagggaactcccttgctacaaagtggggaggggcatggttttaaggaaacagaggatccaggggagagcagtaccgattcccaaagcaagaaaggttcacgggggtacttccagccccatgccgggtatgtagagaggtactttggagtgggctgagccattgtcccttttctctatgggtaaggcaagctctttctactatcatctgggttccttgatagagagaagggatagatggcagtggagggaggacacaaaaagagagagacaccgaagaagaggcgagggcctgagggagccacaagcccagatgccacctcaccggttggtcagctgtgggtgtccatcatgagtctccaggaagacccaatgggctgccatgttctgcaggatcacagccagggccaaagtcagccagaagggcctgccagtggggtggggaggtggtcgctgttagcggacctctaaggagtccctgagccctccatgtcttgtttcactcaccacgaggactccagggaacggaagagcaggaggttcctgccatggagcacaggcatgagcaccaggaaggccagggccgtggttcccaggaagaagatgatctgctgcaccaggagccctgccaggggcgggagtggcagggggacagaaaacaggttccatgaaaactggccatccccgctgcccccagaaccaagggctttgggattgggcaggcctggttttagatctctgctctgccactgcctagctatgctgccttgaacaaatcactttacttcattgagcctcagtttcttcctctgtaaaatggggataatagtccctacctcagaggctgttgtaaggatccaatgagataatgtctgtggaaactcttaaaatcacaaaatactttgcaaatgttatttccctccagtttctcctgagtttgagttactgggggataaggctacatattaaactgatgtttgcattccttcaagccagagcctggcatacggtaggtgcccaaggactgtctattgaaataatctggccaactgattagagaatgatgtctacaaaagggcctggaggcataagggctaccaagaagagacgctatgacttttgtcctagtaattcatctactcctttaccatccttctcctcccgcaaggaggtgagaatggaaggaactggagggagagatacaaggcccttggatgtgcaacccaggccacagcccctcaccattcagagtgcttttctcactgcagtacccaaggggagagtcagaaacttggggctggtaggggtcctggaaggttatctggtccaactctctcagggcaggaccccctttgcagactgcaacaatatccatggaactctgcttgcatacccccagtgacagggatctcattacctttgtaggtagccaaatgtgacacagccctttcttaagctggagcgcagtggtgcaatctcggctcactgcaacctccacctcctgggttcaagcgattctcctgcctcatcctcccgaatagctggaactgcaggtgcacaccaccatacccggctaatttttgtatttttagtagagacggggtctcaccatgttggccaggctggtcttcatctcctgacttcgtgatccacctgcctcagcctcccaaagtgctgggattacaggtgtgagccactgagcccagccaggaatgtaccattttgaatttgacacctccagacctgggtccacccccatgtgaatacttggtggcacccagggttcatctccatgtggagggtacacactcaatttcccgagggctcctgtacccccatcctgaataagcttcttaagggcagggaaggcaggggggtccctccttcttgctgctgccccagagcattcccagacaaactctgagggcagtacttgctgagcactcttctccccaactgaggccagtgtctgaggggaggcccaggccaaggctgggtgtggcgggcaagggaggctcaccaaggcagataaaggctgtctggtaggcactgaagctcatccaacagaatatggcttggcgggagggatggggactccgatgcaagggactcaagtccagggcagctcctcggtgcagagctcgaaggttggtcctggggtgggagccagggaggcagagacctcagggagcaacacactcttcctaaatcctcctctgggccagcaactggccaaactcccaatagaatttcaactcacagccatcagcagggaagcccagaactgtgggagccaggaggaggccactaacccaagatatctggaagaggtgatatctgggtagtcttaaacagtgaacgaggaatacaaaacgaggcagaaggctcaacctgagccaagtcagaaaagtgagaaacaacagtgagaatggaagtgacacacagcacagccaacaggtaaagaggcaaggcaagcacaggctgaggagccttgaatgccagaagaaggaggggtgacctgtggaaaaagatccctgggaagagctctgagacctggcaagtgcgcaggagacatgggccagttctctgacatgggtaagtgctcgggctgccccttccacctgccctgggccttcagtgctcctcaccactcaccgctgcagggcaagcaaggtggcatggcgagacccgtaccacctctccagtgtgctatgccaccaggctacccctcacctacactctcacatggcagggccaccccagcctctgttctcgtccacacagtcctcacctcctatctccttccattcccgggcaggtgcagcttccccaggccaccttccctctcatccagcccacccggtggcccctactcagggggcaagctccactagctgccctgagttggtggtgccctatgtccctcacactcacagacgtttccccaaccagacaggaaggcccaagggcaggacccagccccaccttctcccactgcagcgcagccacgcacaggtgggctccatgacagcccgggccggcagagcccttccctccctccaggcccagggcctccccgcaggcccacaggactcccactccttccccacctcggcgctgggtgagccagagtctgtcactcacctgtgtgtcaccagtgagcgcatcaggaccaggaaggtgagtaagcaggacaagaccaaggctgagatgtagcacactggtgggcagagaatgagcaaagtgagaggtcagggtctggagagtctcctggaggcctcagaacccctgccagggtggtgccttgtggggagttccccctgccccaaactgaactctgtgtggaagcctcttggccccacccccaggtctcagatgcagtgtaagccaatgacttcggccaccccattcttcccagtgacatacagtggtcaagagatgaaaccagctctgagtctgcagacctagtcctcaccctgctgttgctgcttctattgctgtgggacctccatccaacctggcatctgcctccagcttcactgcttcttggccatgtggccttcaggagggcactccttctccccaggcccccatttgctcgtgaacataccgcacgccgttatgctgcccagctctcaggataatgtgagccataaggccccatccacgtctgcactaatggtcttcgttcagggcatagagggtgtgagtccacatcggtgtggactgagtccatcagaatagggaggcagccgctgtcacccagctccctcaccctctccctggccatgcacacaatgagtgtgtgcatgatggtgtgtcatgaacaagcctgggtgtttaagaatttcaggggtgcaggctgcaactctcccaccttacgtccacatccagtcttgctctggactgtaacagcaaccccgcaaggttagacagaagaactgttcccactgggctgaagaggaagctgaggctcagagagagggcttcgcccagacagccatgctgctaggaatgatagagtgaggtgtgtaaccatttctaagcagatccagaatgagcctgagatgcctgcaccctgatctcatcagtcagtccagggaagtgttcctggtgcccgtgtcaccaccagaatctcaaggacggggagagcaaacacagaaaaggtgagtgctagttccacatagccacagggattagagtggtggatctcagcaccgatagcgcctttaggatcacctggagctgctaaaactcgcccatagcccagcctgcacccaaaccagttaaatcagaatttctgtgggtgggacccagccttagcctgtgaaagcaacactggtgattcagtgtgcagtcaggactgacagccactgctctgggggctttccaaaggcagagccttcatgatttatttccatcagaaatgaattgaaatcaaccaaccaaccaatatttattgggtgcctactacagtggtgatcaaactttgcttgcatgagaatcactgggactgtgatcccaacactttggaaggctgaggcggtggatcacctggggtcagaagttcgagaccagcctgaccaatatggtgaaactccgtctctactaaaaatacaaaaattagccaggcctggtggcgggcccctgtaatcccagctactcgggaggctgagatgggagaatcacttgaacctgagagacggaggttgcagtgagccgagattgtgccacggcactccaccctgggagacagaatgagactccgtctcaaaacaaaacaaaattagccgggcctggtggtatgtgcctgtaatcccagctactcgggaggctgaaatgggagaattgcttgaacccaggaggtggaggttgcagtgagccgagattgcaccactgcactccagcctgggcgacagagcacaactccatctcaaaagaaaaaaaaaatcactgggagggctgttcactcaaagaggctgggccccactctgagagtttctgattcagtaggtctggcacagggcttgagcaacgggaatgttaaagccaccaggtgcttcccagattcagccagggctaaaaatgatgctacagaaacctaggcccttctgctggtccctagctccctcctccagggccctcgcagggacacttttctcagaagcaaggttgggagaaagcactgtgcatgcatagctccagcctctgtggtcccccttctggagccagctgggctgcagcgagggcacattctggaccatttgctgccaggaggtgaacagcccgcctgctgagcctggcctggtgagtgtacaggctaacacagggttgaagggttagcagcccccttggccacaggcctggcctttgatctccatccatctacctcctacctctctctccctccactggttcccaacttgggcacccccaaaccccagcactcacacaatcttcctgctctttgccacctctgggatcctgtgcctgccttcttctgggccctgctttgggggatagatctgtcttccctcatgtgattgagggcctcaagggcaagtgttcctttttcactccagcactcattttgcagttggggaaattgaggtcaggagaggtaatgcactttgcccaaggtcactcagcttgtaagtgatggaacagagattctaatctagtttgcctgactcagtctgagctctctgtgagtgatgccaggcttatggtccaagtgctgggtggcagtcctaacagaagctctgagctcagaagacattagctccttaggcgaaggacagaccaagggacactggagcccaggttgcgggatggctttggccgtatctgtaatcctcctgggcctcagtattcctcatctgcaaatttaaagagtaactgttgctctgtttggcccaagaagattcaaagtgggagcctttgagcttggaaactgcaacatgcaattaaaaatataagacatgatgagtggaagcagagtcctttgccctggatgtgtctcattttgtctttgagcctcaatgtcctgccctgtgagctgggatcaatgatgctgacctacagggtcactgtgagcaagggtctgaggttggttgtgggctgacctggaccatgtctgcacctgcctatgaaccagattgcaaccagctcagaaaatctcctgggagaggacattttcagctcacccggaacttgtcacctgtccagtttgttgccctcagcagcagttccagggcagcctctagtacgggaactgaggtgctcacggagatggtggaggtggtcagggaaggaagtggtcactccgtgcacctctgcccaccccccactccctgccccgccatgaccagcatgcccaggtctgtaggataaggatgatgttaatggtcaggtacagctgcggagcagctacacctccacctgcaacgctggcagcccacgctctgaccacatgttactcctcagaagccgggggcccatccgtcccagcctggggtccccaagtaagcagaaggcgcatgcctcctgagtcctcagcaccgggctttgtcccaaggtgatggagaaggcccccgcctaggcttcaggagccctgcgttctcttggctgcactctgccctgctggatggcctcaggcaaatccttccccatgtgtcaagtggggacacttctcagtcccctccacagcgctgttgggagcgcccaggaggcagagtaagtaggtggctgcaggaggcatcagaccacagaaggggaagccaagatggttccctggttcaggagctcattgtcagaggagggaaggagaaaggagacggccccaaaagacagggagtggggaagagaaagcctgtgccctgcccaacgccagacccctgccacgaggattcgctcagaaatcctcaccatctcccttcgccgtctcttccctccttccccaccctcagctcccccatcccatggccttcctcatctccatgcctggatagttggtcagagacactgggggtggtgggggaagatgccacagaagcaggcaagggacaggagctgctgagatgtcccttcaggtttcatggaagctcagaactggaagcgccaactgccacaatttggagatgaggcaatcgagacccagagagaggaaggaatgtgtccaagggcccccagtgtgtccatggctgactagggcatagaccttgggtctccccgctttcattccccactgcagccctcaggggctccctggaggcctcaccttccagagcccacagatggtgcttcaccagctccaccacctcctgcttgtcctcggagagcacgattccaaagccggccagcaggtaggagacatccgtggtgacccctgccctcaccttctggatagtgggtaccacgcccaccagcagcagcagggccacctggaagagccccacagtgagggccccatcccaggaaagggttttctgtgctaacaggggagacgctggggaagaaactggcagcacacaggccccagccacatgcccattgcccatcagtgttcttatctgccccttagagcagggatctcacgcctctaaatgaggacattacagacaggtgcaatcacagcctaataggccaaaggcatgccttcgagcaccgtaacttcatatagtcagccctgcgtatctgtgggttccacatccacaaccaaccaattcaatcaagcgcagatcaaaaatatttggggaaaaaccctcaataaaaaataacaattcaatacaaataatacaaataaaaaataatacagtaggacaacttcttcttttttttttttttttgagatggagtcttgctctgtggccaggctggagtgcagtggcgcgatctcggctcactgcaacctccacctcccaggttcaagcaattctcctgcctcagcctcctgagtagctgggactacaggcccgcgccaccaccgccagctaatttttatatttttagtagagacagggtttcactacattggctgggatggtctcaatctcttgacattgtgatccgcccgcctcagcctcccaaagtgctgggattacaggtgtgagccaccacacccagacataggacaactgtttacatagcacttatgttcgatattataagtactttagagataacgaggtatactggagaatgtgtgtaggctatatgcaaatactacaccatcgtatatcagaaatttgagcctttggattttggtatggaggggtgttcctggaaccaacccacctcagatactgagggatgactgtgtctgcacctctatctatttacccatcatctatctatctaaactttggaatgtaaaatttctggtttttctatgttgtgaaagtaaatgagcacaggaattaaagctggacagacttggattcaaacttaggctacgctgagatattagctgtgcagaaacttggccaagtcaaattcacctctccaagcttccattctccccatctgtaaagtggagaataatcatacccatctcccaggattttaattgttgttgttggttttttcggggttttttttttttcggaggtggtgaggcagagtttatcaaacatgttgtcttgctaaatcttcccaattactcaaagaggaaaattattctattttctcctttttacagatgagctaacaggttcagagaggttatataacttgcccaaggccacacaggaggtaaatagtggagctaggatttaaattcgtgtttatgtggcctccaaaattaatgctccgagtcacttcatgagtccaagagtgaacaccccggcccttctgggtaggccagaactcccaagatggcctgcagcacctggtcagggttctggatggagcacctggagagctgggttgggccggaactgctccaggcttgggggttgagggcagggctccagaggcagatggcagtacagggtgagggacatacctggtaaatggccgtccctgtcagtgtagctgaaagcaccagcttcagcgggagatggaatcctgtagtcctcaaaggaaggagtatggtgaacagcaccactcaggcccgggagccctcctccctcccaaggggcccaggaaaagggccagcaggaccctaaatgaccaaggccaggccagggtcttcccgctgtcccaagctggtagttgtccctcttgatgacaaggattctggggagcaggagccagtcctccactgcagccattctgtgcaagggagggtaacgtcccctgtcacgctcggcctcagctcccaaccccatacctggctgtggagtgtagatgcagtgtctcaagcagacgcgggcccaggacaggaagccatgcttggaggtgtggtagctgcagaaagacccaggcaggtgcggggtcctcaggggaagcccattccctgagggccagccccagaggctggtcattcttcccctctgcccctgccatgctgcccagtgccagcttcccaagcacggctgctaaccagcccaatccattggcccacaaagggtgtgtcagagaccccacctgcttcccagcttcttcctgcaaaggaggttcctcagatattcctcagagtagctgctctgcagcccctgtggagacagacaattgaacaagcagatgagatctgcctcgacccattcgtgggtccctggctcagggaactagagtgttcaccaagcaggtgctccataaaaacctgttggccatggcggtggtggtgagtgtggatggggctgacctgtggggatgaggtccgtgccctccaaagcttcccttttctctctcacaaatacaaggccagtctcctatcaaagaaccatcaatgccaggaagttcttcctaagatctgtctccaactctcgcctgctttactcagtcacatctcttcaccgtttcttcccacccctagccctctggcctctgctagctgaaactggggcaaagggaagcttgtgtcccacgggcacatcctagaccaggacacagaagagggtcattccaggtcagacaccctcaggcttctcctgctgccactgcgcaagggagatcacaagggtgaccagatttgtctaagccacattccaggccttaagctgcctgtgaagtagcagaggcccatgggaagatggggtgagcccctgcctggaatcactgggagaacacaggctgttgtcacttgttgccatgacaaccctgggatcccgggcaggagtgggtcagctcaaagcttgatgggggtcctttgagacttaaacctctttgaccaaagtccaaagaggattgtacacctctcaagcctgggaggaaaggctggcaatggagagagagatggggtggtggaaaccctggaagagaaggtaaaggggcatgcctcaggcactgtgtcgtcccggggggccgctcccttttcagagccagctgtaaacaggaggggacacaggcttcctcgaggggtgttggcctcaataggcaggagctacaagcgctcagaactccctgcctgccacgtgggagccgagtctggagtccgtgggccttctcggaccagagtagcccaaaagggacccggggttctccatcctgcctagggatctcactcactctctggattcagtctgaccttgccgagttaacacccggtcccagcccctctgctgagctccagactttgagcagtacaccctcaggaccaagcatcatcccaggagcacctgctcctccctccaccttccctgggccagcagctggcaccaccacctacctgctggctggccaggtgcctcccatcaagcctttccttcccctgccctgtctgaagagaagccacgccctttggcctctatgtcttaagactttctcctgagtctgttcttctttcccctttgagggtctctgcagagctttcttcctcctcctctctcaccagaaagaagtagtggaccccgccccctgcaccacagtcccaacacccggtgcaggtttcacattgcactgcaggtgttttgtgccgcatctgtctcccccaccacactgggagctcctggagatcagacacaagtccatcagctccaagtccacagcactgagcccggggcctgacatatggtaggtgcttagaaggctttttagtgagattgaagtatcttctaagaattctcttttaccatgatgcattcatccatccatccttccttccatacatctttccttcgatccatccatccattcatccatctattcaaaaattcaaaaatatttgctgagtatctattaagggccaagacccacccagtgctgcaaatataatgaacaaaacagacacaaaactatctcttcccctttactcatgctctttcccgtgcctacaatgcctgctccttattctctcatcactctagatctccctgtccttcaggcccttgtagagtctacctcctctaggaagccctctcagccctcccctttatctgaaattattcaaccacatccaacctagagttgactcataatggagttctgccctgggtgcttcctgaatcatctcattatgtgcagaactcggattaggcacaaggctccaggctgtctctccagccagatctcagtgtttcacagacagagatatgactctcctggcttctgactcagttctgctttgttaagtccctactattcacacagcccagtgccgcgggtatcctgggtgccagtcaagggcccagtccagcttttgcctagggagggaggactaagcagtcactcagcaaacattttctgagcatctattctgtgctgggccctacatcaagcacggccatgtatctgggaccacagatacgggggagtagggctgtcttgggtgctgaggaagagctcatcccaggcctgcccctttaccttggagcctgctcctgtcctacggctgaagcttctcaccagctgcacagggtaccaaaggctcaggaatccgaggcccagcaggagaggcagggaggccagcagggagtagtacttgtagatctggacagacaaacacccagacagactactttccaccttcttcccccagccaagaaccagaatccgttgcccttcccacctcacactgggccctgagggtggtctggggggccatgggaaggcttcagctctatggttcccaacctgccacccagcgcaaacctgcccacttccccttctcgagccctgcagagatgctcacccctcccccaggctcctggatccccacgggcctgagaggagccaagaggaggagatcacttgattccctcctgccccccactggaaaggacacctctttctgtttctgtgttcccggagcattaggaacagttctgaaaatcacacgaaagcctgcctttgcctacatatagttttcaacctgagcatcaggaaagtctatgccctactcctcagggctgaggccttcctgggggtgggctttttgtatactcattcatttatttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatac

SEQ ID NO: 2595 - DNA, 2309 bp, Homo sapiens
acaggccgaggcagggagaactctccactcggaggaggagctggggtcctcttccatcccgtcttcatcctgcctggctgcgtgacctcgggcaagtctccgcccttctcttggcctcagtttctccttccgtaggatgggggcggtgggctaggtggtgttgggatttagctgggttatgtgggacagggcctcctgatgggaaagagctctggctgggcttgtgggaggaatgagtccctttggcaggttctcgggatcccctgggtgacatgcctttctctgcaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacgccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgcc

SEQ ID NO: 2596 - DNA, 3127 bp, Homo sapiens
gaagcagttgttttgctggaaggagggagtgcgcgggctgccccgggctcctccctgccgcctcctctcagtggatggttccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggtaagccagtggggaggagggctccagggccagcggcgggagcgggaggcctgttggacataggggctggttccctcttggtccatccctgctggtctgaggtgcgtgggacaatccctagcttggagccgtccagggggcatctgcttcttccacaacccacaactgaggccccagaaatcccagctgcgtttgggctgagcctctggcctcacccaagtcagctgagaggtcctggcgggggtttatttaggcagctgcctggctaagtttgaacagaacaggccacgggtgtgattccacagaaaaggcctggtgtctgctgcggtcatggccggaggagcgggagagggcgggtggagtggatgggggtggtgtgcactgcacaaggggcctcgtctgggccaaggcaaagcatacctatggggggctccggtgggagggactgcggccaggatgtgggagggcagggggaggttctgcaaagtgctgggggaggggggtggctggaaaacagatttcaagtcataaagtcagctaggaacaggccgaggcagggagaactctccactcggaggaggagctggggtcctcttccatcccgtcttcatcctgcctggctgcgtgacctcgggcaagtctccgcccttctcttggcctcagtttctccttccgtaggatgggggcggtgggctaggtggtgttgggatttagctgggttatgtgggacagggcctcctgatgggaaagagctctggctgggcttgtgggaggaatgagtccctttggcaggttctcgggatcccctgggtgacatgcctttctctgcaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggagggtgccttcagggaggtgcccctgctgcagtcgctgtggctggcacacaatgagatccgcacggtggccgccggagccctggcctctctgagccatctcaagagcctggacctcagccacaatctcatctctgactttgcctggagcgacctgcacaacctcagtgccctccaattgctcaagatggacagcaacgagctgaccttcatcccccgcgacgccttccgcagcctccgtgctctgcgctcgctgcaactcaaccacaaccgcttgcacacattggccgagggcaccttcaccccgctcaccgcgctgtcccacctgcagatcaacgagaaccccttcgactgcacctgcggcatcgtgtggctcaagacatgggccctgaccacggccgtgtccatcccggagcaggacaacatcgcctgcacctcaccccatgtgctcaagggtacgccgctgagccgcctgccgccactgccatgctcggcgccctcagtgcagctcagctaccaacccagccaggatggtgccgagctgcggcctggttttgtgctggcactgcactgtgatgtggacgggcagccggcccctcagcttcactggcacatccagatacccagtggcattgtggagatcaccagccccaacgtgggcactgatgggcgtgccctgcctggcacccctgtggccagctcccagccgcgcttccaggcctttgccaatggcagcctgcttatccccgactttggcaagctggaggaaggcacctacagctgcctggccaccaatgagctgggcagtgctgagagctcagtggacgtggcactggccacgcccggtgagggtggtgaggacacactggggcgcaggttccatggcaaagcggttgagggaaagggctgctatacggttgacaacgaggtgcagccatcagggccggaggacaatgtggtcatcatctacctcagccgtgctgggaaccctgaggctgcagtcgcagaaggggtccctgggcagctgcccccaggcctgctcctgctgggccaaagcctcctcctcttcttcttcctcacctccttctagccccacccagggcttccctaactcctccccttgcccctaccaatgcccctttaagtgctgcaggggtctggggttggcaactcctgaggcctgcatgggtgacttcacattttcctacctctccttctaatctcttctagagcacctgctatccccaacttctagacctgctccaaactagtgactaggatagaatttgatcccctaactcactgtctgcggtgctcattgctgctaacagcattgcctgtgctctcctctcaggggcagcatgctaacggggcgacgtcctaatccaactgggagaagcctcagtggtggaattccaggcactgtgactgtcaagctggcaagggccaggattgggggaatggagctggggcttagctgggaggtggtctgaagcagacagggaatgggagaggaggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttgggagcagcagagaaataaacagcatttctgatgcc

SEQ ID NO: 2597 - DNA, 14644 bp, Homo sapiens
tttgttggttcaatatacttttattgagagcttagtatgtgccaggttctaggtggtgaaaaaaagccaccaagttccccctctcaaagcaacctcttagtcttcacctccaccctgagggactggtgttatcagctccatggacggatggagaaacggtctcagaaaggtggcactgtttccccaaggcacttggtaccacctggcatcattttgtttgcgtgtcatgtctgcccttctgaagtgacggctcttgggaggctagggactgtttgtcttgttcatagctgtagtccagtgcctggaaatgtccctggtacaaagtatgtgcttcaaatatgttgttgaatgaatgggtgagtgaatgaatgaagtggtgaagctggattcacactcaggttgtctggctctaaagcctgtaccatcactctttgagttctagactggacagcttcacagccccagccagcagccagtgagcaaggtcctgaggttccggaattctcctctcagccctcttagaccatccctgacttcgcacttgccggcctccatcaagcttcactcccattccctctccagcctgaccaaagggaagctgggggatcactaacacaggcattgggggtgggggccatttcaggctttctcttccccctactctgcccacttccccttctccgccacctcctagacttaaagttcctgagggctgggcccagccaccttgttccctgcctctcctgcagagcagccaagcttggaaggggcacatgtttgaaggcatggaatcccatgcacaatggaaggctgcagggcggcccatcatagaatcagagctcaaaggaggcactgtggtttgagtaggttgctctgtgcgcccctctgccctaggccattgtgatcagcggttaccttgggcacctggggacactctgccctctgccagacctggaccccaaggtgggcccaggacagcgtgctgccgagcaggtgtgcagctgtgtggccagccgtggcacaggcagccagagggtagtagagggcagcataatagaacagtcccagtatcttccaggcccctggaaggtgaaacaagcagagagacccatgctggaggggcagacatggggcctgcagtgagcccacccaggcctctcttcggtctccagcttccaagcccttcagcacgttcagtgggcaagaacactaggttcaaatccaggctctgactagtctcaactctgtgatcttgggcaagttacctcttggagcctcagttttcccatctgtaaaatgaaaataatcacagtatattagcaagggcaaaatgagaaggtggatatataatgcttagcatggtgcctgagcaaatactcaatttaagatactacttccctggctctcagttcctccattgcaaaatggggctaatatgcatactttgtagcatcgttgtaaagactggatggtctaaaaaggtcacgtctcaggatagcagcccatctcattgacagctgttcctgttactctcatctccttgagccaagcttaaaactccgagaccccaccctaccccatcccatcacaccaaccccagggcctgggggtcagtgggtaccttggctgggtgctgaggcgagagtcaggaagggcaatgcgtcctcgtcggggagcagcaaacacagggagctcaggaggaccatgaaaacagcagcaggcactgcccggggcctgtccccagccaagaaatccacagggctagcacagaggcaaggacagggcaggagggagttgctcagcccctgcacccccattacctcccagctgtattccataaatcaaggaggtggagtcagtcccactttctagatgggggaataaggccccttcattcattcattccatagatatttgtggagtgcctcttatctaccaagctctgggccccgtgccaaagggacttgggacacacatacagtgggaagaagccctaagactgctcctccgcccaccctggaagctccaggaagcagccacctccacactaattggtctgtctgagctggcaaaccttcagagaactcagcgagtcacaacatccttgtacaacagccgccgccctgggctgggtgtggacccggggcagagggcagacagcgggcatagctgtcccaggcatcacccttctgggctcagggcaagccactcagacccacagcttctgcactgcagcttgcattcatgctctgagaggttcattctccctcaaacactgccccagccagggcaagctctttctggggccaaccagagaccccaggctggttccccacaaaaccagcacagcaagacctgcctcggtgcacagtctgggtctgggatgtgaagctgtctacaccaaggagccacccatcacctgccccaaccctttggtctctcgcacactagcttgcccagccccatctcctcaggatcatgcctgtccaggctctggagtcacagggctgaaggagataggagaagaaagctccagctataggggctagatgtcagtccccataaatctgccttcaagcattagggtccaggtgataccctcagggaagatgacggtcaagatggcattgggatggtcacgtcaatccacacatggagggctgcctgagaaggtacactctgacgctgggtcctgtcaggcttgtttccctagggtctgggttggagtcctttctcccaggcgggcttgagcgagtccctcccccttcctctgggggtcctgactaaacctggagacctaggtgggggtgaggaaagctccaggctgagggcgatagggatgtcattaaagccagagctgccttttaggtacctaacaaatcacccaccctcccagagggaccctgtcagctgggtcccctgagtgggggtgcccaggccatggtacaaacctgggcaggccgggcctgccacgcacacagtcaggccagagctggcggcgcctcaccagcatggccaggagcagcagcacaaggatctgaaaggagagtgcagaggagggcttggggtgcccaggcctcccctgagggtctgagtttgagggcttggactcaggccccaggatatcccctacctgcccagtgcacactcatgtgacatcttggggactggtcaaggggtgacagacatctggaaggttggacttgcatcctggtttgggcctccaagctgggagaactcccagatagctccccccacccaggatcttccagggccccccttcaccagccccagtggggaacacaggtcccactgcccaggctggcagcagcttgcaagccaggttcaacttgggttggactcactgacagcgaggccaggcaggcgtggtacaggccgggtggtatgctggtgtggcaggagggcacttccctgcagagcaaatgaaggctggctcaggcctgcgtcaggcccccctgggtgtgcagatgggtctggggttcaagactgttcacactgaggctttacccactacctccctcaaccctctgatccctcctacacaagccttcccagtcccaccttctcagggtcattctggggccctcgtgtccctgtgatgtgccagccccatgccaagctctggggttataagactaaaggacatgggaagctcccaggggaagcagagtagaccggctcggcctgatcacttattctcttttttttttttctggagggacagggtcttgctctgtcacccaggctggagtgcagtggctcgatctcggcttactgcagcctcagcctcctgggctcaaaagatcctcccacctcagcctcatgagtagctgggaccacaggtgtgcaccaccatgcctggcatttttttttctgtatttttagtagagacagggcctcaccatgtcgcccaggctggtcttggatttctgagctcaagcaatcctcatgcctcagcctcccaaagtgctgggattacaggtgtgagccactgtgcccggctgagcacttattcttgctcacccagatgcttcctgtccttcaaggcctcccctctccagggagcccctctgactgctcctggtctcacagacgtcttctcagaactgcagttgagcacactacctgggtcaagcagtcaagggtttggccctgtgattcgccctctactcactgccatctgaggttggtctgtgactaaaatgatctcccctggtccctctcttttcctgcttccctctcattgagagcctccatggacagccatgcaggttgcccactgcacaaagatgctcagccaagggaacgagcaggccaccctgctcaccaaacccagcacctgctgagctgaatgcacctaactggggatccctttctctaattccacagaggctccctatggcctggcaatggtcctgcactcaccctggctgagcgcagaggtaaacccacagtggagataggggtcactgaggacaatgaaaccctccgcttccccagcagaatcatgtggtggagaaagggagtgaggcaggagtcctgagctcagggctggccctggccctgggagagtaggcaggactgggtccctggtgagcagtagagctccgggttttcccagcttgggcctgggagagccagagggagggtggcagcatgggtgaggccagtggggtctggtgggcgagggcctgagatggagcctgggctgccgccagtccctgcctgcacagagggcttagccgcccaccaaaacgccctccactgtatgaagagaggcatcaaggctgcattatccaggggagtgcagagccctgggatgctctgctgggtcagctcggtctgtcctgctcgctttctctcaggaaatcccagcgggtgagcggtgggaaagaaaccagtcacttggtggagaggcagagtaagtcagctctgggcagcttcttggccaggagaccagcctcttcccaaagtagaactgggatcgtgagtagcagccacactgactccagtgtcagctccccacctccagctccaaggcctctcactctggtgcgtagggcagccctccctctcagccggcatctccccgcatgactaggtcccgctccacctttacacctgggcccggcagggacttggaaaactgtccctggagtagtttgaccattttcctatggaccttaccccaaaccacccctacccccagaaatgccctccagggccctgcctgggggagcctctggccctttctgtatcacctgaggtccccatctgacctctcagctcagtgtgaggggtcagatggggatctcaggtggcatagaaatgagcaaatatttggctagtggcttgtggccccactttttgtgccatgggacaggcaggatggcacagacataaagaccttggagagggtggtgagcttgatcctgggacaggcacagcaggtgctgaaggatgcagaggagggagaactttgggcaaaaggaggtggtatctgattggagtttaaaaaatggttagtggctgggagcagtggctcacgcctataatcccagcactttgggagactgaggcaggcagatcaaccaaggtcaagagtttgagaccagcctggccaacatgatgaaaccctgtctccactaaaaatacaaaaaaaattagctgggcgtggtggcacgcacctgtaatcccagctactcgggaggctgaggcaggagaatcacttgaactggggaagcggaggttgcagtgagccaagatcgcaccactgcactccaacccgggcaacaagagcgagactccatctcaaaaaataaataaataaaagttggttagcatctctttaggcaaagaaggggagaggcagctccaggtggagggaagtgcatgaggaagcagagaggcaggcgacaggcagcgtggctggggctgggcaggccttccagtttgattgcagcccagaggtcaggtgagatgaggttacagcaagcatgggaggccccaggaagccactgagggtgtttgagccattgaatgttctggattttaggacatttctgtggctgactccactgccatcagtgttcatccaccccaactccagcctgagagtgctggggcactgggcactccggagttcttcaaagctctgatgcaacatgtccccagggtgtctgactcacacagacagaggtgaacccaagttcatttccttgggattcccctgagctcccaattttctgctcccactttgagggcagggggatggcaggcagctcaattggtttggctaagtaagtagattcaaacaaatctctttattcttatggatgtcatgccctgcagtgggagaaagaagctgaatcttctagatgtcacccacatgagggactggactccccatcacccagtgcctgacatacacacaactttattctgagacaacagctatagaccacagctacatttacaggcacctggcccccagccagtgcccaggccctgaggctcccaaggacacagcttcagattagagccttcacctaggtcagaaaccatcctcatgggttcctgggcctgtcctcattctggtctctcgcaggccacacatacacagcaggatatgtggagcccacaggctctcggtcagtcaggcaagatgagtggggagcacgcccttgctgactgcaggctattttccaggtggtcagaaccctgagtcctccaaacaacagctccttccccgaggcctgggtggagcctctgtccctgctggatgacccaagcccagccaggccgcagccccagcccctggggaggcacgcaaggatttttccttctcaagtttcaggttttgatggagaacagatgtgcacacatctggctcggcaacccccagcctcacctttctacttctccaaaccgtcagacagagcagggagataagggatggggccaggcctgggaacaacaggggagaactggctctgggtcctacacaggcaagacatcctggcaggaggtgggggacacagaaggggcccagctcctccaccagggtgcccagactaaaccccggtagaatggacccaggcaaagcagctgtggctgggttctcaggccaccctggggcgggctgccttcctgctcccaccctcacctgggctggcctgagcacttctgctaaagggaataggctctcctcatcctctgagaccatccaaagacaacaagggtgcttgtttcctcagtgacttctcaccaggctttctccctttggttctctgccttccccgaatcccccagcctgcccagagaacttgacacttggaaacaccacacccaaatgctcaccacagagaccaataaccccttgaagggaggtctgcttgcctcaactgctctcagcagcttctccatcctggctatgggccagaatcacccagggagccatccctgcagatctgaatcatctgtatttttaacacgtcacacatcatacctaaggtgaccagccttaggtgtcttaacagcagggtgagggatgttgttctcatgtaacagaggcagagactgaatgaaccccagagaggctgtgacttgcccaaggtcacacagcaaatgagtggcagagccagacctagcagcccctgcccaggagctgctccctggccagttgcaacctctgccatcaccccattctgatggctgacagagtgaggtggggtggttccacacttacccctctggctggagctcctcgcccccctggggctcatcgatgtaccagctgccataggagtagtcctctgtggccccgggggaggtctggttccctgctggctgggacgacattctctggcccttctcctttgaccccaggcgagagaaaaaaaaagccactacagatgtgaaaagaggcttaaaagagaaaaaaaaagaaagaaagacggaaaacccaaacaaagaaacatttctctttaatcctgaaggttactttcttacttttagctctctgggaaaagcccgtctgggactgagggcctgagcaagctggcacgggaagaggacagggcctctcgtgtcccctcctcccttcccgcccatcgcactggtcctgcagagatagctgtccccttggggccccggggctcccgctggcgcatctgtctgaccaaccaccagcaggcgtgtgttcaaaggaccattttcaaagaaggcttgtccagtctgagctgcctaaagagacgccccttccttcccctttcccaagcccacctagacagacccacagacacaccagaagggaggcccagggaggaaggagttgcagagatgaaagggtaggcagcccacggccagctccgcactgcctgcctgggccctcccagctgggctcccttgagcccctcccccagcctcagcctgcccctttctggcccctttgggcctcggtgatggaaatacaccataatccttgacaaagcccccctcctgggggaggaggccccagcaccattggcggcctgagccctgcaagggtgtggccaggagccacccccacccccgcacctgacttcacacacatacctgccttcagcgcctgccccagagctcccaagcccctgcccgccacatctgcagtgccgcacacagacaggagaccagcattacagcaacaaccgagtgagacggaccgctggggctgggctggggcggaggcagggaaggggaatctgtccgtttcttctcctagggtttccatgaaggaggcaacatgtgtctcattggtaaaccctttttgttcctacaagttgatttcacaaggagataactcacccccacaaggcggaaattagctctttaaacacaaaccagacccacgggtaggcaagaggagccccgcctgcctcctgctcctcctggagtgaggttgagggtgagcaagggaaggtctgggccagggaggagggctcctccgcattctccctccccaggagcaggaccctgccccagcctggaggaaggggcgagaggcagaagaaggtagaaagcagttctcaggccactgtccctggtggaggtttaggcccctaaaactgtgagggtctctgtccttccaataccctacaaggggcttcggcttggaccctgtcagctaaggcagtcattcaacagcttttttaagaagacattattcatttagtcttttaacttaaatttattgaacacacactatgtgccagcactgttctgagccctgaggcaggagagatgacagttcagcggggacacagccagataactaaatcccctccaaagtctgagggttacaaagggaatcacaggttgagctggtctgtaccatgggaaaccaaatttagtccaagagcatttggggatggggggagattcctgaagaaaagaacctttccgtggtgatctgaagggcaggggaaagtccgctgagcagagggtggcaggctcaggatggggatgggggtgggggaaagtgtgttccccacagaggaaacagcacgggtgaagtctcagagtagacagggcttgaaatcctggaggctctctttcaaattcccaagcctgcagggcaggattaggggctgagcaccctgctagcctgagttcctcccccttcttcccaaatggcccttcttgcaggaagagggctctgttgctctccaccatcccacagagatatcagcatctgctgactcagagctgaacccgagctttatttgatgtaatgaggagcccacactggcccttctgatcccagggatgcgggaaacttgccttccaggcgcgagtgtgagctcccggagggcgggactctatccctcccacccctcctcctgccttcccctgatgctcagcgcctggcccttgggtaagagggacttcagaaattgagcttggcaaagccattgcttgttctggcggccagtattcatttgtgggcctgtcctatacaggcggctgctgtgccctgaggttcaccagctgggcttcccagagtccccgtgcccacaccagaggccagcaagcccttccctgctcaggggtctcagactgttaccttagggagcagccaactcccatctgattttaaatccacctccaaccattggagtccagttccagacagggagcccactccctctacaaggcagcagtgtcaggggttagacatccttgcctatcagaaaccatgccctttggccaggtgtggtggcttacacttgtaatcctagcactttgggaggccgaggcaggtggatcacctgaggtcaggagttagagacccagcctggccaacaaggcaaaatcccatctctactaaaaatacaaaaaattagccggacgtggtggcgcacacctgtaatcccagctactagggaggctgaggcaggagaatcgcttgaacccagggggcagaggttgcagtgagccaagatcgtgccactgcactccagcctggacaaaagaggcaaactccatctcaaaaaaaaagaaagaaagaaagaaaagaaaccatcctcttccttggaggaagcctaactctgccttccccaggctggtttggcagcgagcaagatgagtcaaggcctgcaccaaatggaacctgatgtatggtagggcttaggggagacaacaccagaggggaagtgaagtgggggaagagaagagagacgggagttggctgtttgagacaaggtggtcagggaaggcctcactgagaaggtggtgtgttgctgataccagaggggagagagggaggtaccagttgggcactgtgttcatctgtttcgcattgctgtgaaggaaaacctgactctgggtaacttagaaggaaagggggtttatgtggctcacagttctgcaggctgtgcaggaagcagcacggcaccagcatcagcttctggggagggcctcaggaaacccacaatcgtgatggaaggtgaaggggggtcaggcaggacacttggcaagagagggagcaggagagatgccaggcacttacaaatagccagctctcacatgaactgatagagcgagaactcactcattaccacagggagggcaccaagccattcaggagggataccccgcaatgacccaaacaccacacaccaggcctcacttccaacactggggtcacatttcaacatgagatttggagggcacacacatccaaaccatatcgggcactgaagaaaggcaatcaggttgcctgaaggagcctccatctgcccaggggctgcagccaggctggcagaaagggaccccagctgagcccaggcacagtcccttccccaccccccacggagagcccagtgccaacaataccacctccctcctcatgggaagacacagaggccaccaagggaggccctaagcagaggggaggaaatggtgagcttcgtccttttcccctggtgggggcctagcaagcagagcgcagccttgtgcctggtactttggccagggcatagctggaaggtccagaggtaagggccaggtttctgcatggcagtggagaacgcctggttggggaggccacctagccggatttgaaccctgggactggctatgtggccttgagtgagtcttttcctctctgtgggtctcactgtcctctctcaaatccggcctggagattctccagttgtgaactctccccacaaggcccccgtccctgcacaccagtaaccagttgtaacaagaaggtcacagagagtggttgtgacttcctaggtgcccccattgcctcccacctgccccctcctggcccccagctgccctgcccagtctggtgcgggcagggtgggcaggctgggttgaagatccatggatagcgggtggccgcgtggctcaagctgcaaggtgagcccacttcttgagcccaaggtacctcctcagcttggggctagaatcgcttggagctcccatctgcaaaatgggaggctcggctctgagctgttaagaaagatgctacctgggaagacggcaggaggcaagaagtgttaggaagagaaggatggtaatgatgtgcccctgaagaatttctccaaaggcctgggcagcagagtcaagggcctgccctctggagctggctttaaaggggcactgatacccaggaaggcccagccctgccctcaggagagcaaaagtgctcaaaagacagaactgccaaagcctgaggagcggggagggaaaggaggagatggcttgggcagtcttgcaggctccctggaggagggggcctggagcagggccctgaagccatggaagatctggaatggtaacaagaatgaattgacacgtgtctcaggagtgccaagaagggaagtctgagagacaaggagagagtagcataagggtcagggcagggctccctcgctgtgaccagcatgaacccacgtgggcactcagatgaggctgatgccagtatccaaggagcagctcaaaccagcaggtctcccaactgggcacagattggcgggtggctaagccctgctcactatgggaggaggtcctaaaaagcttctggactctgagccagtgaaggccatctgccatttgggcttggcacagagctgctatgcccctcgggttggagctggcccatgaaggccttgggacagggcttccttcctctcatgtttttgttcaagttgattaaacctgaggaatttttgcatccaggagcagaggcccacgtgcatttctgcgggagcctgtgattatcaaatcctcaaagggcaaagtgccaagcttagaagaagctaacagcaggccagaaggaatggggaaggccagcagcatccccagaacctcagaaacatcccctcaaggactcccagatctcccagagaacctccagaatctcagcaacatttctgagtttcagtaatgccataagaagccctgcaacctcagtattgcccccaagaagccccagaccttcagtaacacatcagaaccactgcaacacctcaggacactcaaactctggcaaactcaaactctggcaaatcaaccacagattggaacaagatgttcaaaagcctgtgaccatttgcagaaaggccagagacccccgttgctctccaccctcccatctcagcccttgactctgagtccagcagcaaacccaatagtttacaatactcaaacctcaggtacacccccaacttcgatagcacggaagagaacacgcaagagaggcgttccaggagtggggggatggccactgtgcccacctgtgcagcccagtccccttgagagtccatgaataagcagccgagagagtcaacctcatgcgggcccgtgagcttggggtgtgccctcagtggcacagcacactcacacacacatccaactgcccttcgcacacatacgtgcttaattctggcaccagaccaagtctgactccacacagtgggctggaaggcagtgtcgtcggctgccgtgctcacggcaggaagagtatgggtgactctccacctcctgtctctctacctcctacctcccctgccatgtgggagggtcagaagcaccatctgatgtgcccttcctgcaattctcatgcccccctcaccaacagcatcatcataacataaaggatttagaccaggctgttctggtatgagggtggacactggtgaggaggaggagggtagccggctgtgccaggggagcagcatgttctttccctcccagagggctaggctagtactgacctggaggagggaggcagatttcagctcagaacaaaggtagccttctagagtagtgaggcccccatcaagggaggcaatcaagaagaggctgttaacatcaagatgcaacagagggcttcctgccttcggaggactagacacaaggccatgaagattccccagctataagagccccacgttctccgttcccagcacgttcctccctgggctggccaccgtggtgtggccttgagatgtaggctttgtgctgccctccttcctcactgaggacattgactgctgggcagatcccctgacttctctctccttgttcccttgctgaccacaggacagggctctccaccaaccttttgcccacagccagtcagatccaactcagacaggactctgcgaatgtctcctgccttttggagctcctgctagccccccagtgtcccctgagggcagcccaccccaggtctccaaacttactcatcagaattgctccagcccatcactctgctcacttcctgcccctaggctctgactcctgctcacttcccaccgcacaccccatgtgccttctcgctgttccccgacctgttccaatcccacctggcctcccagacttggctccagcctacctccaatcaagcgctctcctgacctctcccttccttgtctctttcctttcctttattgatctctcccggaaacttgtccctccaggcaagcagggtgctcccaacacggggccttctcctctgagcccagcaccagctgggctgggatcctagaggggtggctggttgtgtggtctcggcagttggccctgagaagtgtccccagcacctgctttaaaaggtgtttgatct

SEQ ID NO: 2598 - DNA, 23414 bp, Homo sapiens; identical to SEQ ID NO: 2594

SEQ ID NO: 2599 - DNA, 668074 bp, Homo sapiens
agatggcatcctcaaccaaatgttttgaatttattataatcgtgcttctctacaactaatgattcttgtggtttgcaaaccatgtctgcctttatttacctacacaaacacggaacagaatttccaataggagaggttcacacagctaacaaagcatagagtgtgtgacctcaataaggcattcaacaaagacacacgccgtatttccctctgactgcgttcccttaggatgctctgatgttggcgtcgcattcttctaaaagtagaatcaaatcttcaatcaggctgtgttctctgccatgtgtcactctcataatatcaaaagcctaaagagaaaggacggaagagagattagaccccaaaataggtgagctcaggccattccccacctttaccccatgatgccaggggcctggtgaaccccacaggtttacagggtgaacagtctttaacaggcttacagcactgtggttctcccagctggaaagtcacatgaaaagggtgatttctgaatgtggtatttggaaagcagactcactattcgagtcatgctggggcccagtgacaatcgatgatcttcaaagactgtcagtgcacaggtttggtgggtagtcacagggataagaagagttaccaaaatgattgagtcatatgaaagaccatgctgctaccaccttaaaatttttctttattgcacactccattcaattctcatctatatgcaccaggattattatatacatgtattctcacattttttttcatatcatattatagcactggcatttcaacagtcctctccttcactgctcatatttggtccattattaaatcttgtcaactcttatcttcaaaatatttctgaaatctgtgtgggcttatgagtacttcaataatagagtataatagaagtaaagcaactgacttgtgagactaggtcaaaaaggcctctgtgttgtttactggtcagtatgtttgctcccagaaccaagagactccatgctgcaaggaagcccaagccacatagagggaggccgtgtacaggcactctggctggcagtcttagccaagctcatctttcaagtcattctagacaaggcaccagacatgtacataaataaaccttcagacgattccagcacccagctgaagactgccagatctgtcttcccagatgaaacaccagacattgtagaaaagaagaaagccattcttatgctgtgtgccaattcctgacacacagcatttgtgcaataattttgccgttgtttactccattcagttttgggatggttatggaacaacaaacaaccagagtatccttgaaaatatttttgtaataaataagagataagcaatattatcctgccctgcccaaatgggggggtggggtggggtggggtggactggggagaagggagggacaccagaaccactgcatttgatgtaaatgtgcccaggagacttgtaaagatatgactctggtggctgttatgcacccaaagtacctggaagtggcactgaggctctcagccttagctacacagcaggatcaaccagggagcttcaaaagagacaccgagggccagaccctgcacatcaacagctgaagcctgctctccaggaatgaggcctaggccccaggagattccaacatgttctcaaggttgaaaacaactgatagagcaaactctcaacaaataacatcaactactcatgattcagtgttaatttatagccagaagaattaccattttaattgttgtatataatgaatgccatcatgcttataaaccattatttactaagctactcctggaaatttagatcacctccaattgtttattaggatatgatgcagaccttccagaatagattttttgcctttcttggatatttaagagcaattgctaggggtggaattcttgagcatgaacatcttgaaaaccacagagatttcagaccttggtggtcatgtggtgagacgcctgcattttgcaattctgcatgcaggaaaactttccattctacgttggaaaaacgctgaagcttcgagaaacaaagcatttcagggggatgggtaatttcaacctctgtttctggcttcttttttcacctcttgaatgttccctttaggctggaaggaaaacaggcagacagagggggtctagatttgctgctgagagagagagaaagagagagaaagagagagagagacagagagacagagagaaagagaaagagagagagagagaaagagagagagagaaagagagagagaaaaagagagagagagagaaagggccagcgcctcagaccctggcctctcagcctggaagacagctctgctctgagtccagttgtgaccccgcactggcagtctggcccctcaccctgtgacactccagctgcaaagcccagaaggtggctggagctgagatgctggcggtgggaattgacttcctattcatgcgagcaagtctgctctgtgggtgcacagcatctgccagcaaatccctaggcagggggctgtccggagtgcaggggaggagttgggaccagcccccaccttgcaagcagcccagctctatgagattcccctgggcagaagattaaaaacaaatgtttgatggcattcatggagcacatgcctcgtgttttattctcttttctccacactgccctggatcctccgctgctctggacatcttgaggtctgaggcagagacctgtgtgacagcacgattgcggaaagagaaggtttctcagatcagagagccttcatgggaaattttcttacttgaaagcactcttagatgttctcttcccttttactcaacaaagagccagagtgcttgtgatctggcaaaggaagatgaatggggcagaatcactgcctggaaagatctttgcagagagggacgtaaccctccgtcctgaaaaaggccagacctaacctgctcggcctcgcctccctccctgccctcacagaggccctcggctgggtgagggcctggccttgttgctcagaatttccagaccagcctcttttttgccctcctggttacattccccaggttccccatctgaagaatgatctgtgcttctctctgacttgactcagaggctaaatgacaaagccatcttcttgtcacttcaacaacataagttcactggcatgctttgaacatactacaggctccaggcttccttcctcgctcttttcttccagttccagtggtgagtttcactttctcctcttttgcagctttaagagtaaggtctactccccactgatccagtatattcctgttcatggaaggggcagacctgcccatcccacagtacggtaactacttccagttcttcagccattctggaattagagccacagccaggaagggggagtttcctggccttcctccagcttcacatccacacctcacagcctgcttccttgaggaaagaccagaaggatcatctagtccaataccctcatgttatggaaggaagtgcttcctgaggtcacctggcttgagagttagactaaggatgacctctcggctctcaggactcaacccagtgtgtccattccatgactgcattgtgcagcctccccgtatgaacagactgcagtgaccaaggagaggagcagaggctctcctggacatggctgcagagataccctgaggggacacaggtgccttccttgtcaagatgctgctggtcatgttctgtgttctcttacttgatgctgaatgcatcaccagtagcaaaggggaacaggggcaaccctcaggaatgtgtgtgtagagtctgagatactaagtttagaggatctcgtccatagggtggctagaaacagagaggaaatgggtatgggtaggggcagagaactaatctgaagcaactgaaaaaaaaaaaaaagaaactacatcatctgtctagaaagtaaaacgccatatagatttgattaattcacaagcaaacatacttttctctgaaagatgggcagatgtagatgagaaagggagagaaaaacgagaagaaagaagtaggattcagtaatgtgcaaaatatgttagtgactgtgtgtgcggatgtgtgcgtggatgaatggtgtgacacaggtcagcaggaagctgcaattcacacctggtgatgaggacatctggtccttgtcttgaacatcacctgggcctatgggtgagctggggcagacagtcctcaacaatgtacggagagggccctgtgtggccctgggcacagcccttcagcactgggtgagctggggcagacagtcctcaacgatgtacggagagggccctgtgtggccctgggcacagcccttcagtacagcaggaagatgaggagggcttcccctcacattaccatcccccaaaaaagttacaataaatttctgacaaacgagagcaattgtttcaagtagctctgtgtctcccttctcctaccactcccatctgtcacccatgcgcatgtcagagaggacaattctggtttaatttcctgcagtagcatataaaacagattaaggaaatataaaattggagcaggctggtgttgggaaaagcttatctctttccattaaattttattttttttaatggtagcatttaaaaagagcctgcacataatctttcacagagcactcatttgaagcctccaaggagggtgcctgctacacccacatccagactcgaaatgtcacatgagaaaagcagcatagcttgtctgccacattacaggcatacagttaactcagtaatagagaaagggtccccagaattgatttcaatctcatctgtttttttaagtaattttagaattgtggtcatatattaaataaaatgaatttaaatcaaatcataaagttggaaacaatatacctctcctattaattttaatatgaatatattaagcttatcaaggatctcaaacagtttctaccatgagcttgaggaatctagtaagtgacttcccaagtatgatttaaatatggatataaaatcagagggaaaagaaatgtatgcatgataagaacccctggaatcaaatcacgacgggaaaaaataaagcaggttttcttattctgcccaactcagaatgaaagaaaagcagagggtggggcacagggaggaggaagctggtctggggcattcaaaggaggaaatgcaagaagcaagaggtacaacacattaagcagctctggaggcacaaaaagccctttgcaaggacagcagagaatcccaaagactttgatgatccacctcagctcagcagcacccctggagaccccactccactctacatcttggataacttcaagtgtgtattccgctggaggaatatgtccttttgggaggcagaatttccttagagataacatctacccattcattcactcaatactgtctgagcagctttaatgaataaaacttggcccttgccctgggagaagctctggcatagtcagagggacagaatgtaaataccagatcattgcagtggaacagtgtgtgttcaacagagatgcaaagtgctggggcgcccagaggaaggaggaaccaggtggccccacggcaccctcaggaggggttacagatgtggtgagctcaggtctgtgctttccagtggtagtagccattccagaaaaagcatggctgttgtatcactgtttaatcaatcaatcagtacatattaattgaactctgagagactctgaagaagttatgtttcctcagctaaataatgagactggacaatataaattctaagggcaacccaagtcccaatgtgttgtacaatgtgccatgccagacacagctacaaggcgtggatttggttttgtttccaaatattgttactgatttctaatttaattccattgtggtcagataatttactttgtattaacttgaatctttttatgtttattgatatctgttttgtggcataaaatggtctcttttggtattatagttacttaaaaatgtgcattctgttattgctgggtgaagtgttttctaaatgtcaggtcccattggttgatggtgttatggaattattttgtatccctcctcagtttctgtctagttgttctaccaactgttgacagaggaggtctgatgttcccagctgtgcttgtctatttgctcatttctcctttcagttctatcagtttttgtttctcatgttttgcaactgtgttgtttggtgcatacatatttagtactactatgtctttttggtagactgacctttttttcattatacaatgtccctctctgtctctcataacattttctttgctctgaagtctactttacttaatattgatatagctactccagctttcttttgattgtgtttttataatgtatctttttccatcattttgctttcaacctatttgtatcattctatttaaaaagaattcttacagacaacatatgcttgagtcatttgttaaaaatctgttctactaatctctgtcttttaattggtatatttaggcaatttacatcttttacatagactactgacataatttacaatgttattattaatacatcagggcttaaatctgccatttaattttttgttttctgtttgctctctttttctttctttttcctgcctttctgtgggttaaacttttttttagaatttcattctctagtgcttttgagtgtattactttatatagttttgtggttgctccacgtcttattatttatatatattttatatatatatacacacacatatatatgtatatataacttgtatataatatacatgtgtatgcatattatatatgtatatatacagatatatatgtatataacttatcatactttactagtgtcatcattttacccattgaactcaagtgtagaaaccttccctttacattttaccctcccccactcccccatttgtaatacaattgccctaaatatttctactacatacatttagaatcatatcagatagtgttataatttttgcttcaactatcaaacaatctagaaaactcaaggggagaaggaaagatcattttacttacccacacttttgctgaccatattctttcttctttcctgatgttccaagagctttcttttatcattttctttctgtttagagaacttctttagccattcttttacagtaagtctgctagcgataagttcttttagttttccttcatctgaaaatgtcttgatttcttcttcattcctgaaggatattcttgctggacaacatacattctaagggcaacccaagctttgggttaacagttcttttctttcagtacttgaaaaaaatatgctactttcatctggcttctgtggtttctgatgagaaaatcactgtcattcaaattgtttttcctgtacaggtaagttgtcatttttctcttgctgcttttaggactttttttttttttgtctttagttttcagaagtttgagtatgatccacagtcttggtgtgaactgctttcggtttatactgttcggggtttgcttagcttcttaaatctacaggtttatgtcgcctgccaaatttgcaaagttttccactattaattctttttttaaaaacaatatggtaaagtacacaaaacactaatagttaccattttaactatttttaactcttgagtagcattaagtacattcacattgttgtgcaaccattactactatccatatagccataacttttgcatcatcttgtactgaaactgtgtacccattaaacaatagcttcccatcccctcctcccttcacactctggtaaccactgttctacttctgtctctaggtatttcactattctaggtacctcatataagtggaataatatgatatttgttcttctctgtcaggcttatttcactttgcataatgccttcaaggttcatttatgtgtagcatgtgtcacaattttattcctttttaaggctgaataatattcccttgtatgtatatatcccattctatgggttgctttttattttgttgatggtatcctttgatgcccaaaagtgtttaattttggtgaagtccaatttgtttatattttcttttgttgcctgtagctttggtgccatatccaagaaatcatcactatgcccaatgtcatgaggctttttccttaatgtgttcttctaagagtctagtagaagcttttgctcatatgtttaggtctttgatccattttgagttactttatatggtgttaagaaagggtctaactttattcttttgcatgtggatatgcagcttccccaacactatttgttgaagagactgtcatttttccattgagtggtcttggcatccatgttgaaaatcatttgatcatatatgcgagggtttatttctgggctctctattctattccattggtctatatgtccatctattccagtatcaccctgttttgactactgtagctttctcgtaaattttaaaatcaagaactgtgagttctccatatttcttcttctttttcaagactgcttttggctatttgggattccttgaggttccatatatatttcaagatgtatttttctacttcttccccaaaaaagccattgggattttgatagagattgcattgaatctgaagattattttgggtaatattgacatcttaataatactaagtcttcgaacctatgaacatgagatgtcattctccttatttatgccttcttcatggagaataacttattcagttattctcagataataacttacttggttttgtgttattgcaaatagcattattctcttaattttgtttttgaattgttcatttttagcgtttagaaatacaactgatttttgtgtgttgatctgtatcctgctaccttgcttaattcacttattagttctaacattttttggtgtgtgtgtgtaatcttcagagctttctccatatgagatcatgtcatctgtatatagagataattttatttcttcctttccaatttggatgcctccaccattatttcttcaagcactttttccacctcaccctctttttcttttctttctgggactccaatgttagatcttttgttactgattcataggtcccctgaggcactgttcaattttactttttcttcagtatttttttctgtttttcagcttgggcagtttcaattgtcttatcttcacattcaccaattcattcctctgtttcctccattctgttgtggagctcccttctgtttattttgattattatatttatcagttgttaaatttctatttgtgtcttctttacggcttctacttcttaactgagattttctattttttccatttattttgagggtgtttgtaattccttgatgaagcatttttatcatggctgctttaaaatctgtcagactattctaacatctctgttatcttggaattggcatctactgattgcttttattttcattaagattgagatattcctggttcttggcatagtgagtgatttttaactgaagcacaaacattttgagtattctgttatgagactctgaattttacctcaacctgctttagccggctttctctgacatcactccagcaagagaatgaagtgatgacaccctgttactgccaggcgggagtacaagttcaggttccctatctggctccttgttactactgaactcatacttcctggaaggtaaatttctgcttatttcccataatacgacttaatcactgtgtttgcattttatccattattttcttatcttttctcttttttggttcaaaaacacactcttggaactattattctctatttggaggtcagtaggaatcactcataaatattagagccaggggcttccaaacaactctttgaaggtattagtgacaattacgggacatccttccgcatgccctcttactccccctctttccctcccacctccccacacggtaacgtatgatgttaagtgtttagaggagggctttttaacctaggcaccatggatactaagtccatggaagggcttcagggagcctctgaagctgccatccccaccaaatatacaaaaggttgtgtatatttaacttttctctggttagtcagtggccctcatcagattcctaaatagggacacaaccaaagaggttaagaatcactgtagcggattaagacatgggaacaacagaactgcatgctctaaatcagccattgctggggctgaaaatcagggcagccgatgcaggaatacaaggagcaatctctaggacttgcggcctggtgctgtctgttgagatgcagaaaaagctaaaaagatgctcaatgggtaaaatactgcaataaaatcaaatgagaagggaaaaattgtaatacaaaaagtttaaatacagatttttttaaaaaaatggatgccgaggggaaagaagtctaacttttgcaaccagatttttgctgaaaagcaactacactagggccagggtgagggagcctgcagcatgcagggttcacaggaaaaaaaacaactctgattaacaagacagcccagatgggttgtccttgaggtccaagaagtcaaattagtagcaaacaaaagccttctaagaaataaatggaaagaaataaaagtagattagtgacaggagagggcaggagggaagcactgggaagggaccccaggactgtcctgtggcagcaatcacaagaatttcagctgagcccagtggaaatggaagactaaaccaaatcagagctgggctaagtggattcctttcctggaggaggctggagcctaactgaatctgtaataaatttctgtttctgaagctcctctgatttctattcaaactcagtcttcaaaaaccttattcaagtgatttcattccattatttccagggtttctaagacaagaaagagcatcccgagggtgcccgtctgaagatgacatcagtttcaaaaggcaaagagtatagcctcccttttccctctccaggttacccgagtcctgagaaagctcaggaaagaaagactttcttcaggaagaaactgacctgcttctagactcacaggtcacgtgagctttcctagggatggatacattcaggccatccctctgctagcaaatgctcagcaaaggtcatgagaagatctggtccattaactgtaaacagctaaccagcaggcccagggggaggcttttaaagacttctatccattaaaaaaatccattcattcaagcatgtatttaacagaacttgccgtattgggggcatgtgtgtctatgttaggtggcaccagaagacacaaaaggaatgtaaggtcccttgagggattcccactcaccttggggagcaaaacactgctggggagcagtcatagaacataattgttcaccagaggaaccaccgtgtaccccaaactacaaacacaagtactgaacagaccagctagtgggagagtgatcagaacaagagttcctgtaacaatacccatctttaatagtttcagaatgcttgagattggcaagcacactctcccgcattgcctcgcttactcctcaaaacaagtctatgggatagctatcagcttccttttacaaatgaaattatattcagagattaacgcaaatggtgggactggaacctgaacctactgactctaaatccttgcactctttctacaactctgccaggagtgcatgtttgctccttggttgatcatcagaccttggcaagagactcaatgacttttgtagagacacacagcaagtttgggtaaggccaccatttaaccccaggcctcatgacagataatctgatgctgctcccagaatacctttcatttggcatctatcagggtgtatgcctgagcttcaccttggtaccaagaataggaaaagctaacatgattacgaagagaagcttctgaaagaggcgatgcaacctcatcagaagggtgtgagggcagcagaacagacctgggcatgagggatgtaaagggcagtaagagggtcatctgaagggctggtgatggtcagtaccatcagcccaggccacattatcctgaaaatccatagcgagatgtctgtctgggtttgttcaggcttgtccttatagttgagggtattagatgtctccttcagaagttctgtatgcaatagcaatgactaaagcttcacataagaagcaatctaaatcttctctgatttctctcccatatttttccctgagttggcatcatgggttcggttagatcttaagggatttctgcacactgatcttactagagagcctcatctatttaactggaccagtctagaggaaaagagcagagccttggtttctggcctggatttaatgacttgtacatgtctatctcctccattaaattgtacacaccatattgagtctttttttttttttttttttgagacagtctcactctgtcgcccaggctggagtgcaatggtgcaatcttggctcactgtaacctctgccgcctgggttaaagcgattctctcacctcagcctcctgagcagctaggatttcaggcacccgttatcatgctcagctaatttttgtatttttgtagagacgggatttcaccatgttggccagactggtcttgaacccctgacctcaggtgatcctcctgcctcagcctcccaaagtgctgggattatagatgtgagccaccgcgcccagcctgagtcttattcaaagtagtagaagtatttgatcaccatgttgaattaaattgaacaaatacacctggctctgcctctgtgcgactttaggtgagctcttgcatgtctccaaacctgagcgccttcactttccaaataggaatgaaaatgcctgtcccattgacctcacacagctgtcacctgtcatggggactgagtatgatcacggatcacgtacgtacgagcagtattcatagtttctagtcccatataaacacaaaggtctagtctgatcacttacgaacatctacttgcaggtgaccctgtgttgggtgcatcgcacattaggaaatttcctgcacgttgtttttctgtcaggactttcacacagtaggcccttgataaggatttgctgtaccttgctgattcgactggctgacaagtacccccagaccagaaaaggaaagttctccctgaggctgcaacagacggtgcggtgttcttcccccgcctgggtaaacatgccagacatgataaaaagaacagaatagctgagtgccctcagggaatcctagtgttactcccgttggccacacgctgactttatttagagatcaagtaaaggcgctatggctagcattcggcgaaaatgagcactgtggaatctggcttttaagaatcccttcggcatttgtcatttctcttaggtccatgtgggcggctgccagtgttttgggatcagccggcccctggacacgccctgagcaaccctgacgcccgatccttccaccgtcactcttctgcacacaagggcatggcggcccagagggtcctgttaaagtgtcaagcgcttcctatgatacccgcacgccaggtctccatacaacccaccagtgcctggccaggtgagcatgtgagctctcctttggaagggtcacggactagaggagaggaagttctgctgaggtgggaaggcctgggccagacagcagagagccctgggctcctccgggcagaggagactccctgagcgggtgaaactaaccatcgtgttttaacaagctattccaaccctaaaccagttctcccaattagtttcttgacacttattgccagaaccgtattcactgacctccttcgcttcctccctcctccttccctcaataatgaatacttcctaagttccagatcccttgcatggcactgagctggttgccaagataaccacgaagccctcacactctcctgggggcaggggtaagggtggtcatcgggtatgcctactgcaatgtgaaaagggctctcctggcagggtgggcagagagctgtaggggtaggaccacaaagtaacactggaattgggccttaaaggatcagcagagtcctgccaagcccagggggttgtgatgcggagagcacttaaggcagaggaaaaaatagctgtgtgaagatggaggagtgagaagttcagggtcacagtgggtcctggtgaacagcagtgatcactgggtgggtggaaaggaagagaggaagggcggggagaagtggctgcaaaggtgaactgccacacagatggtcaagggcttgccacgcgagggacacggactgtgttccgtgggcaatggggaggaggcacaaacaaggtcaacttgctaaacgtggagagggcacaggagcagtggtgttctcagactggtttgtaccagtggcaagagtaattgttaatattatttttataagaaggttgattttacatttaaaatcagccatggtgggcatgcctgcatcacagaaataggcaaatgtcatgaagcaggttttttccagagtggttgttaaacatttaccagcacacactgggcatgcgtgtgtatgcgtgcacacatacatagagctgctaacaaatcacaaagaggcccagcaacagcagaaaaaaaggatgccaggcagaactatgtgagatcttggcacactcaccagtctcagattcttcattgcttggggaaacatgccttgatgtagctgcagtttgccaactttcatcacttgaacccctctgacgggatggcttcctgggaaaaaaatcctggaagaaaccaaacggcaaacagtgtcagcagccctcacctttgcagtcagcatttcatcaggagactacgaaagtggaagcagacactagctgtgaatgttaatgagctactgaaaggaaatcagctttgcaatccaggagaatgcagtactgaggggaattgacacaggactggtctccagctcctcagaatgtgttttgtgttagggaaaaaaaatgacaggactagaaggtctccctcataaacactagagaagagaaacaaaagtttggagctctgcgttgatatttgggaggggtggggcggggagaacaggtgctaatctcctcctccaagctcttccatgaagcatcagcatcagcactagcacagccctggaacagcagattgcctctcaatatatatttgttgaataaacaaagttttcatcatcccccaactagatcctaccacaccccccttttaaccgcaaagccctttgattgaatctcagctgtggagtccatcatggtacacctttcttatgagcacgtgtgtatttatttatcatctcactggattatagtgctttttattcaggcaccccatctgcgttctccatgatgtctgacatgcaggaggaactcaatccatactggaccctttcacatagaacagaatagaatacggtgttgtcgtggaccaaagaaagaggacgcacacgactccggctatgggctgtttcagaccctgtgaagagctgtattacttcaattcaacaagaatttaccatattggatttaaccaaatatgagcagtttggcctcttctggccccaataccccctacccctactcttagagaatactgagcccccgctgtatatgcagaattgtctctggtggaaatgcctacacacacacacacacacacacacacacacacaaaaccacagtttaaatgagcttttcaggacaggtgcgatggctcacacctgtaatcccagcactttggaggccgaggcaggcggattgcttgagcttaggagtttgagaccaccctgggtaacaaggcaaaaccctttctctattaaaaaaaaaaaaaaaatacaaaaatgagccaggtgtagtggagcatgcctgtagtcccagctacctaggacgctgaggtgggaggatcacttgagccctggaggctgaggctgcagtttcacaccactgcactccaccctgggtgacagagtgagaccctgtttcaaaaaaaaaaaaagttttttccttgaggctgaatcatcccattagacacaagataaacattcctgcaggagttaaaacaatgttacaggacggagcatgatttagcgcccaaataaggcataacttagtataccctagatgtccagttcaagtttgttgaattgaactgagaaaatgatacaagtattgtgaagacaaagaggtgactgatggttggttggactggggaaggcttcctggaggtgggaaattggacttacactggctcccaaggatttggagaggcttggctgggtaggagaagggaagcatatcccaaccgtcagagagaacgagcaagggcacactctaaatgctgcttctccagggacggaggtgcctgcccacagacatcactaagatgacctagaatccatcactcacgcagggcctgccatgtgccaggcgctgttccaactgcttttcatccatgaacccagagaaccccatctaagctctattatataacagtgatgaggcggatttaccaggagagacaggtatgttctctgaaaatgcacacatatctgcaaaccattccctctcgctgaatcttaactcttcctcccatgaaatgtgatatagaaacactttttttttcattcatgctcttaagaagtagaaagcagtacctgggaggaaagtatttaaaccgacagaaagttgggcatgcctcttttaaaaagctgaaaaggggctgggcgcggcggctcacacctgtaatcccagcactttgggagggcgaggtgggcagatcacaaggtcaggagtttgagaccagcttggtgaatatggtgaaaccccgcctctactaaaaatacaaaatttagctggacgtggtggcaggcgcctgtagtcccagctactcgggaggctgaggcagaaatgcttgaatccaggaggcagaggctgcagtgagccgagattgcagcactgcactccagcctgggcaacaagagcgagactctgtcttaaaaaaaaaaaaaaaaaaaaaaaggctgaaaagggagcggaagggggaacaacaaaggagacactgggtcctggatttttcttcatctcttcagtatgccaaggggtcaatcactttacctctcaccccttacgaaatgaacatcattatctatttgtgtagaaatgactttaagatccccagacaaaaggcataagggcaggacgccatcatcagagggtaactgccctggacactttccttgaaaagcacgcctggatttggggtgttatattattactacgaatgtagcatcattaaacttaaaggccaaaaagtgatcttacactaatcatcactccactaagtagatgtctgtcatgtcagttagcagaaggaaagacaatcttcagttctacgatggcagagaaagcggtgtgtcattacgccatgacaggtacctgccccggtagctcagatatttcaaaatgaagtagagcttacaaaggagagcatgaggaagcgcttgtccaggggcacttccaaataaatatttccagggcagcctcacagctctatggggctgctgattgcgggcctggttggtttctggaggcctcccagctgacatagagaataaaaatcatgattccttgctggagtataactccaaggaaagctggtcaagctcactcctgctgggagacattcttcaaaggtgtggccttccatccacttcatggtgtagagcagggatggggagagaagagggcctggaggtagtagtcttgacaggacaaaaagacggtcatcttttgataggattgtcaaaaataaagaccgggattaagagtccaaagtgaagcagcaatcaggtgtgtccaaggaccgtgaggactaaagcaggagtctgagtgagaaggtgaggggaagatgcacctacaagatactggattccgggtccggccccataagcaatctgcagaagtccaaagtgagtccctgcccttggttagcatgtagtttgcaggtgaggcaaatgaaatcatgatatagaaaggcatgtgacagccacctgaccagggcacagtcctggtcaatatggtgaaaccccgtcaatatgtgtgaaaccacacaatgtgtgctctgggagcagccgggaccacagtgatcaggggagtggcagagcctgagtgtgtttccactggagatgatgatgggatcctgggacaagggaagggatggatggttgctctggtgatgggataggaagctgaatgccaaagggcagtgagcatgctggtccggccagcagaggaggggagtgggaagggaggtgcactcaaggccaggctgtgcagaggcacacacacgtgcaaagctaggaactctggacttctcttgccagcagtgaggccaggctgtgcagacacacacgcgcaaagctaggaactctggacttaccttgccagcagtgaggcactaccaaagggggctgaagatattttatcacaatagaaaaccaagaaaattggaaaacagaccctagaggcaaaaatacttgaggtaggatagcagcaatatcaacagaaaagaaggacttggtacaagaaaggttatgcagctgatttaacagaatctggggatccaagggggtgcagtggagtctgagttgactccatgattcagaaatagaaacgcttccacaaaaacatacaagcaaactacataacaacaaaatcattcaacaaggcagtttacttgtttgggtgatataaattttcctttcacaggtataatgctagcaatcacatgttccagaatgcttggcctagattggaaaaaaatgtttttggtgtttctatggtgaataagtgcataagaagaaatgggtttaaacaagcagagaaaagaaggaaatgtacacaccagctttaactcagacccacaagcaccaagatcttactgatatattttacagggaggctgaaagtcagggaactgggatctgaagtcaaaaggacatggagaagaaatatctgatgccaggatctctatcagtctggctgaggttgctgatctctattggtcctacgtgacacaattaccaatcacattattccgttacagatggcagctttggcattcacagggtaggaaaaggcctttgttattcagggctactgctttggtttgaatgtgttccctccaaaattcagatgctgaaacttaatggccaatgtggtagtgtttggaggtccggcctttaagaggtgattaggtcatcaaggctcctccccttgtgaatgggattaaagcccttataacacaggtttcacgaagtgttcagcttgtttgccttccactgtgtaaggacacagtgttccttccctccagaggatgtagcaacaagacatcatgttggaaatggaaagcagccctcaccagacaacctgctggcaccttcatcttggatttcatgacttgaacttcccagcctccggaactgtgagaaaaaaaaaaattctgttcttggtgaattaccgtctatggtattttggtgtagcagcacaaactaagttaatacaattattttttaaaaactgatgcaaaacatattactgaacctgaaaggagaacttaacctgcctatttaaattgtatcttagagtaactaaatagctccagttgtatgaattttagctgataaatgtggaatgatgacagaattagaaaaatcattttgcaactcctggagaattattggactgaggggagaaaatatcacttgatgaaaccattagataaaaggatggtaaagaattttacagtgggtggattaacttgtcaccatctaaatccactgatcaatcttagcaccaccgaaggaggacaactagacactaagtgccatccgacgcagaaggaattatttttgaccacccctcaacgatccttgtgaaacaaaacagaaccccacacactgaagctgaatctaaccaaggctgcaaagtcaaatcccatttcatgcaaaaaacaagggacagagggacaagtagagcagtcagctgaatctggggtacgggaaattctacaaaagcccggacccgggatcttcaacaagtcaatcacatcgaaagaaaaagatggtagcgggagaagaatactgtagattaaaagagatgtaagagatgtaacagccaaatacgaggtgcagaccttgtgtatccttactcagccaagacaactgtaaaaacatatttctgggataatccaggaaatctgagcatgaaatggcattgcgcatggaagaaaaaatgtcctcatttttcagagatacaaaactgaggtacgtatgaattaaatgacctaatatctgagatttcacttaaatatagtcagtcctctgtatgcacaagacgttagttccaggatccccacaaataccaacatctgtggatgtttaagtctcttacagtcagcccatggtatcgctgggttataaatccccaggtccagcatctgcaggttccaacaactgcagatcaaaaacacagctggccctgcatatccacatgttctgcatccagttcaatccagcagagatcactcaacgcagaagccatgaatttagagggccaactgtatcttcagcagattttcagcttccagcaatggtggagtagcttatttcagaccaagcagcttatctgctgctgaaaacacgaaatgctgtaaacaggaaaacatagacaaaaaagtatttttaagaatctgtttgaaggtatcaaggagccactgaggcagcaagatcttgaaaagtcaagatcatggaaagagtggaaggtgaaccttgtattcattggtacttttccctttgatgatcttagagacagagaggctcaccagctgagcaatatttttggcagtctcatagaaaaggagacacagaaactggaattcagggatcaacaatgataacaaggagctccagtaaacattcctggctttcgactctgaccaccaaaggactacaatctatctaggtatagtaaattagaaataaagcagccattacaaagaatgaatcacttcaaatcctgattggattaaggtacgaactctttctatcctgattcccagaagcaaaagtaaacatgtctgaaggagataacatcatcctcagcctcaacttatctcaaattttctgtataatgttctgcatttggtaaaattataacccggcatacaaaaagacaagaactctctgaaaaccaagaagaacaatatagacagtgacataagacctacaggtactgaaatggtaaggttctcatacacagactttaaaatagctcataaatatgtttgagaacttaaataatatgtaagaattttagcagaaaaatcagaaattatgtaaaaaataaccagtggaaattttagaactgaaaaatagaaaactaaaattaagaacttaacagtctaacattagattagtcagagctgaggaaagaattagtgaactgcaaggtaggtcaaatgaacatatccatcaaagatacagagacaatgtaacagaaataaacaggagcagaggtctcatatgtgtcaactggaatctcaaatgagagaaaggagagaatggggcagaagctatatatatacacacacacacacatacacacatatacatacatacatatatatacccacatatatacatacatatatacacatacatatatatacatgtatatatacatacatacatacatacatatggctgtaatggcggaacattttcaaaactaaagacagcaagtcacagattaaaaaatgctaagaattgcacagaaactacaataattcagcaaagggaaaaagaagaaggatgagggataaggtaggcgtggcaaaatcttgataagaattactgaagctggatgatagacatatgaaagttcatattattctatttttgtgtacatttgaaaattttcataatcagggcactggattttactttttcacttttagaaatgatggacttcaggagatagcctcaagtttcaaaagatttggaattttactaaattttgagccttctgtagaaataaaatgatacattcaatgaacagtatataacagccttccaatgctgtttcaagacattagacagacatagacttgatagctagaataatagcagagggagcaacagcccacagtgaacattaaaaggcttcgctttaggtcttaaagcaaatgtagaaactcagtgtcatatgccaggagtaaacgggacaaagaggcatgaagaggcacatagagtcagtcttctgatgttccttaggctctgtttaatttaaagcagctgttttatggaagttatttatgcctttgtggtaggataactttattagtaatatgatatatttttgttgctgggagggaaaaaaaaggtcctaacatcaggaaacaaaaccaaaggggaaaaaaaaagatgggccccacagtcatgaaaccacctcagaacacggagaactacttcttaccatgaccttaattcacccaggctgctactctggagaggtgctgtttcccaagtgggtgatgaatcactgcttctccatcacctctactgctgtgctttgttggtgacagggagatcagggccgtgaattcttgtttccaaaagaaaaagaacttgggttccagcccagactgaaccctcagctcttgtttggtttctgatatgtactattggcctcatatcattaagatggatctgcactcccccatctctatgtgagtaacagaaagaaaattcgtggtgtcacacaggatttgacaacatcacagtgagattttatctaatgcaatgaaatttttcttgcatttcttttacttcataaactgagatacatttctacttctcttaaaaccttccaccaaataggtccttcactcaaaaggtggggtttaggccaggcgccatggctcacacccttaatcccagtgctttgggaggccaaggagagaagactgctccagggcaggagttcaagtgcagcctgggtaacatagtgagatgccatctctacaaaaggaaaaaaaaacaatttaactagtcagccatgcttggtgttgcacagctgtggtcccagctgcttgggaggctgaggtgggaggatcacttgagctcaggagtttgaggctgtagtgagctatgatggtgctactgtacttcagcctaagtgacagacaagactatctctacaaataaatacatattttttttagaagtagggttttcttactcttattagtttgacaattaagagttactttgcacatgatccattattagaatctttaatcagataagaataaaagagactttcaattatctgaaatgtccatgttattcagactcaggagcacagagggtaggaaagcagtagataaattagaatgaaggagatacaagatttgggctgaagacatggctcttccagttagttgaatgactatttcacaactaatgtgataagagattggagagcatctggaaatgtatacaactccatacgaacacaaactagtattattaagtttccagggctagtaaatgtatggtaattagtggaatgcactgttgcacccacatggagattacacactgggttgggggtggggagaatcactaaaaaaaaaaaaaaaaaaaagcatgatagcatcaaaatggtcattttccacagccaaaaacaaacaaacaaaaaaacagaaaaccacttgaactactgctacatttgcctgtttcttttaaaatacaaggggcttgggcagcaacacacaggaaagcctggagtagttgagatgattctgggtgagtgtcctcattaagggaaagacttatgttgcagataggactaagcatccaataatgaaccaaactggggttttggtctttccttctagaaaacacactgagaaactcttgcctatatttgtaacttttatattaagtgtgttcaattattttcacttcacactggacttaaaaatttcctcactctcatgcccgcgagcagcctggctggcagcagggaaacctcaggggctgtgtggatggccctcagtgtggcgcaggggtgaggactggccagcatcttccaggcaggcaggacagtcctccacttcatgtaaacagtttcctcttgaagactcctaacagtgataatgctgtccttttgcctgtctcatatatgacagcactatttttttagagtgtgaaacatttgatgacatcttgaaggatttcaaaaaggctggctagcacaactgaagtataaaataaccataatttagtttaatacatccttgagaaaaaatggtaatgagatattccctacaaaaactgcatttattctgtatagtctatccttgtgtgggataaagttctgaatgtacacactcaagccctccaaagatggtcatatcattcagatcattcctcaagaaacttaacagcagaaagtttaaaattttcagaaaattttaaatttatttgaacgttttagttcaagtttataaaagttggtttatattctactcctagaaatgcagcaggcatggtagctataccgattcaatgggagcatactgaaaacaatgtagaacgctcgatgaaatattctaaaaagcagtaagatgctggcaagataggaaggcattgtcaggccagaatgtgagtgaagaaggactcctgacaaataagcagaatagctgaactgctggtctgctggagtctctgtcctcctctgctctgtgggacttgggggacaaaagagcaagcccactgtctccccagcaggatggggtctagtaggaaatccttcctttcgttcaacttatttggaatggtaagtaagacatgattgccggtaacagaaggaaacagattacatgcaagagtcccagagagctgacaagcagttgcagagtggaagctgaaagaaagccagtggaatgacatcttccatgttctgaggaaaacaaactcctcctctagaattctacatcccaaaagacatctttcaagaataagattgaagagctgaagggtgcagggcttctgatgatgatgaaaatcttctgaaattgactgtagtcatggttgcacatatattaaaatatattgaaaaccactgaagtatacactttaaatggataaatccctctccctctccccacagtctccctctccctctctttccaccgtctccctctccctttcccacggtctccctctccctctccacggtctccctctccctctctttccacggtctccctctgatgctgagccgaagctggactgtactgctgccatctcggctcactgcaacctccctgcctgattctcctgcctcagcctgccgagtgcctgcgattgcaggggtgcaccgccacgcctgacgggttttcgtatttttttggtggagacggggtttcactgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctggctacaacctccacctcccagccgcctgccttggcctcccaaagagccgagattgcagcctctgccccgccgccccgtctgggaggtgaggagcatctccgcccggcagccgccccctccaagaggtgggggacacccccacccggccagccgccctgtccgggaggtgtacgcagcaggtcattgagaacgggccatgatgacgatggcggttttgtcgagtggaaggggggaagtgtggggaaaggaaagagaaatcagattgttgctgtgtctgtgtagaaagtagacatgggagactccagtttgttctgtactaagaaaaattcttctgccttgggatcctgttgatctgtgaccttacccccaaccctgtgctctctgaaacatgtgctgtgtcaactcagggttaaatggattaagggcggtgcaagatgtgctttgttaaacagatgcttgaaggcagcaggctcgttaagagtcatcaccactccctaatctcaagtacccagggacacaaacactgcggaaggccgcagggtcctctgcctaggaaaaccagagacctttgttcacctgtttatctgccgaccttccctccactattgtcctatgaccctgccaaatccccctctccgagaaacacccaagaatgatcaataaatactaaaaaaaaaaaaaaataaaaaaaataaatggataaattgtaagctgtataaactgtctctcaataaatctcttaaaaaggataaagatgaaataaaaatatctttagacaaagaaaaattgaaaatttgtcaccagatcttcacaaaaggaatttctaacattttagttgaaaggaaaatcatcccagatggatggtctaagatacaagaaaaaatggacaaagagaatgcttaatatgggcaaatctatgaatactgacaaaataatttttgtgggttaaaatatggtaaaaattaaaatacacaacaattatagcatatgtatcagtaggagaaacagtagtattcaagcgttttaaagcctctctacatccacgaagaccgtaagaaagtaacatactttctttacaattctttaaacagttcatctgtgacttatatatccttcacaatatgtgatttatttaataattttaaaagtcttaattaagactttttaatgttctgtttaatgtaactgatttaatgttctgttttaatttctgagtacaaagccagtttgcggagagcagtcaggttaataggtaatctagggatttaacgatctcaaagattgagtgttacatcagtaagaaaggagcattgtcgttaaaaaaaacccataccttttccttgtttggaaagaaaagaggagagtcataaaaattaaatatgaataaaaagctgcacaatttactttaaaatagaagatgaaatatagtttggcatcaatgagcttaccaagccgtatgtatctgtatctacaatgttgtttaacaaccctatactcatgtgatgttgttgacatagatttcagtagtgttactggtactttattgaaatcaatcactacagatgccaagtactcagagcccacagaccttgaagaagtcataggatgggtttccatagcacaggtgttggaaggtgccgtattgtggtgctgggaagcagagatgttctcttctttgaagattttcaaagaaaaaatatagcctgttgtagcagagcagctagcactgcttagatgcagaatcatgagaaagtgaggcgatagcagaggctggtaaactccacctcacaagccaaatcccatgagcaacatgcttttgtaaataaggtttcgttgggacacagccgtgtctattcatttacatattgtccacagctgctttcaagctacaagagcagaattaagtaggaggatgtatggcttgcaaagctgaaaatatttactacctggctcttcacagaacagttgctgacacttgctctacgacaaaggagttactaaaaataagaggccaggaagaggatcccttaaaaaaatgatcgtaatggacaaccatgaataggtctgggaggtggggctgcctagttgtctgcatcactagtaagaataatggtaattacagtaacagcagttcatacagttagtgcctttgcctcatgtcaggcactgtcctaaggactttgagttgaatttattctaaaaaaaaaatcttattcaagcagactctggtaatgatggtgtaaagtaattagtagttcttgtccatagaaaatgagtacaaaactagtcaaaattgccaaaggcaaccactttagggcatcagaaattgatctaaggtagacaaaaaattgagaagtgtttatttttttaaaaataactatattttaaggtaagaaaatcaggattctatggtcttcttgcctgaggctattcccatctaccattcacccccaagtcagccttagaaggaatgagaccaactctccgtatcacctggataactgggaaattgcatgtacacaagggagacccaaaagaacctcatcaaaagtaaaaatcagaggagatttgaggaccttaaatgtatcttctcacacacaagtgaccagcagagtggaagccttataggctcaaggtatttcctagaggtccccctgtgtcttctgcatagcttaatggtctgcccacatcacaaaaaagaagaaaaagaataagacactaagcaaagacaatactgatgagctccactgcgtactccacactctgcagctgaagtccaagcaagttacaaaacaatacaccacaaaatgctcaccaactactctcagaacaaaacagaatgcagttataacacattatttaaaatgttcagttcccaaaccaaaaccaccagatatactgtctctacaccctgcccccaccccccaaagaaataaagacagagggcaggaaaatgatacaaagtgtcaaaagaaacaaactattaaccgagatacctatatccggagaaactaccatttaaaaatgaaggtgaatatagtaaagatgatgagtctctttaaattgacttagtgaaactgtaataaaaatccaagcttgatatttgtagatatagacaaactgtttccaaaatttatatggaaacacaaaggaattacaagagtctaagcaattctaaaaaataataaaattggagggctcacacaatccaattttcagatttactagaaagccacagtaatcaagacagtgtggcactggcaaagagatagacacaaaatgaatggagcacaatagaaattcaagaaattgattcacacaaatgtagccaattattttttttttcccaaaggcataagaacaattcaatggagtaaggatggcatttttaaccatcttcaacaacacctgttatctaccttttctattatatccatcccagtgggtgtgaagtgctatctcactgtggttttgatttgcatttccctaatggttaataatgttgaacatcttttcatgtgtttatcagccatttgtatatcttctttggaaaatgtatagtctagtctaggaagaaaaacgaacttcaacctgaacttcataacttatatatcaaggtcaatgatgaggccatgaactcaaatagatcattgacctaaatacaaactcgtaaaaattttagaagacgtaggggaaaatcttcatgaccctgagttaggcaagagttcttaaatatgacaccaaaaatatgattcataaaagaaaaaaatggaaaaatttcatcaaaattaaaaacatctactctgtaaaagatacatttaaaaaatggaggcctggcgtggtggctcacacctgtaatcccagcactttgggaggccgaggcgggtcgatcacttgaggccaggagttcgagaccagcctggccaacatggtgaaatcctgtctctactaaaaatacaaatattagctgggtgtggtggcatgcgcttgtagtcccagctaattgagaggatgaagcacaagaatcacttgaacccagaaggaggagggtgcaatgagccaagattgggccactgcactccagcttgggtgacagagtgagacactgtcccaaggggaaaaaaaaaaaaaaaagaaaaagaaaaagaaaatggaaagacagcttacagagtgaaattatttgcaaaatatacatcagattgaaggcttgtatccaaaatatatcaagaactcaataaaacaaagccaaaaagaaaaggaaaagaaaaaatggtcaagagacttgaatagacatttctacagagacaatatatgaatgccaaatatgtacaggaaaaaatgatcaacataattaggtaccaggaaaatgttttccaatgagcaccaccacgtaccctttaccacaggtcaacaggctagttctccatcctccctctaaaccaaatatatatgacttctcccagattgtggaagtatatatgcatttcctatgcttaattagataatcaaatccctacttagagctcaaattactcaaattactcaaattacaagttcctttagtcttgttcctagaggtgcctctgcagctatgaatcttgttttatacttatcaacttatcaacttgtaagattttgacagtttttggctaaaatcaaacaaactatcaatactattcttttgtgtttgtgaagatgtggaagaactggaaccctcatatattgttaataggaatataaaatggtaaagcactttggaaaacattttggcaattacctaaaaagttaaacagaagactcgagtgagatggtcaaaagatctgactagatatttttccaaagaagatacacaaatggctcataaacacctgaaacgatgctcaacatgattagccatcagggaaacgtgactcgaagccagtgtagtaccacctcacacccactaggatggggataaccaaaaagacagataataacaagtgttggtgagcatgtggagaaatgagaaccctcataccctgctggtgggagtgtaaaatagtacagccactttggaaaatgatctgtcagttcctcaaaacattaaacgacagagttatcatatgacctagcaattctacctctaggtgtgttcccatgaaaaatgaaaacacaagtccatgcaaaaacatgtatacgaatgtttatagcagtgctattcataatggcccagaaatggaaacaatccaaatgcctatcattttataaataaacaaagttgatatctccgtatggtggaatattattcagccatgaaaaggaatgaagtgtttatacatgctacaacatggatgaactttaaaaacattatgctaagtaaaagaagccagacacacaaggccacaaattatatgattccatttatgtgaaatggtatatgacaaatcccgaataggcaaatccacagagacacaaactagattagtagtttccatgggatgtggccaaagggggttggagatgactgctaacaagcatgaggctttttttttgcatgaggcaatgttctggaattaaattatggtgatggttgtacaaccttgtaaatatgctaaaaaacccactgaaatgtacacttttaaagtggattttatggtatgcaagcgctatctcaatttttttaaagattaaacattatgcccctgaattccattattaggaatcaatctacttatgagaaataaaaatatatgtccatacaaggtcttatatgtgaatgtttacagcagcattactcatcatagccaaaaaagtggaaataacccaaataatcaactgggagtagataaatatgatgtactatatccatacaatgtaaactactcagcaataaaaagtaacaaagtactaatacatgttacaacatgaatgaaccttagtaacatgctgagtgaaagaaagcagtaaagtaaggctacatatatgattccattgataggaaatttgtagaaaaagctgaactatggagacagtaagcagaaatgtggttacctggagctgggtatgggtatgaactgactgcaaacaggcctcaggaaaactttggagatactagaaatattctaaaaatggattgtgagaatttttgcacaaccataaaaacttctaaaactcagaactgtacaacttataatggttgaattttatgatatgtaaattatgcttcaataaagctgttaaaaattaaacaaccttatgagacagatactattattgttgccattttagcaatcaggaaactgaagcatagacagattaagtaacttgctagaaaatggcagagctattatttgattccaggcaaaatgattacggaattcttaaccactaaatcaaatccagtgtaatttgctaactataaagtatagtactgggaaaattgagaaaaatgccaccttcttccaagagtcaaagaatgatcacacattgagggcactatttatatacctaactctctgcaagtaaccccatttccatcctctcttattagcacaccaatttgcaaggtagttgctattacattaaaaatatacaatttaaaacagttcagcacatgtgtcttataatggtctcctccaaattccatagcgaccattaaagaaaatatgtctgggccaggtgcgctggctcacacctgtaatcccagcactttgggaggccgagcactggggtcaggaggtggagacaatcctggctaatacggtgaaaccccgtctccactaaaagtccaaatttagctgagcgtggtggcatgcatctgtaatcccagctacttgggaagctgaagcaggagaatcacttgaacctgggaggcagaagttatagcgagacaagattgtgccactgcactctggcctggatgacagagtgagactatgtctcaaaaaaaaaatattaactaatcaaaattttttttaaaaaagaaactatgtctgatacctacgcattcagagctttctttgctcaggcaccctctcctctcacagtctctgaaggccaggcaaaaaggctagttctttaccctccctctaaaccaaatatgtatcactccttctacattgtggaagggtatatgcatttcctatgcttaattagagaatcaaatccctacttagaggtcaaattactgtagttcctttaatcttgtctccagaggagcccctgcagccatgaataatcttattccattcatacttatcaacttgtaagattttgacagtttttggtaaagcacaaacacatagccataagtactgctcaagcagtatttttcaaagggaggaagaaagggaaaaagatgagggaagagtaaacgttcatgaaaagaaagatttctcccctttgggaatctgtttattttgccattgtcaaagtgaggcaggaattcaaacacctgacggcatggaagtggcaaaaccatgtgggtttgacttgatggtcctgagaagctgctggcaatgctttttaaattctgcaaatataattaatggcttgtttgctattttggcaacttaaagcaggggctatgactgcctgtgacaaaatcagtaattgaatgattaaactagatactcacagtcaaaacggcatctaacaatttacctctaatacaacattcccaattaatttttaaatacctattaagatataaaaagatttaaatataaaaaaattaaattcaacttaaaacactttaaaactagggccaatgcctgagtctagaaagagactacctaatgccagagtctaggagttcttctgagccacaattttgctgagggcaatgcatagtgaaacgctatgagggtaagactgcctggctgaaaagagtgacaaggacccttcacactgtcagaatcatggatcagaaatcaagtctgcaccaagcaagaatctgcacaactgtctgtgcaccatgtggggctggcttctacagcagacatacgcagtcattttggtccctctctcctcagccaatatgtttattccatatacagactttaacttctgggaaaatgcagggtagagagtggagagaagtggcaggaatggtgtcacattgaatacgggcataagcaggtatcatacataacgtgataagagaaggctgagatatgaggagccttcacagaagtacattctacagtattcagttttcaaggtactttgtttcatgtaccagaaaagcaagctaagagaagatgccatttcagtcaaccagttcccaatagataaaaatacactggattgtgagaaccagctgtagactgagcatatccatctgttgtccagttacagatctgatgagggaatccaaagagcactaagccaagggcaacttgtgtaccatttccaccagcaaacattaatgctgaatgctttcacactaaaatgggagaaaaagcaaggatggctgtcatccatactcatattgaacataatagtggaagtactagccagtgtaataaggcaaaaaaaaaataacaggatatagaatagaaaggaaaaaataagctgcccctatttacaggtaacatgattgcctatgtagaaaatcccaaggaattttcaaaaacatttctagatctaataagtgaattaagtaaagcagcaggacaaactcaacccacgtaaattaattatatatctacagactagcaagacatacatgaaaaccaaaataaaaaacacagtaacacaaaattacttaggtatgaatgtaaaattgaatacttagatacacacctaaaaataccatgtacagtatctgtatgctaaaacatacgaaacacagatgaaagatctaaataaataaagagccacactgtgttcatgcattggaagactcaacacagtgaagttgtcaattctctccaaattgatatataggccaaacaatttctatcaaaaccccaggaagagtttttgtagctatagacaagagtattgtaaaattagcatgcaaaggcaaaggaactagagcagctagcacaattttggaaaaggagcaaaactagaggattgatgtgatctgatttcaaatgtttctagagaagtacactactgaagaccagaagtagcaagcactagttctcatgctaattctgcgatgttcacttaccacactgctgccctgtttccagttttccactgtactttggaaaagctagtttggaagtgttgcaggagaggtatctaagcatctatgtatggcaaatggttgttctagtcatctactgctgtgtaagaaaccaccccaaaatgtagtggtataaaataataaccattttcttatggtcacatattctgtgggtcagaaattcacgaaggatacagcagggatatctcccctctgttctattatatctgggcctcagctaggatgacttaaatggccaagggtgtctcaaaacagctgcagctcaaagatctatttccaagatggcttcttcattttcacctctggcacctgagctcaagtgaccaaaaaatgaactcaagcagggactatcaacaagagtacttaagtggcctctccttttaggttctcaaaacatggcagcttggttctaagagggaatgtcacaagaatgacctttctggaaagccaagtgttgccaaggaccaaggcagaagctgcaggggttcatccaccctagccttggaagtcgcattgattcacttctgctgcattctagcagttacaagagcttcatttagggaaaaccagattcaaggggagggaatttagactgaatttttttttttttttttttttttgagatggagtcttactcttgttgcccaggctggagtgtagtggcacaattttggctcactgcaacctccgcctcccgggttcaagggatcctctggcctcagtctcctgagtagctgggattacaggcatgtaccatcgtgcccagctaattgttttgggttttagtaaagatggggtttcactatgttggccaggctgacctcaaggttggatcgggtggatcacttgaggctcaaactcctgacctcaagtgatccacccgcctcggcctcccaaagtgctggaattacaggcatgagccattacgccaggccagactcaattttttgatggggaaatggtaatgttacattacggagaatgtggaggaggagatattgtagtggacatcttttgaaaataccaattgtcacaatggttacagtaaaaaaatacaggagcatttaaaaaaaatcctccactaaagtaatttccactttatccaggtattatgttataacctcagaggctctctaagtcctttcaatcaacagactaagtttttatcactcacatggaaggttctattatacttgcagatgcaatactgtgcctttcacatgctgcccgctaggtgctcaaaaggccaaagaagcattaatttacactcacttgcctactcccaccttttgggtgggtgattcctcaccataaggatccctttgcccaacccctccccatccccttggtgttttctttcaagagacagggcacctctcccccagagagagagcgagcgagagagagagagagagtgcgtgagagagtgagaaagcgagcaagagagagagcaagagagagcgagagacaggcagacaaggtcttgctctgccaccggctgcagtgtagtgctgtgactatagctccctgtaacctcaaactccttggctcaagagatcctcctgcctcatcctcccaagtagctaggactacaggtgtatgccaccatgcctggctaattttattttttttattttttgtagagatggagtctccctatattgcccaggctggtctcaaattcctggcctcaagcaatcctcccatcttggtcttccaaagtactgagattacaggtgtgagccatggtgcccagccagaattttctaagagccttttaggatgcagctataccacggttacatttattttaacttgtagaagttttgctttttttttttttttttaaaaagcaatcactcttggagatactagatactacaactattacctaaaaacttaccatgataactagttgagaacaaagctttgtaaggataagcactgagttgagttggggtgtggacgggggggggatggtggcaacagaatattaagaagaaaaagaagcctacggaaacctgggtatgatatcaaaacaacaaagattatactacctaataaatgtaagtacagtaagtatggcatctttatacaccacaagccaaattcacatccactacttcattgattaaaactgtacagtttatcatgttgctaacgcaatgtagaacccaaagttccaagaggcgaggtgatttggccaagtcttcacggcgtgaaagggctgagatcggaactcagcctgtgcttcctgaacccagctctctccagccatctcattgcctcactgaacctcacctaacagtcatgtacgttgttaacttcttaactgaaatatttccaatcaatgcaagaaccctaacacactctgagaccactgagtacaaacaagctggcagcccagcatcacccgtcccacagcgcccaccaggagttcacacgtgaagcctaattcatcccttaaaaaaaaaaaaaaagtgttagaaaaatgtgaaaccaatgaatctgccagcatggttgtttcacatagaaaatctggaatccagcatctaaataaacggtagaatactgttgctaccagctgtgattccatttaagacaccatttgtggaaaatatttattatggtcttccattttctcagcacaaaatcaaagaaaattgagaaatatgaaattacattgtcttcaaaaatcctgtcatagagtaactcagctctcacagctatcctctgaagatgttattgatgttctaccaagttgatggagtaatataatttgctagcaggaaaaaatgctggcaaacagaattgtgttcattagagcggtatctttacaacgccttcttccactttcattacttttcaagatcacacatcatgtcacagggccgaaccacagccttgctatgccctggatatttcagtatttttttacagttggaagcagattcttaacgcttgtgcaaattacagctatttttgctaaaatgggctcatttatgctgctggggaaaagaagcctctctgtctccctctctctgaaggtctatgaggcagctctttacatgtagctcccattacttcaggctcgtaagttcccgcgggggcagtctcttccataaccaatcatcagacctagcgctggaccagttcacatccacactgtgaagtaagcatcgtttgtctttactccctttccatccctcttagttctgacaagttttctctttcacttgggctgaaggactcaccaacggccttcttagtgtggcctcacaaatgctgccttctccagagcagctttctccagaagttccctctttacccagtcaaaacttccaagcctcctttagaaaagtctgatcccatcagggtgttaaaaaaaaaaaaaggcaaccttattagatgaaattacaggtgttaatgattaataatttcatagatgagtttagattttgagggagaaattcttatcaactcaaaacaatttttaataggtaaaatttgaaacaacacaactacgtgctgcattttcatccgtgggaaggaaaaggatttttgggcacaagcgactcccagattcctcaaaagcaaaccacggagagttgagcttcatgtgtgtggtagaggttcaagcacggtatagggagtcgactttcgaactgggcattgtactggtcacatgctcaaccttgctgctgaagtgtcctttaaatcacttagtcctgggaagcaaatgcaagatgcatggatgggacctgaccagattagcacagggaacagggcaaggagaatggtgagcagattaacacagggaacagcgcaaggagaatggagtctagattagcacagggaacagggcaaggagaatggagtccagattaacacagggaacagggcaaggggaatggtgaccagactagcacagggaacagggcaaggagaatggtgaccagattaacacagggaacagggcaaggagaatggagtccagattagcacagggaacagggcaagaagaatggtgaccagattagcacagggaacagggcgaggagaatggtgtccagggcacctatgaagcattgcttctactttctgagctgctggaatagactacaagctttgtggtctgcattcctctacttctactaagcgttcacatgactcgggaggccagatgttattcctggctcatgcctactaggttaaaggagtgggggatgctttacttccaattattgaaatgaatcacagactgtttagagccagaaggaagcagagatcacctgcttcaaccctgtcaccttaaagatgatgaaatagcctagaaaagttgccctaggcccactcaggccatgcagcaagctctaagcccctcagctctatcaagttgggtacacaaaaggtgcttaataagtgttggctagcctagtggctggattcctgaggtctgcttcctagttccatgctcctttcattataactccctcccatgcccaccatccccactcccacattcttcgttccagtctctggtggaaaacaatcacagaccatgccagagtccagaataagaccccaaagtgagttaggggacggtccacttactcagttacttatgactctaattatgtgccaagtggtgccagtgtgccactgctaattattactacacaggcttcagaaactgggccaattctttcttccttccaggaggaggtttggactaggggaccgagaaggtggctctcaggaaagcattccgaaagtttctctatcacggagtatcctttgaaggtgaagtcaagaactcctcttggaacacggcaccaggagcttttggagtcccggatgcttgcggatgactccccttaatgaaatgtaggtatgacaaggtgtacgtggcactaggttcagaccatgataatgtgccatttcggggacctgaattcctattatgatgtaagtcctttcagagagactttcataggcagctccctaatgaggcaaaggtctccgtagctcctcacgtataaatggaaagttgttgcacagaggaacagggccctttctaaccaagctagcagggacaggaatggcactagaacccagtatatttctgcacagactcaggatttttaatagtctgcaatacggcaagctgtaagcaaggaaatattccaataaaaaaataaaatacagactaagaagaaagccacagtcaatatttgattatagaattcaatgaatgattggggtaatataaacaggggatgacccccaaattcttgatgttggcctgaaagtattgtttttatttatatttaagtacaattgtgtggtctgtattctggaaatttccttgaaactaaatattggtgccaaatgaagtccacagagaattttataagctctatattttacctatttccaccattttccaattctcctcaacacgaatagctgacttctttcactgctcccaaaacattgttgggacaaagatggtctatgggttaatggatttccctgctcaggctttgtactttctagctggcaattatagctccttacatactattgattaaagaaaaattccatctctggtgttgcatccacctttggaaaagtgaaactagaattcattgaccagtttgttcatttatttgttcattcattcattcatgcattcacattacagattccacatttactgagcacccattatgggccagacactacagggataagctgggaaataagggagaccacggttcctgtcctcatggatcttacatcactgtggaagggccagatactggaaagtattaacaagtctggtgagtactgggcaggcttcaaaagggacctacagtagtcagagctgctctagagagtcaggaaaaacttagaagagacactttcattgggggctggtagatgagtaaaaattaggctgatgaaaaaacagtaggtggaaaacccccaggggcacaaaacagcaacactgagaattcaacgaactgatggaaagtcaagagtgtcccaactatagaaggagagctgcagtgaggaatgaatgaatgaatgaccctacttgctagattagtggaatcaaccccagtgatgaatggggcaacacgggcagagcccactcttatctacccactggggcactaggtccaagtgaggggagaacccccagagtcagggtcggcaaagcttttcgagggcagcatctgcaccttgagggcaattgtactttctatacttggctccaaaccaggcacacagtcagcacctaaaaaatgtggatgcttttagaaaagacagagtcacaagcacataattagagaaagcctcttttggtcagagggagagcctcatttctgaagcaggaatttctgccacagataagccacaatgggggatgagtgtactctgtgattctttggctaactgaaccatttgcatggacactgctaattttgggaaagatgactgaacagctttatgggtcaaatttgagactgagttgtagagccagatttgaatccaagactggatgactctgttccatctaatcatcaggctcattcatttccagataaaatgattttttttctgcttactctgctttcctgagcaaactgtacttttcagttgcaaaatattacatttacctcaaagcccagggaaaataaaggtaggtgatacaaatgacccttttttgtgactgtggatgtgaatttggtctctgtcctaagaaatgatgtgcaggaactggggagaaaggaggaggccatggtgaagctcaccacccaggctgcatgtcttcaataagctacaccatgaaaaagctacatccctaccagacaagcaattcctcccctggtatccaaggtctcagtgatttcatcaagctggccactttcttcttcatccacatgggatacctatactaaactactctgggcatcttatggggaataaaatcagttgggggaaagagagcctattatgttacctaggaaaagagatctggcaagtatgagatgctttccaaattcctcttgggcactaaagtactacttgcaacacttattaatgcaacggatcagtttatcctgctaacaccatgaggataaattgcaaaacagcatatggaaatggcaggagtctcaaactcagggcatggtgacactgtgtctctgctagtaatcaaggtttacgtgctcactgtctgtgtttttcttgaacagagctgtggagcacgggtcagccagacagattatcattttctgtaagtaacaagtttatctacctcttaggaaaggaatggggggagaggacgggagaaagagagaggggggcagacagggggcctgtgcatgctcatgagtacatcagtcggtatttgttctgtagaaattcaatttattcaacaaaaattctggtctttttagccttcagctagattgtgtctgatacgcagaggtcacatgtgtttggaagccactgaaaacctcctcctcttgccttctctgatttctgtctctagaattatcgctgcctttcttttctctgggccactcccttccccattatcagctctcctctcatgctttctggtagttctcactgtcatgccaatgacagaccatctgattagactgttttaaacattctaattttaaacttgtgtgtgtgtgtgtgtgtgtgtgtgtgtgtgtaagcggtatacgtattcccaaaaggctgttcgatgaaatttgatttatgtcctctttctgggcttactctcaaatatatatgaaagagtgctgactttgtacctagagggtttacaactgagccaactcattcattcattcactcattcatttattcattctcttcaaggaatatttattgagaacccacaatcagccaagcactcttctagatgctgggtaccgctctagatgagtgttacctcaattaatcctcacagtaaggtaaacattattactctcattttacagatgacaaaattgcatctcacagaacttaaatataataattggcctaagccacatagctagtacactgcaaaactgctctgtatctaacttggatctttttaagatgctctcaactgctagcagatagggattctcttggtaatcagattttgtaaattaccatgcctaattctttatgccacaatagactccaaaaacagacttattaatgatgacagactatgggcaagattctgatcactttgagaaaaagacagaaaaaaaatttttttattccacaacttctcagttagcatggaattctgacattccatttgtttatccactttgggggtgtcatgataatggggaacatagtccatcaacatatctgtaagctaggacttcattaatatttgttacaatgaacagataaagttgtctatcgctaacatatagcttctttacaaacagtagctctaatcacagttaagggtgcagacatgatctgcagggtttgggtggacgaagggagagggcatgagggacgacgtcgaagttcaaagacaacgaagtctcctcgggattttatgctggctcagctcggtcatctcagtggctgctgccatccagtaccataatgatgacaaaatatgctctcctaagttataaaacactgtgctgaaagtaagaatctctgataaagccttgagtttcagaagacttgcctcctgccccttactgcatttctagttagaaatatcttccatataggccaggcacagtggctcatgcctgtaatcccagcactttgggaggccgaggcgggtgatcacgaaatcaggagatcaagaccatcctggctaacacggtgaaaccccgtctctactaaaaatacaaaaaatgagccgggcatggtggcgggtgcctgtagtcccagctactcgggaggctgaggcaggagaatcgcttgaacccaggagacggagcttgaagtgagccgagatcgtgccactgcactccagcttgggcgagactccgtcccaaaaaaaaaaacaacaaaaaaagaaatatcttccatttaaagtttcacttgcatacttgcatgttttcccgctggcagacagagtgtaacaacactaatttgaccatgctttccagagcatggcggggcaggaatgaaaaccgttgtagccacttcctccctactgccaaggctccggcttgcttcgtctctcaaatctccacctgtcactctgtaatgaatgccacccagaggtccacatctcattttacccatcagtagcacacactactgtttaccatcactttcttcaaaacaggcccctcttggtctctcaatccctgccctcccctgctctgcccagtgcccccccaactgccctcacctctatgctgtacccgccacacctctcaaaccttgccctcccatccatatagctattttctgcagggaccaaccatattagcttaggctaacgtgcaaatccctgaccatggcccacagccccacatgacctggttcatgctttcctctcttttataaagagttttatctccacaaatgcttcatctgccctaaagtctatattgtttgataatgacagttaacccagctttcctctgattaatgtggtcttgatatatctctatttcatctcattatttttaaccccttggtgcagttttcttcttaagcagcatgcaactgggcttaaaaaaaaccaaacaaaaaacctgtctcttaatatttaaatttcatcttaatcatttacatgtatggtgatatatgtggatttatactctccttatcatttttacctagtattttagtttcatctttcagtctcaacacagggaaagcagttgtgttcacattcattagtaaattctattttctgacatttcagcaatttctatactcaacactgttctacgcattctacaacttctctctgggtttacttttcttgtaatacacattctttttaaaaaattattttaacaagattccttgtacctcttaaaatatctttatttcattttcacttttgagagacagtttaactatagacagaattcttgacaattctttgctttcgcacattgaagacattccacgtgacctgacgtcactggctgttgagatgttctctcaatcaaattgaaatcaggttgtaagattctctgccagcgatgttctgaagattcactagtgtgtgtgtatttacatttctttgtattgataccactcagtacttgggggtatgctttgaatttgagggttcatgccttttaaaaactctgtcaaattgaaaatttgctggtcattcgttctactctttcttaaagaacttcttattagaaacttattggatagtctcaaaatatccctcctgcctcagctgcttttgcataattttaaaaaatgtctttttcctctgagctgcattctgggtaaattcctcaccactatctcttaattcaatgtatctttgtgggtttttttatttcaatgactatagttttcatttctgagatttctgattggttctgttcctattctcctgttcttgtttcacatatgtttgtcccccaatcccagtggatattatccatttttttctctttaaggatttggaataaattgaaaacttttattctataattttatttccatatggagtgaatttctgattgtgaatctcagtggttctctttttgatgctctatttctttatgtgttttggcatttaggtgtgcatgttcatttcagtggcaggttctctcccatctgtctctgtccctgtctccatttgcatcctacccccacaagtgcctacgccctcatcttgaacaggatcttaaatgctagctcaaggatcctatccccagtgatagggacattgcaaatccagtcactgaaccagcaggtggcttggctcaggccctggtcaggatcctgtgtctgggatcttatacctccatagactcacaagcttcatgtcgaccatcattccaggcataggtcagcagttacttttatcagcctcccatcatagtgaggatgtcctctctcatttatcaacatccccggttttcagtagtgagcctgactccacttcccatttcacagagtacatatctagtccctgttacattccaggagccaaattcccagccattttgcctcctttatccgagagccaggtagccagtggcttcagctccatcacttctttgcatttctcttctttttcagattcactcgctttgagcctagctatatctttttaatttcccattgttatattttgtctcttgtggcctaaagcatgatctaaccatgccagctcaccaaggagttccctgactttctctacaacctcacctcatgccacgggcccatgcgctccagtcacctcctttgctatctcttcagttctctggtcaatcaagatttctcccacctcaagaccagacacatgcatgaagagaaagagccaagcactgaacgctcttgtcccctctctccctaaatactattctcggccttttaatttcagcttaaatacagtctctctccctaaatactattctcagccttttaatttcagcttaaatacagtctcagaaggcacttttctgatcactctatcttagtaaccctatctcccaattgtttattaattggatccagttagttgtcttcagagcaaagttgcaaacagtcacaagatcgcccaaaccacagcttacaggccacacttctttttggtaagatgtacctacaccactaacattgacagtggtgctgcctacaaatataaaggtcaaggatatgtacaggtatggcccaatgtgaaagacagcagacttcttgggttgggaagtctgagtttcttttcaggactcagatgatgaaattacctggaacttaaggtattatgtccaataatcaaatagtctcttgtttcaatattttatcaaaaataaaatataataaaaccttattgggacgaattgggatgatgaaacatccaaattaatggagatttggaattctagattttttttttaataaaatggagactgatttcttgtaaccctgtacaacagcacagagtaatggtttacaggacactgccaaatagagaccctgccaggacctactttaatgaacagtaaagaactgtctatgatcaactatctttttagcggggatagcatgctgtaaaggcagcatgaatgggctagcatttcccctataatttcctacatatttatgattttcacaggaaacaatttttttccatctacagacactggaaatgtgagtatcagctctctctctacagtaccataaattcaaaatcagtgaggccagatcaatgaaatttgatacgcacaaaactcttgcatattctcatgtgagtgtggaggagagcagagtgtcatcaagactccactccacagccatagtctccgcatctgcagttagctcttttaggacagctagatcactgctccattctattagctccaaacatactgcaaccacctgttgaagctgggaaggctcagcatttttttctctttctcccactggctctgcagaaagcatcacaattccaattagtctgtcaaaaacgaaaggccatgacttaaggtgcaaaacacctatgaaataatgaatttggaaggacaggaggagacatatctgtaccggttagtgtactcaagaatcaggctatagaggaaattgcttctttggtagtgtaaatacaaagttttcaagaatagttactacaaggcactttctattcaagtaccaaattgtgagatacagaatatgaggggatttggtgaatgttttcctttgaacagggctttacttcaggtccatacccaaaggaatatcaatcatgctgctataaagacacatgcacacgtatgtttattgcagcagtactcacaatagcaaagacttggaaccaacccaaatgtccaacaatgatagactggattaagaaaatgtggcatatatacaccatggaatactatgcagccacaaaaaaggatatttcatgtcctttgtagggacatggatgaagctggaaaccatcattctcaacaaactatcacaaggacaaaaaaccaaacaccacatgttctcactgataggtgggaactgaacaatgagaacgcttggacacaggaaggggaacatcacacactggggcctgtggtggggtggggggagggggtaggatagcattaggagatatacctaatgtaaatgacaagttaatgggtgcagcacaccaacatggcacatgtatacatatgtaacaaacctgcacgttgtgcacatgtaccctagaacttaaagtataattatatatagatagatagatagatataaagaaaagaaaagaaaagaaaaagaaacggccaactctaaggagatttcaggtccactgcagacgccccctactggccggttttcaaagctatgccaagacatgtcctctcaattgcttccgggttccaaaaaaaaaaaaaaaaaaaaggtggatcaagacaccagcgaggctcattgcttgtggtctgcttcttatgtgttctagggaattttattttcaaaagctacaaagcttttcacaatatgggtttgaggatgctcagtacgtgagaattttgggttgaggtacagaaaccagataaagccttgttcatttgctcattcggcatcaacgtccagtgtgtcccaatgtaaatgaatcactgtctagaaagtagaaacattcttatttttttttttaaaatatgcaactcttggctattactggctatttcatattccaggaaagcacagaggattctgcactgagctgctgcaggcgagctcactcctacccagctccttagcctggcctgcgccatcacccagtagtgcctgtgtcgagctggtctgcagtccctgagccccttccctaccctcaaaagaggaagcaatttccagtgggagccagagcggccccggcccatggggaagggcagactgagaagccttctgagggaaggatcttgacctgtcaacacacacacgcgcacacacacacacacatacacacacatacacacccccacacacatacacacacataaaaatatgcacacacatacacacacatacacaacacaccacacacacacacacacacaccttgagccttccccatgcttaagagccacccagcttcttaatctgcccaccccagaaccaggaagaaagagggaaatttcaagagccttgggctccattctttgtgatgcccagatgtgttttctcaggctgggcttgtactggacgaggctgaacaggagcggggcagctacccctccgctaccactgctggcttttcctgtgcctcctgttgctcccttattagatgaccactcaaagcttaattcctctcttatgttgtttgaatctcttcagatcacccttctggccttcactacctattttcttcttcctcccactttctctcattcttttccccctagaacaccatcaacccctcagcccagccttgctcaggcccctcagaccatgccttagtgttcccggcaggccctgcttccaactggactcactgcagcctgatgatgtccttgttactttttcacacagcaaatatccatccaacaggcactcttctcttttcactcctgtctgcaccctcgatactcttcacagaacaagctctagccctctccatagcagagaacctgcctactcctctgagagatgataaatgctcccagagaggaatcagagctataggtgacagctccttattcctattaggtacagagaggttgaagggagagggctgggcatccagccttccctggtcctcctacacagctgtgcaaggagcacagcaacaagagcaacatcacagagagagaggggccgaggggaggggttgcagcagctcagcaggaaggtctgccatgtcccaccatgtctgatgcactcagttctctcaattctgattcctacactcagccctgctctcaactgtgtaggaccccaaaaactgggttctctaaagggtctgaaaacagccaatccaccacaatcaccagcaagtgctgttatagtccctctcttctcctttccaattaaatgaacactaaatggactcgaatgcgtgaagtctgagatatcatgacaagaagtaaatttagttactctgaagcaagctaggcaatgtgtgagtttatgcaaacaaacatttttatgttttattataaagtgtaacgaatgttagtcatgtgagtaaactgggtacagcacattgttctctttgtattttggctgctgacgctggtagaggaggcatctgtctgccctggattaacttctctgtggtatctgctaatgaatcagtgaggcagagaagcttcctgcaggatctcccgacctcggcacacctgtccacctgtccatctgcccacctcatgctgcagcgctggaattcacaccaatgaaccagtaaggcagagaagcttcctgcaggatctcccgacctaggcacacctgtccacctgtccatctgcccacctcatgctgcagcactggaattcacaccaatgtgcaaacagttggcatcactttgaagccactccaaggtggcatctgcacttaataacaaacaccctgcaaaaaccgctgtgcagccgtgggcctaaggtatgtgcccacttcatcagcctcattctgggccacttgtcctgtcccgcttccttcatctccccatgcctgtcaccaccctagctgttgtgcaggttcttgagtgtggtattttccctcctgctaccgggtcagggagagctcttctctgaggctggccagcccctccggtagttcactttactctcacaactgggctcccttcccatcacctcctgtttctacctaaaagcaggtccttccatcggaagctcttctaacagtgtatctttccttcctagctcttcatgcagttcataactatacactatattttggtaatgatgtcattgtctctcatgctagagtgtaaactgtctagtgatagggttatatatgctgggttttttttttaaataatgctatatctaatagtgcttggcacataggaggtactcaatacatatttaaatatttgtgacattaatgaacaaatggtattaaggatacagaccaagagagctcaagcagaaaacagaacacagccctgtcatgcagatgtccctacgtaaataagccattaacttctctagatcaagctggttgggaaaaatgacatctgtggataacaaatgatgaaaactttgttcttaaagactgttttgtacaaatgcataagaaaagactaagttttttttcctaaagcaagtagtggacatcccaacaccatccatgggagaatgagagacatctgtcacagggccccaggaacttggggaaggattcgggctggctgacaatgactcttttcttggccagtgtggctaaagagtaataccaccttcctgatgacaaagaaacagaaactaatagcagggcatactcatggttagttggacataattgtgtagaatgaattttatacagttttcattacagaatgtggggtgtagtaattctctgcaaattctttgttcattacataaaatcctgggttgaaacagccctctagatactattatgcaggggggccagaactgactacgtcttatttgacttttaaagtcaagtttctggtggacaagccaaataaacagccccacttaagagaattcaatcctaaagaagtttatttttgtctgggtgtgctacgtattatactagagccaattacaaatgtttaaaatagctaaacttttaaaaatgtgtttgatgcttttatatgcaaaagtgttttcaaaaacaataatagtgtcaataaacagagtatcggatttgacaaggtggattgttaagtggttgcaaactgttcccacaagacgctgatgagtgcatccctctggcctggagggcatggaatcaggccatcatttctagccacggtaactaaacttacttcttgtcataaatatctcagacttcaggcattcaagtctaagtccatgatttagatgaagatatttaagacatgtttatcaaacctgcagctgctacgaagctcagaggaagggataagagctcttataatcttggccatggtagttaatccagcagactctccatttcttcatctataaagtgtgacaatgatttcgattttgtagggttattgtaaagaattaatgagccaaggtatataaagtgaaccagtaaagttagttatcttcttttacacaaagaatagcagaatcaggatttgttaaaaaaaaaaaaaaaatcacaaaaactcaagttggaaaaatgggctaaagctaataattgtatcaataaaaaagggaaacccagcatgtagctttaaaaaaacaaaacaaaacaaaactctgtggaaggatctacaaaaacaacgacacatgaataaaacaagtaagttgtttaaaaaaacaccaaaacaccaaaaaaaaaaacctttgagtaatgtcaccaaatcgtgttcttccaaaatataataacgccatttgtagactcttaagacttgttatatataatcaatcagtcctactgattaaaggaaggttgcatgttttacaaccttagggcagagattcctggtggactgacgttaggaatgcgtaaacaacattgtcaccaatgtattccactgagttctattttataattacttatttaaaataatttgagttgctctcatagtaaacctgcatttaagcaacaaaattactgaatacccacagaatggggagatttgacttggtagtgttcctggcatggagttctagaagttctcagtggccacaagctcagcaggagacaactgctgtgaagccattgaagtcttcacctcaactacactagtcctagggccagagagccaaacgctgacctccccctctccccaagtcataagacaactctctttttcctttactacaaattatgaaaatagctacttgatatcaaggtcacaactaatttcattttattcaacttaatctcttgaaaaatgattggttttttaaaaagatacattttgcattgcatacctccccaaagcaggagtattgcagtactagagatggaatcaaccatgcttcagctacccctggttagtggcttcaggctatagcctagggcctggctttgggctccagagctttctggataataaggtggctccagtttccaatgttccctcatggtgcctgttggtggcctaaaattctgtgatttcttttaaaacaacaaaagtcaagctatgaagagagtgaggaatgaatctgccaggccagcattgctcttcaagataatggaataatcggaagacagaaccagactggaaaccttgggcctcgtcttaagctcttatcttgggcaaatctcttaagtcattgagacttgttgaggggctgccatcagatcacctttaaagtcttctctagttctgaaattctatcagctgccaactgccttggcacacaggcaacattggcctttatgaatctgtggacaccacttgcctctcaaaactgccagaaatgagttaaaaagcatgaatgttcaagactcacagggctggcagagaagctctacagcttctaaaaatacttcttctctttcttcattatctgattcacaggacctaatttaatggtgaaattccggaatggcgtgccgaaacctctgactgtgacatgaaagatggtcatcttgcacctgggattcagttatgaatggcttgccgtatgtgcaagcactctgtcatttgcctccagctgtttattcgtcacactggggcacaggagaggtgctaggagcaaaccaacagcaaaataaaaacattaatttatgcaaagctttctagacacaactgctgttgctgagaaacaattaccactacaaacctggtgttttaggttgaaccatatgaactggccaatttcacgtatgaactggccaatttcacaggtcaacaatggtgactgtcaacagtttcatatggttaaatacacacaaagccccccagtggctggggaaagtggtattctacaggtttttctctgagtgcaatgatggtgggaagaagatggacgacaactcaaatgcaaaccccagccacgtggaggctaaaaagttattatgtaacaaaacgacattatagaaatgccttctggaactactagaattaggtgggaattcttaaggaaaggaaaatcattatttctagagttaacaaaagctggaaggaaaatgacaaacacacaaacctatcagcttaagaaaatttctaaaatttgatgtgcctgattttgaagccaacagaagagggaacagagagatgcagagaaacaatgtcctattggatcctttgagccctggatccaaccaggcttgaggccagatatccctggactttccagttacgtaagtcagtattttttttttttttttttgagacagagtctctctctgtcgcccaggctggagtggagtggcacaatctcggctcactgcaacctccgcctcccgggttcaaggattctcctgcctcagacttccaagcagctgggaccacaggcgcccaccaccacactcgggtaatttttgtatttttagtagagacagggtttcaacatattggccaggctggtcttgaactcctgtccttgtgatctgcccatctcggcctcccaaagtgttgggattacaggcgtgaggcaccgcgcccagctgagtcagtatctttcttattaaagcacatactcatgcatacacacacaatagcactcactgccgtggtctggatgttctcccaaattaatgtgttaaaacttaattcccggccgggcgcagtggcactttgggaggccaaggcaggcggatcacgaagtcaggagatccagaccatcctggctaatgtggtgaaaccccatctctactaaaaatacgggcgcctgtagtcccagctactcgggaggctgaggcaggagaatggcatggacctgggaggcggagcttgcattgagctgagattgcaccactgcactccagcctgggtgacaaagcgagactccgtctcaaaacaaaaacaaaaacaaaaaaacttaattcccactgtagtggtagtaagagtggggcctttgggaactgattaagccatgagggctctgctcttataaatgaattagtaccttataaaagagctagagggaactaacttaggccccttttttgcccttttgcattctgccacgtgaggacacagagttcatcccctctggaggccacagcaacaaggaaccatcttgaagttggagcgagcagccctcaccaggcgctgaacctgccagtgcctggatcttggtgtctcagcctctccaactgtgctgagtaactttctgttgtttataaattacccagtctgtggtattttgttgtggcagcacaaagatacccaccacatacacaaaagcttatgatgctggaccaacccatctcaaaatgttgaactgaatcacaacaagcaagacccatttcatatcaaaacttcaaaaaagctttggcttctagtctgattcacaagtacatgcgttcaaggcccaagcagttaaaaccctgcacagataaattgtaagagcctgggtaaaagaaaatagaatttcctggtaagtgagaatgaaaaaaaaaaaaaaagtttaccacatgtgtagatttaaccagtacgttactaatgcagagaagggaagaatcaggctatttcataatcaaatgttgataatataagagaggggcaagtttattatgtcctcatcagaagcaagaagctggatgtcaggtatactgtgaaaaattgcacaagccaagacctaagactggattaaaattatcaaattgttattagatgaaagttactagaatattgtcagattatcctaaccataagagtagcagaacagtactcaatgtttctaatcagttttgtctattttctgagctggttaaacatttgctgatgtgcaatttgtaaagtcacagccatctgttcatttgtgtcttaagtcttcctgcataaattctgctcttttacctgttttggggaaataaaagtttattttaatttactgccaaaatttgtggcacaggaaagggataggttgaaaccaaaaactattttgcttttttaccatctattagtcatcctttgaaaaatcaatattcagtgctcaccccgtctgtggctccaggcaatcaaaagaaaattgtgtactgtccccattcagactgatgatgcattgtgccattatcctgtgagctaatatgagattcagtatctgctgtcttacctgacaaataagccttcagaatccaggcttgggcacattatttgaagaatctgcagctttaatataatttatattcccaagttccttctactgcttcagtatatgcagcatatgacttgagatagaaggataaagaaaccagaatgattctcttctttcctaccccatcatctgatcaattctggacattcctttcaaccctgtggccatctattacaagttgagtgcctactatgtgtcagagaatatgttagctgctgggaagacagttatgaagaagacggggtctttccagttgttcaactttttttgctactcataaagaggataaaagaaagagaaagaagagaaagaattccagtctgttaggaaatattataaaattactccaaagtggggatgcagaattaaaatataccagaagtaaaaaagagaaatgctgatgttctatttcatgatcaataataaaaacagtaacagcttatatttgttgaatgcttattttttgccatccatattgctaggatttgtcttacttaatccttatcacaacgctgtgaggtaggtactgtaaataaatccattttagaaatgggaaaactgaggctcagggaagttaaattccatgtctacaataaaatatctcaaagcaatggagttgccgcagaaacctacctgcctccgatacctgaacccttccttgctatgctatattgcaggaacttggccctaaactgacaccttgccaacttgggatacgtgttatttctaaagatgaactttcaaagtgggttaaaagagggagaaggccgggcgcggtggctcacgcctgtaatcccagcactttgggaggccgaggcgggtggatcatgaggtcaggagatggagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagatcgcgccactgcagtccgcaatccggcctgggcgacagagcgagactccgtctcaaaaaaaaaaaaaaaaaaaaaaaaaaaaagagggagaaaaatggtaagacatatcttcctaacagttagaaatgaacagagaaatgagtcaggattgaggacagggctgaaggtgtcttctgggaccagtcaagagtggggtgtggtcaggctgctgctgctcactcctcctcccacgcagcacccacaggctgcatggtgcaactgggaggcttgctggaaaatggcaagtcctgctgcaggcgggctacagtgggcagccctcacctccactcctggccaaactgaccagggccactctccttacacagagaccatgctgctgaccaggtctctctggggccatcagcctcaggtcagcaaaaggtcttacaaaagtcaagaaattgcttatgattacagctctgcaatgcaaacgcgtttttaccaacaaagaaaaaaaaaaggttggagaggaagaagaagagagaaaaagaaacatttggccaaggccagaaagggtccaccgaagtcagcctccgaacttccggtccaatgttgacaccttgttcactggtgacaactcaggactgtaccccaaattacacaatgctacttgagggaagcaggcctggcagcagagagagaattaccggcacacattagtgagagcaatcgcagccaactcaaaaccgcactcgaaaacggccttgcattcatggactggtagttacttcctggtttctaagaaaccaaataaaattaaaactcaccattaataacaaaacaacactttacagtccccccttccctttcagagacgcatcaagtgacggcacctgatcaaagctgaattattaaaagtctatagattaatcctgtaactctcaagagcccagagtttgtaatttcccagggaaaaaaaaaaaaaacaaaaaacaaaaaaacagaagcaatctacaccgtgaaaaatttaattgcactttaattaccagttaagctgaatagcatgagatatgggtgcctttaatttttaatagtcgttatgattccaagagaattttaaagggaaataatttaatctcttgagagtattctcctcttctgccactgccaaaatcaaaatgaggacagaaaaaaatgtaaagggcgattcaaattcttccagatcataacccaggacggcccccagcaataataaactggctgttcccaggcagctgcactgcacattttcatgatatgctaatatagaaatgggtttcctgcagttgagttctggtacattaagcagataaacgcccttggctggggtgtttcttttttaaaatcagatctaaagatggcatacttgtttctttgtctctcagagcctggcaccaatatgggcatgcatacccccacctacgtaacacacatacacaaacctgggcacccatatacacatactcttccacatgctgccatgatgccccaaaacatccttttgaaaggaaaaagggaagagggtaacacaatcacacaaggctccaacaaaaatggaaatcagcaggtctgagaattcaaaaggaaataagcgtagcctccactttcactttatctgagaaccacctgactcaggaaggagctggcctcttgagagctggtgcaggagggagccgcctggaccgggtgaggctggccactttcccctttctcaagcacacactggccttctcaacttgctgaggctcttgaggtttgcctgttgtgcaggtgtagttgtctccattgaggctgcagtgtgcctcagcctcttcttggggatgctgtcccatcccaggacagtgcttttttttggaaataaattaggttgtgatttcttttttttttagtttttatttgtgagacagagtctcattttgttgcccaggctggagtgcaatggcacgatctcagctcattggaaccactacctcctgggttcaagcgattctcgtgcctcagcctcccgaacagctgagattacaggcatgcaccaccacacctggctaatgtttgtatttttagaagagatggggtttcaccatgttggccaggctggtcttggactcctgacctccgcccgcctcggcctcccaaagtgctgggattacaggcgtgagccactgctcctggccggttgtgattttaagaagtcagactgggctcaaaaggcttttcatgaggtctccaaataactcagggctctgtactgcctctggttcctgctgctcactactatcaaacacataacaagtatgggccttgttattagtgatcatttggtaaatcaattacaatttcatctgtcaggcaaataagagaagaaaaaacctgcagaaccatctgccacttttctcttctccaactgtgcacccatttcctttctccaaccctctgtatgaaacctgcactgacagacagtgctatgccaggctttcggggatttgtctgtgtctccctcagggaccaatagcacccacctcagttgggacccacagagaaagcaggagaggcgctttcttcccaagcccagtgagttcaaaaggaggaaggagtagagttctaactttgtgaaccaaagaagtgcccctccctgagaaccctgctgttgttcctttgtgtggcagctggtcatacagacaaaaacactcaggtgagagagaacaaggagtgcaacgtcaggaaggcattgtttagattcccaagtaaaggctgaaagcttggcgtggttaggaggcaagacgcagaaaacatcctagtgcgggcacaattgtgcctgaccaggacaaaaaggggacaatgaaaagaggatcctggccaggccagcacagaggagcttcccagggccacactgctcagggacaattccctagtgagacagaactgcagactggtggcagaagtttctctgtattatccttgacaacttattattgtaaagatttggaattagctgtactgagtcttcatcatagatgacaggttctctctcattgtcattttcacaaagtcccaagataaagagaccctccaggtagctgaaatgcaggtacccaatttaccactggagccaagattttggtttcagaggggacaaacgaggtaagtagtactcattgggtaccatccatttcaccaccagaaaccaatttcaccaagtttaacagttcttcctgctgcctgggcaggaggcggccttgtctctttccgcagtactctgggagtctaccacaaggcagcagagccttcgagttagagcagctctttggaacaaacatcacctctcttgctaggtgaggcctctcacccaacaggctgggagaggctgtcacagaactcagaactaagagcctacaactcattctgcagctcaagtatgagacaggctcactgtacagcaatttgtactggtgatccctcccctggggatgacccccatgactctggcgccctgaggcagggcacctgtttcagaatcccccgctaatcctccttactcccttcccagaactctaagcatccttgtacagatggcattggtactggcaagactgtggtctgtgagtagtcaggaagccagtcgacagcacctactctgttattcacccaaagcctctgtctccactgcagccacggagttgaaggctggtgggggcagggtttggggagtgattcaagaactgatcatccctctgacctgcgctatggacctgagcagcagtttcaggtgtgaggagcgtggaaaagggaaagcctcttagagcttatgtgtctagcctgggtaagccccaggaccagcatcagaattctgtaatttgaatgagaactgagctgagaactgcagagaaagacgcacttttcaaagaattccccaacagcaaattgaaatatgggcacgatgctgaaaagagatgaggctgccaaagccacgtggccgagcagacggagggagtgcagtctccacactgaggctgactgaaaacataaataactaggcaagatttttcagtagctagtgaggttatcacatactctggacaaaatccctagtgctcattacacttctgatatgattttctcacctctctccaggctcactgatgcatcttccaattcaacatggcttcttgcctctgaaaggagagctagtccctcctggaatttgtaagtgtgaaggctgtgtttcagctgtcacgtctggtgtatcactgatgcctattcctgtggcctttccagtttcccagggtgatgcaaatgaacaccgtgcagcaggtaaacagagcgctgaagtgcaaagtacagctcttatttatagatcaaacacctgccatcaatttaaacagtagttatctctaacttgaaagtttagcaagatactgaatgcccccttgaagcaaataattttgaagcagttcaggtatacagatgtgtttccagcctacttaagaatgctataattatcatcaaaaagacagattccattaactatctgttatgctttctgtatgtgtactcccagacagatttgaaatgttgaaagtcttgggtttcttagcactatacttttaacattatttttttaaaggactgggcttaggatcttctgaatttggaaaaacatctgatgagaggtttttggaacagttaatgatctaatgtggccgttcttgtcattttgcctttacaaccacagttccatttccaccctctctctaccagacacataaaaatttcatatttggaaaaagctatcttcctaaacacagatcagtgaggagtgaacacatctctaatcacaaatggccaataaccactatttcttgaaagttaaaaatcaggtgatgtgctgtacaggtgctctatggatactgttccattaatctttttgatgaattcttgaaaggttatcttcattttactgatgatataaactgaggctctgaaaggttaagcatgctgcctgaaatcacccacctagtaaatggaagaatttacatttgaacatgggtctgtgtccactccgaagcccgttcttcctactgcatacaacacactagcacagaagatggtcctctttctttgcttagattgtttcaaaattgattttccattttcagggatatggaatgtcattctggaagtaggtgataattatgttcggtggcttgagattggcatgatctccgggatacgagtctgcaggccacatcagccagtcacgtgtgtgggcaactcactttacctcggtggacctttttctctcccagaaaaccataaggatggattgaaggactaaagtccaacagttaaaactgttccttttaattctaaaatcctctgagtgtatgaactgcttcacctttgcatagaggacaagcttgtgctcaggagggcctgaattatttcagttccctgaatgtgctggccctcctcatgcaggagctgccccagggtttgtaaaccttcccctactaccaggcaccaccactgctatctgatggccgcacaaaggaatgagtgaacaccgtcaggaagacattggtcctgtgctctacgagagggtgtgcccaaccaccactgtcctctcagcatcctccattgtgaccaacgtcaccagggctgcccgaggaaaccctaagagagggaggggtattttccgtgaaaacacacctggatgcaggtctaggaaaccaacccctggtcagagtagcccaagagagaacaggcccatgcccagtgctttggtaagaatgacaaattcttacttctaaacaacagttccaaaaaaaaaaaaaaagagaaagagcgagcgagagagacagagaaactcactcagtagcaggaactgagaagaaaggggtcactcactcactcagagtgggctgggagggaaggcttcatcatttatcaggatatagtcatgaatacctctttttcttctttggaaaaatacagactactgtgggtgagtaaatctcatctagtgggcaagccggagtttgatttgagcaaagaatagaggggtagttggggtgaggaggtgaggaggagaggaaggcatggagccatggtcatgagacagcttctttttttttttttttttttttttttttgagacggagtctcgctctgttgcccaggctggagtgcagtggcgcgatctcagctcattgtaacctccgcctcccaggttcaagtgattctcctgcctcagcctcccaagtagctgggactacaggcgcccgccaccacgcccggctaatttttgtatttttaggagagacggcgtttcactatgttggccagcctggtctcgaactcctgactttgggatccacctgcctgggtctctcaaagtgctgggattacaggcatgagccaccgcaccaggcctagacagcttctttcatttgaaaatgttctcttagataaaatgtataagggtcaacatgcagcacacaagcaaacctccttcccccaggtgcaagcacagcagctggcctgaagataagagttaaatgaatccagccccctgaaaggaaggttgtctatgctacagaatcaaatcaggaagaaaggaagctattctctcacctaagggcattgagaaaggtacatgaatagtaattatctaaaaagagataatcaacaaggagtcagaagggcaaaaccctgtctaactaatctacttcacctttacagcaaggctgaagactaggtgggcaacagcgctgcatgtcaaagggtttactgtgatttcacaaagctccatagaaagcctccaaatgaagactggcaggctgggaaagtctctgaaaccatgaagaaaagggactagtggaggagctgccctcaagagaaaggcaagatgttgagtttagatggcctcagaatattaagcacctaacctgctctgtcatttaggttaattcatggagccctatatatatatatatatatatatatatatatatatatatatatacagatgaatcactggcatgagatcagctaaaatattcattgtagttgcttttaggtgattgtagatttcttcattgtttcaccttttccgtatatttttaaatgacagcaaaattttataataaagtttttataataaatttatttttataataaagaaaaataaacagaaggcaaattgatatcctcacataatgtgggagctacaaaagggatcctaagtcaaagttagtgcccttcctgtctagcctgggaggaaaacgtgactattaaattaattactgaatatgatgtgaactgcagttctgaggacaaggacctgcatttctggtctactcctgttttgaaggtaaacaatttaataatttcagtgtatagctacctccaattatccaaaccactgtcttcataggaatataagaaaattaaggtagatacctgaagcagcaccaggaatcaggacagatagagctcagttttttaaaagaagattctttcctggtcttcttcaactgggggcaaaaaaaaaataaaaacgaaaaaataaacaataaaaataaataaataaaataaaaagaatgctactgttacaccacatacttgttttaaagtcttgcccttctagtactgactacacgcggccccagggacctgtgaaatggatgctgctgcaagattttatttaaacaacatcttgatcttctgtgccatgtgactggcattgcggagaagctgctctttctaaaggcttcaaggtcacttaagcttgtgccggctctgctaagagctccgatgaggaataaactttaagatcttctactagacagaattttggaattcccagcagacctgtttcccttggcttccagatcctctcaaatgaccttatcccttatcccaccatgcacacacacacacgcacgcacacacgcacacacatgcacgcacacacacgcaagcacacacacacgcacgcacacacgcatgcacacacacacactctatcttcactgaaggctcccaagacatcttcctcacaaaacacacaaaacaaagacagctgtccattggtgctcaaaataaatgaagggtaaactaagcccacagacaccatgaggtgaggtgatatcagaaagccagagcaggacaatggtcttgatccatccgctaaatctttaggtacaacctccaaggaaaatgactttcagtcaagccaggcaactattgctaccaacaataaaacagaagatgcttttacactcatggccccagcattgtttctcacaactaaaagaggccaaacatcccaaccagaaaaaaacacaaacacacacaggaagcaactgttaacaaatggaacgtgatagtggcagagcccagaagagctgttggttaactcaacacgaaggagtccttgcctctcattcaggggtgcacacagacatgaccctaccatgcttttccttccatcccaatctccatggtcatctagtccaagctgtacgctctagtttttctcaaagtggagcttatgggtaacctccatcagaatagctggggagctaatgacacatggatcccagatcaaccaaggggattttagagacatggggcctagcccccaagtgactctgatgcatattaagacttgagcatcacaggtcaagaagtacacagatcccagttatcaacatagccagatggctggtggtagaagcaaccctgtccctgtagcacctctctgtgtcctgctcaaaagcattaaaacatcattcttagataagaacagagacaaaggatatgtctttaacactttacagtctataaagtttttccacagccactgtctcactgaatcaacccctaagagacagaaatgaaaatcgctgtttttacaaactgagaaattacgggcctttgaagtgtttcacagccttcacagcctgctggtaagaagcagagatcaggccttggacctgggtcttgtgattccaaagcccatgatccttcggattcatcaaagctccactccaagtgcctactgggactgccttgcagcactcaccttctgtaggtgagtaggtaagttgcggcatgccattctttcaaaagaacagtgcacctctgtgaccgaatatgggccacagtatctcaaggatattttggtcaaagccctggggtgtggggcagaagataatgtattcaatgaagcttctagagaaaagcataataaataaagaagctcctacctgtcgctagccttcctaaatatcccaagaaatcaagaattttctcccaatggattacagctgagcatctactcagaagagaaaatcaagtccatttcagtttagacggcagcagcaaactccccacagagagtactcccggggtggctagggggtggacagtgccattactgtatcaatcaggccaaggagtggggcttgcactactgtttgctagaatggagcttggctctaaaacaggattctcagacacatttcagaataggacgactggaacaatgcaatactcatctaagcaactgcaaaagccagctacaacccaactcaaggtgccatctattatgagaggtccccttcatctatgtaaaaaaaaaaaaaaaaaaaaaagaggagccaagatggccgaataggaacagctccagtctacagctcccagcgtgagtgacatagaagacggtgatttctgcatttccatctgaggtaccgggttcatctcactagggagtgccagacagtgggcacaggtcagtgggtgcgcgcaccgtgcgcgagccgaagcagggtaaggcaatgcctcactcgggaagcgccaggggtcagggagttccctttcctagtcaaagaaaggggtgacggacgcacctggaaaatcgggtcactcccacccgaatattgcgcttttcggaccggcctaaaaaacggcgcaccacgagattatatcccgcatctggctcggagggtcctacccgacggagtctcgctgattgccagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaacacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtattccaacagccctgcagctgagggtcctgcctgttagaaggaaaactaacaaacagaaagcacatccacaccaaaaacccatctgtacatcaccatcatcaaagaccaaaagtagataaaaccacaaagatggggaaaaaacagaacagaaaaactggaaactctaaaaagcagagcacctctcctcctccaaaggaacgcagttcctcaccagcaacggaacaaagctggacggagaatgactttgatgacctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactatgtgaagaatgcagaagcctcaggagccgatgtgatcaactggaagaaagggtatcagtgatggaagatgaaatgaatgaaatgaagtgagaagggaagtttagagaaaaaagaataaaaagaaatgagcaacgcctccaagaaatatgggactatgtgaaaagaccaaatctacgtctgattggtgtacctgaaagtgatggggagaatggaaacaagttggaaagcactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaagatcgggttaccctcaaagggaagcccatcagactaacagcggatctctcagcagaaaccctacaagccagaagagagtggggagcaatattcaacattcttaaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatcgaaaggaacaaccggtaccagccactgcaaaatcatgccaaaatgtaaagaccattgagactaggaagaaactgcatcaactaacgagcaaaataaccagctaacatcataatgacaggatcaaattcacacataacaatattaactttaaacgtaaatggactaaatgctccaattaaaagacacagactggcaaattggataaagagtcaagacccatcagtgtgctgtattcaggaaacccatctcacgagcagagacacacataggctcaaaataaaaggatggaggaagatctaccaagcaaatggaaaacaaaaaaaaggcaggggttgcaatcctagtctgataaaacagactttaaaccaacaaagatcaaaagagacaaagaaggccattacataatggtaaagggatgaattcaacaagaagagctaactatcctaaatatatatgcatccaatacaggagcacccagattcataaagcaagtcctgagtgacctgcaaagagacttagactcccacacattaataatgggagactttaacaccccactgtcaacatcagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgatcacatagttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactggatacataacgaaatgaaggcagaaataaagatgttctttgaaaccaacaagaacaaagacacaacataccagaatctctgggacgcattcaaagcagtgtgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacaaatccagcagcacatcaaaaagcttatccaccatgatcaagtgggtttcatccctgggatgcaaggctggttcaatatacgcaaatcaataaatgtaatccagcatataaacagagccaaagacaaaaaccaaatgactatctcaatagatgcagaaaaggcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagacaagtcaaattgtccctgtttgcagacgacatgattgtatatctagaaaaccccatcgtctgagcccaaaatctccttaagctgataagcaacttcagcaaagtctcagggtacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggatctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatgaagctaccaatgcctttcttcacagaattggaaaaaaactactttaaagttcatatggaaccaaaaaagagcctgcatctccaagtcaatcctaagccaaaagaacaaagctggaggcatcatgctacctgacttcaaactatactacaaggctacagtaaccaaaacagcatggtactggtaccaaaacagagatatagatcaatggaacagaacagagtcctcagaaataacgccacatatctacaactatctgatctttgacaaacctgacaaaagaagcaatggggaaaggattccctatttaataaatggtgctgcgaaaactggctagccatatgtagaaagctgaaactggatccctttcttacaccttatagaaaaatcaattcaagattgattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaacaccatcaaaaagtgggcaaaggacatgaacagacacttctcaaaagaagacatttatgcagccaaaagacacatgaaaacatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctcgaactagaaataccatttgacccagtcatgccattactgggtatatacccaaaggattataaatcatgctgctataaagacacatgcacacgtatgtttattgcggcattattcacaatagcaaagacttggaaccaacccaaatgtccaacaatgatagatcggattaagaaaatgtggcacatatacaccatggaatactatgcagccatacaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtagggggaggggggagggatagcactgggagatatacctaatgctagatgacgagttagtgggtgcagcacaccagcatggcacatgtatacatatgtaactaacctgcacaatgtgcacatgtaccctaaaacttaaagtataataataaaagaaaaaaaaaaaaagccaccgccagcatgcctctagttgctgcctcagtctgaggagctcggctgttttactgctgacaccatcttatggtatcctttgcacgatgctaacttcctccgctgagggtgaagcctcacttaccattctctgcagcaatcccaccaacctctcatccagtgactctagtggggccctttcactgggcccactttgtacttggctctccatagttcctcttaactccgtgatcaaaagacatttttacatgtgttataagcctcttttaaaaaaatcttcctaggaaagactctcttcaaatctctactagaacagggctgcatccaagtgagtccttaataaatagaatttgatcatggtaagaagacatgtcccctgctcgtgttcttgtcagtcctgaatgggtgaggcaaagtgctcagacactgtgctagcaaagggattttcagtctctgcctccctaattatgacattctttttctgcctcccacaggcacaagggccctgacgagggagtgctcagttctttggtgtgaaatatagtaagatagaggccattggcttcagaggaatagagctggataaaaaagtacaaaaggaatgtgaccagtaacaggaatggcatttagaggacctgattcatctcttctacattgttcaggacgattgcaaaatccatttctccttctctgtccctgcttctctgcccttcccccaagctttcttgctctctgccacacgtgcgtgtgcacacacacacgcgcgctcgtgcttgctcgctctcgctctctctctctcttttctaaggctccaggcatccgtccctggagaagtgcaccttgggaaggcgatgaaatgaaagaagggcacatcctcctttaaccccaaacatctgaagtcagcgccgcgcactactgcgatttcctgggccaaatgcattgttcaggcaaagctcccattcatgtcaacagtctcagcaggatttaccaaattcagccatatggacaatattcacagatactcattcaagaagctctcacagttccaacttccaccttgttgactctctctcatctgtttttcccacaagtcgttcaattcagttgttgggcaaccgttcagggaagcctttaagtagagatttctgctctctcattgggcagaagagaggacaggcaaaacagtgagaccgccaaatgaggaaagaaaattggaagcacttctctgatttagtaccaaacttgctccaggataaaactgcactataccaaaaactctggcagggtatcaggtactatggggtgggcaaagttcccaggttttacttccagagctgactgcaccagggagacccacgtgctcccgaaggcaccgcacgcagggcagggcatggccagaatgacagcagatgtcagctctggactcttaaggacccaaaggtccagggtcacattttttgttacataccagcttcctcccctactcacgactggagagttgtggcttctgcccccttcagtcacagctacttggggtgtctgaaagcatcagggccatgccatctagcaatcttccccaaagtagggaaacagcggtaccctgcacaagcttggcatagaggtgttccctcaaaattatctttgcacacagttggaggatgaccaaaatataggttgccatttaggcaaatgacacgaaggaagagatgctttgtagctaagtatcttttccatactgggcacccactaaaggttagctgtatacatgaatggatcgatgattggatgaaacgacacatgaaaggaaggcattgttttctcaaccaagccaagtactaagtaatctttgaaaatgaaaactcaggccgggcgcagtggctcacgcctgtaatcccagcactttgggaggccaaggcgggtggatcacttgaggtcaggagttcgagaccagcctggccaacatggtgaaacccccaactctactaaaaatataaaaattagcagccaggcacgttggctcacgcctgtaatcccagcactttgggacgtcaaggcaggcggatcacctgaggttgggagttggagaccagcctgatcaacatggagaaaccctgtttctactaaaaatacaaaaattagccaggtgtggtggtgcatgcctgtagtcccagctacttgggcggctgaggcgggagaattgcttgaacccaggagatggaggttgcagtgggccgagatcgcaccattgcactccagcctgggcaacaagaacgaaactccgtctcaaaaaaaaaaaaacaaaaaaaaaaattagtcgggtgtggcggcgtgtacctgcaatcccagctactcaggaggctgaagcaggaaaattgcttgaacccgagaggcagaggttgcagtcagccgagatcgtgccactgcactccagcctgggcaacagaacaagactctgtctcaaaagaaaaaaaccaaaacaaaacaggaaaatgtaaactcgccaagagctcagcaggaatggacgtgttactctcagagtagaccccataacagccacccagacacgtgagaatgcagctttgccttaagacagacattaaaggaagaaattccaccacctctccctgtaatctttgccagcgtgtgtcagccatcactcttgggaagctttttccatctccctacgttctcttagatttggaaacccacaacggctcccaacaagctcctctagatggctccacaccttcggcttgtggtttaagtccctcttcagttgttcctgagtctcatatctagaggaaactactacgggggaagttactgggatgagattggcaagcggcccctccacctgggatgagattgacaggcggcccctctatctggcctgcttctctgtcttcaggctggaaaggggctcactaggtgggcggagggcttctgtgtcttcaggctggaaggggctcactaggcgggccgaggccatgcgtggccctccctgggcatcttgtccccctctctgttcagcttttaaaaatgcctttgtgggctttgttgtgggtagggctttctcctacctgttccatgagtctggaagcccctgtgagagaggaattgatgagcacagcaagaaacagaacttcactgagcatgctgaacatgtgtcattattctaaatacatttttctttaattcctatgacaatctgtgagacagatactaattattcctattttacatctacagaaatctaaagtttagaagaattaagtaacttgcccaaggtcactgcctgagtaatgacgtatctgggtctagaattgaagtcactctacgaaaactccacgtcattttctcctaaacgaccttcctatgaaggcaaagacctcctctgccttaatcatctatctctgctcctacatctagtacctagcatctgctttctatgttgtatttaattaaatatttgttaaataaaaatggaagaatatgcatcatgtatttgtgccactaggttttaaggtgtacagttcagtactattaagtatattcacactgttgtataacagtcatccagaactttttcatcttgcaaaactgaaactctatacccattgaacaattccccatttctcctccctccagtctctggcaaccacctttttacgttgaatttgcctgctttagatacttcatataactggaatcaaatagtgtttatctttttgtggctgacttcacttagcgtagtgtctgcaagcttcatccatgttgtagcatgtgacaggatttccttgtttttgttttgttttggtttttaaatagagaaggggtctcactatgttgcccaggctggtctcaaactcctgggctcaagcgatcctcctgcctcagcctcccaaagtgctaggattacagccatgagccgctgcatccagccaaaatttccttgtttattaaggctggaaacactacattttatttcccacgccaagtttcttaaatgacccatttcatcaagttgcttccttaaaactctctccttatattagttcgttttcacactgctatgaagaactgcctgagactgtgtaatttataagggaaaggggtttaattgactcacagttccgcatggctggggaggcctcaggaaacttaagatcacggcaaaggtgaaggcgaagtggaagcaaggcagcttcctcacagggcggcaggaaggagaatgaatgcaggaggaactaccaaacgcttacaaaaccatcagatctcaagagaactcactcactatcatgagaagagcatggagcaaactgcccccatgatccaactaccaccacccagtctcttccttgacacatggggattatggggattataattcaagatgagatttgggtggggacacaaaacctaaccatatcactcctttaattcagcttcactctcggaagagctttaatacaatgacagccaccgctgctacctgttgagcactcacactgcgctaacggagcctctcacacgttttcacagaaacttcagggttatgactgtgatctgtagatgagaaagttgaggcccagggagattaaacggcacgttcaaggccacactgcttccaagtgcagcaatctggacctctgaccttccccagctccctctgactctacagcctgttgtcagtcactaatctttactgccttccagtgagccttagagatgatcaacacaacagagagcgacactgaggcccagatacatgaggtgacacctgtggctgcgctgcccattagctacagagctggggtgatgcctcgaactcacgatgcctggcccagggctctctgctccattccacttgcctccggcccacgtgacctctcccccaatccacatcccatggtttcctcaagatgcagctcaaggctcacttcttccagacagtaaaatcctcccacacgcactcccggtatttcgcttctcctttgctctgctggctgaattcggttggacacacactctcatagcagcatcatgtcctactctatgatcttccaaggaggaaagtgtgttccccttcccatcccaccacctaagagtgtcctggaatttggcagggcacttgatgaatgctttttgactggctatgccataaatttatgcaatctaagagctgggtgggccctgccttatcacacttattttccaggtgagaaactgagacccagagatgtgaggtcactcatgtggttacagagctaattaatgaggagccgagtccagaacccagtcttctgtcttctaatctgtcctctcctgctgctgagcccatctaaccaggattctttatcattttgcagcacagagttgtgccctaaagcctgaagtgggcagacacgaggaaagaaaggttaaattctacatttagtcattttaaggagatatgaaagtactacctttttatttccatagggaaaaaaagatgaaaaggaatactgaacagaaagaaaggaataaaaagcaatgcaaattcctagtctttatccacatattaaataaagacactctgtccttctccctctgtcccctcccacctcaatattgcttgctccttaagacgggccagggaaaatgcaattctctccagagtaaagtgtgaaagactagagaggtgcattaacattttataacctcaaaattcttcaataaattaacattattaaaggatatctggttcttcagtaccttgaaaatgaaatgacaccttctagaaaatatagattcacctcatttgcaggtttgctgtattgttagagccatctacatgtccctttccaataaaaagaaaggaagtcatacacctctgaagcattttatagttaatgaaacacttgaacacattatttttttttgatgataggtcattatgtgcttattttttgacattttaaaagttttattgtatgtttaatagacaaataataattgtacaaatttatagggcatggtgtaatgtttgggtacatgtacacatttttatcccagtaagatgtaaatctttggagaaaacctgatgcagatagaagaggcttctgatacatattaggacatggatgtcagtttttctgatttttttttttttgagacagggtctcatgtcgcccaggctggagtgcagtggcatgatctcgggctcactgcaacctccgcttcccgggttcaagcatttcttgtgcctcagcctcccaagtaactgggattacaggcatgagcccccacgcccagctaatctttgtatttttagtagagatggggtttcgccatgttggccaggctggtctcgaactcctgaccccaggtgatctgcctgactcggcctcccaaagtgctggggttagaggcatgagccaccacgcccggccagtttttctgattctacttactaactcacacttacccaagagttgtcctcttcaccttcttagcctggcttttttttttttttttctgtactgccctccagaaggaagacaatcacttttttttttttaagataggtcaacagattttaatgtgagatagtatgaaaagttcacttatatggtttcagaacaccttataactaacctataagaagctaacttaattctagggattaaataatggaagtattgaatatttaatcaatcaacaagtatttattgggagcctattgtacactgggcactattctaggccctagggatataagattaaacacagcagggggagtttccattctcctgaggttccacactagggccctttcacggatgagacaacaggcaaattcaaattgaaaccacagtgagatactaccgcccatccactaaaatggctaaaatcaagaagacatgtaataacaagtggtagcaaagatatggagaggtactctccgtattactctcatatattactggtgggaatgtaaaattatgcacccactttggaaagcagtttggcagttcctcaaaatattaattgcatacttaccatatgatctggtaattccactctagatatacacttgaaaaaaattaaaatatatttctatataaaaacttgtgcacacatgttcacagcattattcttaatagctaaaaagtagaaagagcccaaatgtccatcacttgatagataaatatgcaacattcataaaatattacttggcaaaaaaagaaaatactgatacatgccacaacatgcatgaaccttgaaactatgctaagtgaaataagtcagccacaaaaaagcaaatattttataattccatttatataaactgtctagaataggcaaatctagataaatagcagattaatggttatctagggactggggggctggggagatggggtatgactaatgagtatggggtttctttgggggtgataaaaatgttctaaaattgattgtggtgatgattgcagaactctgtaaatatgctaaaagccactgagtagtacactttaaatgagtaattatatgttatatgaattacatgtcaaaaaagattgtacataacatagtatgaagatatactgagaactagtggaagatgatctcagcagtttgttctcatgctgctaataaagacatacctgagactgggtaatttttaaaggaaagaagtttaatggactcagttccacatggctggggaggcctcacaatcatggcggaaggcaaaggagaagcaaaggcacgtcctacatggcggcaggcaagggagcttgttgaggtgaactcccacttataaaaccattagatcttgtgaaacttattcacttccaggagaacagtatgggggaaactgcctccatgattcaattatctccacctggccctgcccttgacatgtggggattattataattcaaggtgagatttgggtggggacacaaccaaaccttatcagtgtgtgggtaggcaactggcctgggcaccatgttgctgtttttcttctgtaactctatagagaatacccctctggggaagtttctgggccaaaaattggtgacagatagtaatcaacagatattgctcagactactgtaggaagtagaaagcttagcgataacagattttcctggcaacacccacccactaataagatttacagtttgctagagtggcaccagctgtatgaagattcactaaaatctcacttgagataggcaacacctatctctaaaccagaagagacaggtatttctttcttcttcctctcctcatgtcacctcctaacctccacagtgcccatgttgagttttagaattggcatttagagcaagacatagattcttggtgggtggcctcttgccagctggtcctgcccccctcctcgctacagatcacaagtgttggcctggtttctctcaccacaaacagcagtatcaacaacctcatccaaacttcacgtacctctttaccaaactagagctaatcccaagtaaacagcatttggacttcagaaatccggttccacgtttgtgtgaatgacagattccccaatattttagcagggcctcaccctcagttattcttttccatgatgacagttctgtatcttactgagactaataaattactgtccttcacaacagaggtacacaaaaggcctcaaacgatgagctggctaaaatgtagctgctctgttaacaatgatggaatgctagccatgacatatgcatagcaagcaatttttcctcatcttcaccaatgggaaggagctagcatttggccaagacctttgataagtgccatgggtcctctcacaccctcagacatgaatatttcggggtaaaccaggtacctgggtaactttctcatgtgctattctgccacagcaggggcaactgcccttacagtcttgtcccagaagaaccactaacaacttgaagtttccatcagtgagaaacgcacctgccacacagaccactttctagcatcactcacacaaaggttgtcgatgtttggaccaagttcgccagagtattttttcatttggttgaagttgttttcaatgttttccagtgactggaggtcaagtctggagcagtggcttgtattaatagatcctttgtgagggcagccgctgaaacgacacttcaactcatcactgacaagggaacagaaaacacggccaagtcaggttttgtggccacccctcaaactggccctgaaaatggcactgattctggagatggccaaatgatttaagtgtgcatgcacgtgtgtgagggataatcttggttcctaatttgggcgttttgaattggaaactttgccggacattgcctaaatcaacggtcaaagagtacagtttgttttttctctgagtaacagatatcagtttcctaaagctcactgcctttcttggaggagggaggggaggcctttgccaactttgtctacctccacgctttttgggcttactttctaatgaatgggcaggtctggggcatcttttaccacattcagtccagaaaggatctgtctgtctcatctaacctaaagcctggctcaataatgcctggtcaagaggctgggtctcacccttcggggctcgtttatataatgagtgtctctgggttcagatcttctcaataaaagatgtctgcctagcacaatccttctgaaatttaatggctgcaaccctgacagccttcaggctgggaatttatccgacatcaaatgaacaggcagcaaacaggatggagcaatctttcccaaagtgtgttccatggaactccagggttccatgggcagttaagtttgggacaatgcattccacccctgtcttatttctaagattctaagacatcatcagttttaagctcctcatcgatttaatgttttttttgtttttttttttttgagagttgaggagaagacgacacctgattataagtaatatagttttgtttttaacacacagtaagagcctacatttatctagatgagcactcaggatttcttctttagtatctcagttacagtttgcatctaatcactctttgccatctgagtctaagggttcactgagtcacttttgaccattagaagttatatggaatcttagagggacaagttgcttttcataaacttatgatcttggtctcctttgtatccttagaataaacaacataatgttgaatcctgtaaagaaatattcaagtttcatgtgcctttttttataagcttattgtttcatattttccttaattgaataacgtgactgaaaggtattgactttgctaagtgtcagctggaagctcttgacagattcttggagatggagtgatagttcttcataatgggggaatcagcattccaagaactgtcaaaccaccttctccgcacagtgaagcttccacgatccattcctagacatttggcaatctctgttgcctttaattactgcccggaatatgtgacaaaaaaaaaaaaaaaacctgcttttataatgctgattcataacaatgtttttaaaatacacattttggaataattttagatttacagaaaagttgcaaagatagtagagtgttcctatacaccctttacccagtcctctgttgctaacatcttacattaccaaggaacatttgtcaaaactaagaagcaaatgttggtatgtgactattaactaaaccccaggctttacttagatttcacccgtgcatctacccacgtctcttttatgttctgttctgacaacaatgcattcagttgtcatgttgcctcagtctcctctgctctgtggcagtttctcaatcttttcttgacagtcttgaagcgtcctggccaaatgtactgtacaatgtactctgatctgtgtttctctcttgcttttctcaagactaaatggaggtatttttgtaaaaaatgccacagaagtaaagtacccttctcattacatcctatcacaggggacgtggcagccacatggcctcacttgtgaagctaacctgatcccttagttaaggtagtgtttgccaagtttttccactgcaaggtgtagcaaatgaagggatctaagttaaattcaactttggtggactccctattttaagaactcacctgaggtgccatcaaatgggcaagcatgtacaaagactggctaggtccctgcatcttgtgcaggcagggacaacctcagcgtcctggccagggccgggagctcattggcgtgagaagccagacacactcactctcagggtctcacccgcatgaatcttgcaccccatgcacctcatttaacttgctctatgcccatccccgcttctgacactgattccaaagtttactctaattttagaaacattgaagtataaaaacatgggctttttattttagaatcaagtgtactgtaaaggttctgggacatcctgcagtaaccttatttaacctacagtttcccaaactaatttgatcacagagtcctcttttcacttaaggccctttcttcacctgaacctatgaatagaggggaaggaacagggctgagccagctgaatctgctttgagtcccagctgcctgactgtggcaagcttcctcataaaggaatgctcttcagagcctctgacatcctcagtcacaattctgatgcatttaaatgcatttctttgacctctcatacacccctgggaaggctctgcttgcacgtctgtgagctatgcacggatatactgacagtcctatggaagtggctgacctttgtcacgatatccgggagtaaaaatggtccagacaggcaggtaagcatgcgaacactgagttccaaaatcgtatcagagctgcctgctcattggaccactgtgaatgaggatgggctcaccccagccccctactaacctttgcatcctttaactgccaggactcatacctgactctaatagaatgaacttctgttctctgatactacatcttaacgtcctctgaggaacactgtagtggcaggtgggtaagctgaaaatttaggaagcaaattataatagacatcctagccaacctcatttcacagttctgagcagccccagtggagcaatcttcctgttcggaggatcacggcaacacagggagtaatcaccatttcagcccgtacatgggaggccagaaagggagatcctagtgtcatttaggcccaggctctgccttggctattgacaaggtcttttagggtatggggttacatttttgtcccactaaatgacagcagcatttggtgggtaacatgcatacataagcgcatagggccatccatcaaatcaacaattcatatagtgagtctcttggggaagacattcccacgttataggaacatgggccttttccattatatgagaaagtgaacttacagatacataagggcaactattcctttcatttttaaaaatttgtcaccttttaccaaaagaagagtggcacggtagaaaatgcatgagacttggagttggatatgcttgggctcaaatcctagttcctggggcaggtttccttttttttttttttttgagagggagtcttgctctgtcaccaggctagagtgcaacagcgcaatcttggctcactgcaacctctgcctcccaggttcaagtgattctcctgcctcagcctcctgagtagctgggaccacagacttgcgccaccacacccagctaatttttgtatttttagtagagacggagtttcaccatgttggccaagatggtctcgatctcttgacctcgtgatctgcccacctcagcctcccaaagtgctgggattacaggcgtgagccaccgtgcccggcccctgaggcaggtttcttaatttctctgagcttcagttttctcatgggtaaaatggggataaaaatacatacttgacaaggatattatagagctcaaatgagacaatctgctgaaatatttttagcctggcacagagaaaattagtaacaaacatggaattccctttcactccaagctccctttacactagggactgtctcatggttgataccagatggcccggtctcgattctgcacaagcttggtactctaacaccccagttttaggaaggcctcaagaacaatctgcaggggcaggggacctttctaatgatcccacacactctctggactgtatgggatcattaggaaaaacaggtatcagcgccctgatgcaagtccttctgaacaatccagggtttagcaggaggccaaggtgtttgatcctctctggacattatcatggctggtcttccttctgttctccgtcgacgtgacttgttagcgttaacagtgcctgtgggcaggaattaagaggacagcgaaaacttgctttgctagttaatgctctctctgctctcagagagggtcgagagacaacaaaggctcattcctgccagaaccaagaacccccacctcaactcccaactcctaccaaacattagccacccatctgaccctcatagacgtctccaagatcgaaaaatatcctttggcaaaaacgaatcattggcaatttggttattttaactacttctgtggccaggagagaaggatgagagtttcagctggatataaacagaagcaggagcttgaagaggatgagagaaaatgaagccagtgctatgatacagtccaagacagcctggtttcagttgagctgaggagaaactgaagctgatttcaaacgagtctgaaaacccgcatccctgtgctcccctcgcatagccactggccttcccatcctccgtgcggtcctgaactgaccatgcactcacaatagcacattcagggctggccatagggagccgtcttcgtgcaaggcaagttcttgagagaggagtctgtgtttatgaaggttaattccaggctcagccaaaggccacctaaggcacaaatgctccgagtcggttggggtttgtgtgttccatccgctgctgggcacctctctaggatgcgtatttctagtcagtggaccgtcctaaacatgtgaagctgctgacagatgaaagctggccttgcttgtggcatccattcttcagggcttgtacctgctcttataaggaagtagaactcagagagcactcactggcagcaggggactggtcctacactcacagcaatgtcccgactcggtttcagtgatggcttcaatgtctcattttgtgtcaccagtgttgatgaaaccttgacaaggcaaagcaaaacgacaagcacgccctgagcagagccccgggaattcaacctttaagtggataacttggcttctggtttgccaaggaaccagggcatcaaacagatgaaacagcctattgtccatttcaacaggatttttcaggagtggggatgatctttcaaattatccacaacttaattatttaatattttgatagtcaattacctaagacacggcatcgtcactgaccaatcagaagagatgccagtagttgggcgcagtggcagcactttgggaggctgagtggacagatcacctgaggtcaggagttcgagaccagcctggcctacatggtgaaaccccatctctactaaaaatacaaaaatgagccaggcatggtgggcacctgtaatcccagctacttgacagagtgagcctctgtctcaaaaaaaaaaaaaagaagaagaagaagaaggagaggaagaagatgaagaagagatggcagccacagctgggagacgggtcctagaaatcccccgtagtgcagggcatcctccctgtttgcttcttggattctgggaaagtcctcggtggcaagcctgagaggctgggcaaaggggctagagcagtggctattgacctccagggaagaggcattctatggcctgaacaagcagcaggcagcaccaggtctgggtgattctctgtcctgcagtcgtgggagatgagggcacgtacacgagggaagaagcacagaaaagaagcctctgcaaccttcgcattttttatcacactgtgttagtacccaggagactttagccttcccaaatctcactggatcaataacttcaggaaaaagaatttccaggagccaatttccacattagtttaggtgccgggaggtctttggaaactcagcccgagacacccggagacttctagtccacccccggggaattcagttcaatcctctgaaacactcagactatctcctctaggcaccgccagctcaggtttctactcagaacacatacatttgtgtctggggaaaggcaaggcatgaaatatacttcactgaaaggttgaaaagcatggagggtaaagttaattttcaaagaagaaaggaagtcaacggcataacacaatggaatgtgtgattcacctctgcagggcagacattgattttcccaccagggagtatcatcgaattagttggcagttgaaaatatgatctctgacttttttttccattccccttaggtcctacattttattttaaggccatgaaacaacatgagattaaaagtgtcatccagaaacagaagtggaaaagatgcagtatttcttttgttcaaagaaaatatttttgaagttatttcacaactaaaattgcaatgacaggtgtgtgggtggggtgcatgggctctcctcgcttggttcatattggacagaggggaagcctgtgggcttagggggcacagacccctcccatgaagagtcagcatcagggctgctctgggtgtaacccaggtcctgcaccgtttccagtggctggtgtcctgggaataggcatcagttggaagccacaccttcaccctgcgggggatgaggagggctaatggtgggagaaatcattcaggtaagaaatgttctcccacctcctagatgtgtggctttgggtgaggtgctcaactctctgagccacagctttcagagctctaaatggggactcataatttctgctatatctagatacatgtaggtctaggtttaggtgttctgatgcctaacattttgtataccttctttaagaatgccaagttgacaaatgcagaaatgggaacagagttttcaaaggggctcctgcaagtggaaggccctacagtttaagtctcgttagtgtcatggtgaatctaactttgcacacctgcctatctcaaataagaggtacgtatataaatgtacatctcaaactataattatataaatacatgatgttgaattactctataaatctgtaatacttaatgtatgctatgtgaggtgcaggaaataaagctgtgcaggagacatacaatcccacccgtatgaaacctaaaatctagaggcgttgcattatcatctatgggaggacatctattcagaatgtcctctgaatcctgaacttggaagtgaggcagatcacagtggaatggcttgattgctcgtctgcagcactagcccctctcagggctctctgaggtcctgatgccacacctggctttctgggcggtgagctctgcttgacctctgtctctgccctctccttgccaatcactgccttctcactcactctcattttgaaaccctcacagcaccaggccagcctttttattttattttaatttttattattttgagacattctcgctctttcgcccaggccggactgcagtggtgctatctcagctcactgcaagctccgcctcccgggttcacgccattctcctgcctcagcctcccacgtagctgggactacaggtgcctgccacagcgcccagctaagtttttgtatttttagtagagacggggtttcaccgtgttagccaggatggtctcgatctcctgacctcgtgatccgcccacctcggcctcccaaagtgctgggattacaggcatgagccactgtgcccagcccaggccagcctttctaacctttattttcaaacaggaatggatagcggtttcctggggaggcgggggcgacagtaagagaatgagggggtgacagccaaggagcatagttttctgggggagggtaattaaaatgttccgaaattgattgtgatgatggatacgcaactatgtgactacagtaaaacccagtgatttgtgtactttcagtgggtcagttatgtggtatatgaatgatagctcaataaagttgttaaaaatatgaacggacaaccaagaagcatctaaaattcaagaaaagcttggagcaagagaaagcagaattaataagcagggggaaaaatgaagaacactcagttcattcagaaaaaaaaaacaattttttaaatgaccaattatcctttgagagactcaagaagatgctgcatccacaaaataagaatagggagccatgaaaaaggaactatccaaaaacaagaaagagttcttgtgaattattaaaacaataagtttcctaagagataaaattttgattaaatgtctgcacaatgaagtcagggataatccctagagcataaagcaaaaggcccagacactagaaaaagagaagtttaacatgtgataaccagcactttcagagtgaaagaacagaaaaacagaggaaataaaattaaaaaggaaaaaatagggaaaacttttcccagagctaaaggaagacaagaatgtttaaaataaaagggtcttgtaggaatgaaaaagatacccatgccgaatacatcagtgtgaactttcagaacatcaaagagcagagcagagcctaaaaccttacagaaaagataaaacgggtgattgacaaaggatccagaagccaagaagcatcagaaataacagatcttacgagaccgtgtaataggcttttgaaattttcattgaaaattattttgaatggagaattttatattctaattctccaccaagaacaagagtactaaatctcaatctaatagtgggaaatcaagagatactgcctgaagttgatggaacaagaaatagaaatttcaatatagtgtttgaggtgtcacaggttgccaataaaagaattaaagtactattaccttcatggaaaaagagatgtagaatagagaaaagaacataataaaagctagatctttatttttcatacctaggaatggaccacttcttcagttgtaagaaacttaaatctaaaaatactacatagaggtaataaatataactctgagaagtattgaaaacagacatggttaaaaaaaaaaaacaaagttgcagctaaggagcaggtctgaaaggaaaagggagggatcccagggggagaagaaacccactgctttttattttaaaaatgagatataaggccaaactttttttttcaactaattaacgggacttttaaatacagatcctagaagcagtgcagagagccaaggcttggcatttgggtagctgcgcacttccaaactatactgcatgaaagcatttcacagaccgtgagttgtccagttacttaactttgggagatactgtcattcttgatgtcccttttacagattcaaaacatacattaagttattaaaagctctgagaagttctgtagaatataaaccattttgacttcatttaaatacaggtcaatttgctgaaagaccaatttgatgaactgttaatttgccgatgttactaaatttaccaacttttttaaaataaagatttaatactcacaatgggattgttttcaaagttttgataggaatgtgcaagttgcaaaagaaaattaaatagccaaaaagtgagtagagcacacattaatataaacagagaagattttacaaatgagatttttagactacttctggtttcttttggacatttctggatatcatttttaactttgcttaaaattttaagcattctaaggtttactttccctcatttcctccatgacctactggcctttattgtgtatttctaacaattaaacatttaagttaaatgtaaattcaaatgcatctcaaggacatcagaattttaaattaacttagatctaattcaaattctaaacggacggaaacacaaaattaaggttaaactatttacaaattggtgaaagaacattaaaaattctttacaaaataaaataacatttttaaagcatataaaaaaataaaatgtagttgaaacaatcctgtcacatatgaaatgccaaaacttcaggtagaaaaattgtatttcatataggaattgttcaaatgatgccgaattctgttgtcagccttccagcattttagaattttcttttctactgatacctcagacaggaaacatcttaatattagttaatacagtcatgtgccacataacatttcagtcaatggactgcatatgtgataatagttgttccacaagattatactggagctgccctatgcacctatataattttaaattttatgacatatttttgccctattttttctatgtttacatacacaaatacctgccactgtgttacaactggctacagcattcagtacaataatgtcctgtacaggtttgtagccaaggagcaccatatagtctagttgtgtagtaggatttcacaatctaggtttgtgtaaatacatttcatgacgattgcgtgacaacaaaatcatctaatgacgcatttctccgaacgtatccccattattaaacaatgcatgactatattcagaaaagcatctttcattgtcagcaaaacaggatcaaacacttagtagacagggctactaaatcgtcatgggtaaatgtgcatatctgaaaactaggctcttcgtggacttggtgtacagtgaactggcttttgatgaattggctttccataattgattttcggccaactgacctgaagccattttacttaacctagcttttcccaaattcatttgaccaggattctcttttcatttcaagtcaatggaacaattatcctgacagaacacactctggaaaccactactcaacaggaaggaagtcatatgcttgtactacaggccctggggaacagcaagccgactttgataataataattagcaactgctaacaggggaattaatgagaaaagaaacttaacttatatccagatgccatacttctataaatcggcagactatatattctattcactcatctccactggtgaaaagttccacgttttatattaatttttattttacttttttttagagatggggtcttgttctgttgcccaggctggagtgcagtggtacaatcaaagctaactgttacctcgaactcctggggtcaaaagtgatcattccacctcagcctcccgatgagctgggactaaaggtgcaccctaccatgcccagctaattttctaattttttgtaagacaaggtcttcctatgttaccccaggttgatctcaaacttcttgcctcgagggatcctcccactttggcctcccaaagcactgagattacaggtgtgagccaccacacccagcttatatgtatttttttaaaataaaaacattttaatagaaaattcatgggtgggaatgaagtgtttgtgttttttctctctcatgttctttgggtctgagaaagccttacacagcatgcttccatgtcttaatactctcccactcatgatggctgctgtgggaactgccagcagtgagggctggtagggaagaaagcaacacaggccagggatcacacacttacgagcccactggggtagacaggatgtggacgagtaaagccagcctggtggggaactagtggagactttggcaaactgacagagaatacgccaggtttaagaaggcagctgctacccagcatagctacagctgctttggggatgtggatccactgtaccagtcttctgattccccaggcaaaactagaaatctaagttaaaaaaataaaataaaatctcctgctttttagaagttagcaaatatttcattaaaatatccaccatgtggctaatcagaaatgtttcatatacatgaatgtgtatatatatatgtgtgtgtgtgtgtgtgtgtgtgtgtgtgtgtgtgtgtatgtgcatatacatatatgtgaaacaaagtaacatcagttgtattaccttaaaccaccaagttacacaaaaaattataagcaaccaaagctatactaactcctcaggatgttgtcttggaaccagtcggaggaaggaaagggtatgtgtggtcctaaccttatggaccacatgataactcatgacaagagaggcagtgagaattggagctgagttagtttgttttgtactttatttgtggctgagactaaagaagttttggaggattttgaaactcagaatctgaaagctagaagggacattacagtcatgtgggcaacctcctattcaataaaggaattatttgggtacaattccaacaggttgtcaactagttgttatgtaaacacttccaacgatggagtgttggatgctccattattgggtacctgaggtgttacaaactgttcttcctaatttgctggcatgaaatgtgtctttcctcaattccaagtaacaagtcctagttcctcctcctctggccaggaggaaaactcttcttccttcctacaagacagccttttaaaatgtttggaaatttacagcaggtatccctctccttcacagtcttttaaccttgtgatgaaatacctccagttctcatcagccatttctcatcatatggctacagaattcttctcatgatggtcatcctcagctagaaactgtctagacggggtgatggatacatgtaccccatcctttgatgttgatactatacttaaaataatgcagcctaaggttggattagctttactgcactgcactgttctctctggaccccccagatatatgttatgatttttatgttgtatgaacgaagaaatccaattcaaataggctgacgaagtaaaaataaagtttatcagcctaattgcttatgcaactcaacagtacaggagtaaatgcggtctgaggcagtgtttaaacaatgtgatcaggatccggttttcctctttccatttctcacctctacttccttggtttctttttttttttcttctgatctcttttagtcccaagaacgctaacggcctgcagtcttagggttctatgctcccttagttatgagcagtagtaaaggagaagtcttctttcttaatagttcgaatgaaaggccaagaacggacgaccatcacggctccaacatgaagccacctggctaacatgggtcacatgaccagggaaacatgacttttctagctttagccaatcacagacagactgcctctgtggtcaatcacatacacacgacatggctaggacccatttgaagttatattaagaaagaatgcagaaattaatgttattggaaaaaccaaaaataatctactaaacactagaaaaatttctccagcctattattgaattttacttccaaatgaagacttttccgtgtacccctactcactttgatgccaaatgcttctgattaaggaattaatttgaactttggttcagctctccaaaagattcttctctgctttgaatcccttccatatttgatatacataacttctacgtattcttctcattaagtctttgattaatgagaaccattaagaccaaaaaaacactgagctttgaggcatataccccactgcgtatttccccaaaggggtctatcaatctgtgaaagactatggttcagaaatagctatttaaaaggtataaattaacctcactaactcctatttttccatccataggaaatgtgccaggagacactatcaaatgccttgctgatatcaaggtgcactgtttctgtagcatttccaaaataaatgctacattttgtagcattctggctatattacttaatgcctgtagccagaaggagatagcacacaggggaactggagaacctccatagagtatgtcacacactgccatcaggtacatcaggtcctgacataatttctttgctccaggtaggacctcagctgctttctagagatccatcttttccttttccagctctcagacttcctcctaaatggctggcttgtgctctggtccaagtgggtcctgctgttcccttggaaattctaagaacctgctcttgcaaagctcaatccccagtgcataacataatggcggagagctgctgcttccttctctctcatgtaattgtcctttcatcagtctttttattggattctctttaccatctttgagtcgttttctatctgaaatgtttattagactatttctgagtggaatagtacagtggacatctattcttctggtttgtccagagttcacccaccctcctaggttttcaagaatgtctgtcccatttcaaacctgcatttttggcagggctgccagcacctcatctccctcggtccaggcagggttgggtgtgagacccacaaaggccaaagccatccatcccaaatacacagtttttaaatctggagctggagggaatagaactttttcttttgttatacagatagcagaacatgaatggggtgggggggaagaagctgctggaagccatctgtctcaccacgctgtggacaagactgtgaggaagaatgaggacagcatccaggaagggaaggaaggagggagagaaaaagaacgcaagagcaagaaagcaaaggagccagacgtcagtccgacggcccagactgcatccctgaattccatcgcagtagatctgtggctggctgtgcagtgtgtaggcaacagattctactctgcgtgaaggtgctcaggtggatttctgttacttgtattaaaattagcatcacagagtcatatggtaggaaaacagaatggtatagtggaaagaccactagagccctctgtagtgtagtaatagtttatacttttctaacaaagccaatctgggttcaggctgactcaaatgctttaaaaaattatagccaaaataaaataaatgaatccatggcctgagtttgaatcttggctccgtcatggagtgtgcaagttactaagtctcagcctcagcttctgccacagaggacaagagaggttaacatccttctcactctggctgtgaggattagaaggacaagcaagttgcttggtccacagtagcctcttaataaataacagcaattacttttcagttaaagaaagttgaaaggtagagtccttaaagtcctttcacctactcccctagaaagatgatgctaaccaatagctggcagatgcttttatgattgttgaatccagtttatctcacgttgggaggacattacggtgctatttccaattacaggtgagagcagatttgttcctctttcatactgaagggcagtgttattatgattggtgtcctttatgcaggaagagcaatttccatcatctgtttccctctttgcagagcagggcactgtctccactcctctcactactcccaagcccctgctctctccctgttcaaaggctatggctggccacccttgctacttcagttccccagaacctggctgggccatttcccttaacacatctaacaataagaatagtacacatttttccattctatctcacgagctcaagagctttatactaaccagcccagaagatattttccttgctctaaataactgtaattttgggggtcatttataccccactttttatttctttcaaggacctcttactgctcattataaatgccattatccttctctacaagcgatcaaatattataaggtctgacaagttagttttatgtttgcattgtaactgaagtcccatccatctatccttcgggagtttctgaaaactctatatgaacttcactcaaaatacacaagtagcatgtaagcgtgctgatcatattttcaaaattatgaagtgtgtcctttacataaaattaaaatgggttttaatgtgtttgagtcattcaaagttttatccttcattacccatttttcaggcccacctgatttcttttggctccctacaggggaaatgggatttctttttttcctactttctcttccacgaggtgagaaaaagaaaagagagcagcttggtagctgcacggaagccaaacaagagactgattcaacaggagaaattcaatgcatcccaaaagattccctaggaatttggtatcctgctgcttagagtacaatttgttgtaataagaaactgaaaatttttctatcaggaaagtcaaagtgctcagtgatggcttgttcaagttaaaaaaaaattgaactacaatggaaaatgtcttattctggaaatgctttcacaacataggaagcctaaacacaatttctcaaatcatatatattgctcatacacactggtcaacacaaacaaatgttttcctgttcaggtgacctagccccatacatactggtgaaccacaaacaattaaatgttttcctgttcaggtgacctagtcccaggagtggagtgtggcttccatcttattccacaaggaagttgtttatactgaaagtcaggcaaatgcaacagagataaagtctttttttttttttggagacagggtctcatgctgttgcccaagctggaatacagtggtatgaacatggttcactgtagcctcgacctccatgggctcaagtgatccttccttccacctcagcctctgagtagctggaactataggcttgagccaccatgccgagttatttttttctgtgtgtgtgtgtgtgtatttcttggtagagatagggtttcatcatgttgcccaggctggtcccaatcctgggctcaagtgatctgcccaccttggcctcccaaagtgctaaggcctacaggcatgagccaccttgactggattttttgttgttgttaagagacagagactgactcttaacccaagttggagcatgtggtggttccctgcagcctcgaactcctgggctcgagggatcctcctgcctcagcctctcaaatagctgggactacaggcaccaaccaccaccacgcccatctactttttttatgtttagtagagatgaagtcttgctgtgtcacccaggtctgtcttgaactcctgggctcaagttatcttcccaccttagcctcccaaagtgctgggattacaggtgtgagccactgtgctaggcccacaaaaggtatttcttatgtcctggcctgggttggtggctcaagagccaagcaaggtagacggggaataagtggggttggtccacagctgtgggattttggagtaaagggaaacaggtatccttgctgcaggtagggaggagcagcagaggagaatgtagaaggtagacagtgagcagagagaaagtatatgagccagaatgaaatatctccaaggaggataggccagacagaaaaacaaatggattctgaagacagatcctggaattagtatctaaaacattagagttcaggaagccttttaggaccacgagcatctatgggctgggtgaaagctatagctgggaacttctgttttccttggatactgcaaccaaggaggcacaggactggggtccctccaggttggacaaaaactttcactaggaagttatccaaaggtacaaagtagattctagtggctccctcctggtctgaacttttcccagtagactactgctacctagaatgactcatgctgttacaggaaatccagcagctccccttagcacatggttcttgactgggagcttgagtgttaaaagaggggattggattatcagaaagagcaggatttggtgaaagtcaaatggaggaatttggcatcgggaggatattttacaccgtgctttaagataaaggtttgaagacctccagttaccttgagggggtttggggggcagatcttccaacttccagcagagatgagttatgtgtatggaccaaaaggggagtcaggtggcactgccacttaggagagttctctagaacccagtgttgatcagtgtacttcttaccagaacttgggcctctctaaggtggtaatagtgcaggattatcacttctgatttgaaattaggagctctgctatttaccatctttattttatttattttattttatattatttattttattttgagacagggtctcgctcagtcacccaggttagagtgcaacgacgtgatcacagctcactgcagccttgacctcccagactcaagcgatcctctcacctcatcctccctggtggctgggactacaggcacatgccacctctcccagctaatcttcacatttttagtagagatggggtttcaccatgttgcccaggctggtcttgaactccaggactcaagcaatatgcctgccttggcctcccaaagtgctgggattgcaagcgtgagccactgtgtccggcctattcactgtcttgatgacagagagaaaaggtatgggtttccagggtcctggcatagccagggaagagtataaaaatgggtaggaattatgtataacttggggtttggggggaaaaaggaattgatatccttgtcccaggtaaggatgggaggcaaaggaggggcagaaatgagaaatgcaagtggaatcatgctgtcacaggtcgccctggccagatgtaaagccactaacttcatattacaggctttcttggctccaccccacacggtcctggggctctcagaaatgccactgcacaatttttgttgatacttaatcacttggtcagctgtaactgtgtataaagaacccgaaagtgttttaggcagattatttctcagggcagaacctctattttacacattattttatagtaaaggtaggtgagagtttaagtttgattctaaagctatcccaggctgggttcagtggctcacacctgtaatcccagaactttgggaggccaaggtgcgaggatcacttgggcccaggagttcaagactagcctgggcaacattacaagaccctgcctctacaaaaaaaaatttctttaattagcttggtgtcagggtgtgtgcctgtggtcccccctcatctactcgagaggctgaggtgggaggaacacttgagcccaggaagtaaacactgcagtgagaagtgtttgcaccactacactccagcctggacaacagagcaagaccctgtgtctcaaaaaacaaaataaaaacaaaatgaggctaccctaaaatagctgcataaacaaagccatgtcaaatgatgatattcccccatcagtgtcccctggactgctggcttctgggagaaggcatcctctggtggccaactagcacccatcaagctggtcatgagcacagcctccagctttacgccagtcactccaaggcctgagcatgctggccctggcttctgggtacccttccagctcagaggatgacagtgtggagctaaacaggggtttagccatagggagggctttgggaaatcagaggcactagattctctatatgaggctttaaaatagtagaatgatgaatgaaatcctgaaaatcaatcggggacctccaagagagataagtacttgatccactgcagggcctcctactctagcactctaaaaaccttgtccatcactggccaggccggatttggtccagcaattcctcctcaggttgtcaaaggcctggttttctggagatgctcacaggtgcccctcagctggctgttgaaggctatctgtaagctccaccagaatgaggactttgtattgcctgtttcgtttaccacagtgcatttaagtaggtaggtctccataaatatttttgttgaaaaggatgagtaaaagtgcctgacccaggaatgtgagatgtacccattcaaatcaactatgatctatacatccaggaggccatgcagtaagctgagaatcaggtagagaagatgggcaggcttctttagtccaaatgatatctcttgctctgtctcctaccggccaaggcatatctaaaggccatattcgacttcttgcatacaaataagatggaggttcctacagagatctgatttcctaaagccccatgcctgctagcattgatgtggaaagacacacacagacttggggcaggacgacagctgcacagtggagctcataacggggacaggggaggaacaagcagcttctcaattctcttgtctgaaagtggctgtggactatatctagcactcttgctacagggagagttaccagaataaagttcagcagcaggttctggcaatgctgtccagagtgaaacagaagatggggtcctctgaaagatggttgagtagtggcctctactagccaggagtgaaacactatagagatgtatggccaggaggtgacggaaagcacaggctttatgcatgttctgccatgtgcagcagcatgttggaagcaatgaatgggtcacctccccttcccagtaggggctacacatacatcagcagcacccaatcattttgtttcatccttaagacagatgggaaataggcaagctggatgaaggcatggtatgtgaagctgccagatcacctaagcctgtctgctgtcatccaaagctctgtcagaatgtgcaacacttgttcaaatgcctgaggtgacagcaatggtcagaagagctgctacattcaggagaaggagtaggcccaaggcaccctgcctcctctttttcagaggtgttgaagggccagagcttatgccagttccatgcacagagtgtcctagatttttcttccagaagtaagactacaaggctgggtcattctcacaccaaccagtaggttcagtgctggaaccactccacaaagctgggcaatgaaggtctttacccaaacgtacaggtggcatctcaagcaaggtgattagggctaaaggaagtcaaggtactttagaggagtagatggctgaagcagagatgttctcatttctcttgttccaagaaaagaagagccagagaaatcggtcataatgttctccattacctcctacctaaaccctcatattagccttggattatccataaaagtaaaacataagtaatgaggcctaagcgcaagtcagtggtgtaataaatatctactagtcattgtcatatcttctttccttcttcttcatcttccctctttctctattttcccctctttcacctcctttttcattggattttatgtctagattctgcattaagaaagtctttcagaattaaattaaaaggcttatatttaaaagtttttaaaaatgcttgggtcttgacggacccttcgcccatcactgtgcaggtgatcacggccccagtgtcccagtaagaaataaaccttacaaaatggacagcaaacagaaagaggccctgattaggcatgccagataattcagtatttcacacatacgaacacacgcacatacagagctcagagtcttgtatcgagggtcttccactaaagatactttaattgaaaactacagcatggaaaacatgattaagtggctacaagattactgttcactttaataagcagagaagaaaacatttattcatttatcaggtgaaataattctctaaatctcatcagagacaataaatggcaaacaacatacgtggaaagaatgttggatgaagttcagatagttatttcttcttctggggtgagaactggctctgagttgttctctaggtcctactccatgagcatggattaggaaaagttctaaactagatacaacagccaaggacccagcctgccctctaggaatgagcttcgttgtcagagacaatgacacaagcgtcctcagagagcaagctaacaacatctgagcaacaaggagagatgcgggattgggagaggcagacccaaagcaagcgctgggtatgtgacggcatcgaacgcgcgctcaggtcctcccactgtaatacgcacctgggatgcggggtcaggaaggcaggcccaaagcaagcgctgggcgcgtggctgcaccaaacgtgcgctcaggtcttcccactataacatgtacccggcaagctctgcagactcctgtaccagaatgtcacactgacaaaaacccatgaaagaacaactggagttcttcagaaaagcctgcttgaaaacagtagaaggtactgttatgaggaaatctcatagtttatcaacctatcttccaaaccttctcaaaaaaaggagaaaaaaaaaatcccccgcaaaattaaaaacgaatggggctgctatgtaattaactgacaatctctcagttacaaacccctgatttgtaaccatggcaggtacacaaactaccagctgcattatacttccactctctccacctgcccccattttttctgacaacaaagcacagaaaactatctgagctgaaatctcactcttatcagctttcttctccttgatggagatttcatagcccacctcccttgcctctttctctgatcacaacttaagtctcttcatcattcttgttcttctgcctttttcccaggtacgtcacaaaagtgtcattcccaccagcacaaaaatactatttatggacaacaaaattaatatcaacaaatcttaccctataatgtgggctttgatgaaagaagagatgaaggccctaatacgttttgaaatggctttagatcagaaacaacggaagtcaacgtcatctcttctcatattttcttgaggaaagagtgacattttagtgtgtgtggtgggggaggtacaatttggaaatggttatccaaatttaaaataaatataactttcactttaagagcagggggacctaacttttgatgtaccaagttaccacttaggaatttctcatgtggatttaccctatggattcaattaatcatggcactgtttgacacagtacacataaatggaaacgacagagattgatctaaaaattatggcatatccatgagatgaaatactatgtatctgttaaaaagaataaggtagctaatctggagctaatctagacagatgtctacactctcttgtaaagtgaaaaaagttacagaacatgggctagggagttatccttttctctctctctctctctttttcccgcacactaaggaggacctttggcttggcttcccttccttttctctaatccccactcctccatacaccacctcagcaggcatatttaaaagacctattggaaatgagtctttcccccagcaagacaagcaggaaaaacgcagaagtgcaggagaaagtggaagagcccacgtgaacagttctgaagggaagagagttgagagtaactgggaaagcagaataaaaggaatgggggaagcagggctttaaaaaaacattctgtgtattatgatggaaccattgttcatgttttctggcgaaggttaggattactgtttactttcaatcctctgacaccatgctaagacggaggtctatctggctctggaatatattcagaccggccactctcacacggaacatttccagaaggaaacttttagccatgtttatctttaaggagtgggacaacagtttgaagatgaggctgatttttacctttctgtcctcttaaattgtccttccctacaagcatatgttaatctcgcaacagaaatgaacagaacgggcgaatgtcctgaaagtcctcttcaaagccggaaacaccctctatatctccttatcactctctagttccgaaagaaaagtcaaatttaattaatattcgacgcacaaaaattttaaaacaatgtgctcaattttgtatttttctctccgtttttaggggctggggggggaatttatagcccatacagtggtgctatcaaaggctgagtagactttcatgggttagtctggagacatcaccataatctgtaaccatctttaataggaaaatgcatcccaagttctgaactactaattggcgaattaacattagactaagttaaacttttaaataaaatttatgaagtattttaaaattatcttcattctacttcctgtttacaatgctaagggacagatgagtttccatattagtcacatatatatgccgatactatcagaagacatactatgggctaatactaaacattatacattttgttgtatgtgatttctaacttgttttatgaaacatgaaggatgtaatgttgagttgcgtcataaaaactgagtaaaatctattgagtaaaaataaatgagagtagcaagaagggagctgaaggccataatttggattaaaatggaatagcagcactttctcctctaaggtcagcaattaaaatttagccaaggtcaggagtgacaaaatcatcaagaaagacttgacctccatctagttgttgcaaacaatatattaacattgtaaaactgttacagcagatggcaatgcaatcatcccttggtaactcatgcctagctaactgtctgtgtccttggctaaaggtgagcaaaaggcccacctcctgcgtctgcagggagccgatgcggggggctgagagcactcagtgtgaattccctcatgcacatgtgagaggtgaaaaccactgccaacttctccattcctgcctttgttccaaaattgctaacagggttgcagggtacctgacctatttgcatacattccttatttttacctctgcctgagctaaaggggaaaaaggcaaagtatgacaacatctaacctgcccatttctctcaactttgttggttctggtttatttatagccttttcctcaactacagctttaaaagcaaatgattcgtacctcactcatgtgaagtggatcaatgcagattggatttcttgaaataccaccaaaaagcaactcaacacacgccagggaagagaaaccaagggaggcttggaaatttgtcacccagcataagaacacagcacacacttaaagagattgtgacctgccaaacaccatgtaaatataaccaaacgtttcccaaacataatggactgtattctggtggaggacttggcctcacttacaagaaaggcctctttgtttaaagtcagtcaaactgccagctacttaaggtgtaagttagtgcctcaaagaggccctggtagatgtggggaagagaaggttgcaaaatacgtgcagaacagacacccgtgtaggtgtgtggtcttctttatggatgtggtggacccatgtaaagtttctgtgcttaagagtggcccgagcagggcagcctgagtgtcgaaagggaggatgaggcagaagaatcagtgcagcgctagccaagagtgaggaaccagcagctgctgttgggggcctggagaaagaagggtatttttcagtctgcatcttttggatggagtttatccactcacccagaggctgtttggcttcctcagagcaagccctggagttcagagaggtaacgccaaccatctgacctgcctctttttgcaacactaaggctcagagaggaagccttatctctttgaatgcgattcgtattttccgagaacccacaagatcgatcactctgagcaggcatttcactgctcatgggaaagtctacagtctcagccctcaagccaatccctcatacatttgattaaagctgactcacagtctggattccaaagctgttcacccacaggcagtggaggaaaccatctacagaagtcccgaaaacatgctcagggtcaggctggtggcactggctggccagggacctctgccatccgcctggctggtggagcctctgccgtcttcggggtccttgtggactgcaccaagctcctggctcacgcctggcttcctgaccaaacacctcatttctggtttactacctttgtccaaacaaatatcctagaccctggactcacttctgttcttatgttgaccctgggaaattcctctccctctagcgggaacaggaagtaccctggactctcacgtttccacctgctcctcttcgcttacagccattccctgcctgttgtcctacgttgcccctttgggctgacatggtatttgcacagtctgcaaagctgggaaattaaagatctgcccaggttggagcccctgttctccagggacctcctccctctgccatcgctcctggtcacaggtgctttcgaggtaccttcccgccagcaaccttgttctgtgctagagactgagccattcccacctcagattatggtccacatgtctccgtgcccttccccttgggctgctctccgtctcaccttctagaattatgttctcagccgactgcaaatcagggtgcagcatccaccagcgcctaactctcagcagttcaacactacccccttcaatgcttttctgagttataaaaacatctcagggcaaaacacctactggtctccaggagctgagatcagtcaagaagcaattacctatagttccttcacctgactcaaggagaagctgaggcagggccgtctccctgctgtcctccctggctcacaaggtgattatgaaggcaaatgattcaactgaaagcataaatcctgagagagataaaggaccattcttactgtcagccagaccaagggccccatatggccatcctcacctggaccagcagaggctcatgacacagcctctcaagctaggtctgagcctgcgttcctctacagctcccccaccaccctgagcccgtctttgtcactgcaagcgccacatcgtattgtaatcatctgctccagatagagacagcatctaattagtttctgtacacccacggtgtctgacacatggaaggaactttacaaatgatgaatgaatgcataagtgaatgaacaagaggagtgaataaaataagacttggttttaaacaatggttgagaagcagctggaaatgctccatgcaaagtagtaatcagaatgacttcacaacatggatcctttgcccaacgtgaagacgtcctagcccttatgtcagccctctccctgggacttgcctgtatggctccatggtccgagtaccatagaacaaggcttcctccaacaggccgaggttgatgcaggcatccatggcgcagtcgagcaccttcagctggtagatgttgatatcgggaagccgttcagaattgctgcttatgattgcctggcacatggccagaacctgctcccactctgttattaaccttagttaaggattcattgtcttcatcaagaaaaaaacaaacaaaattagattctctaaaaggctaaagagctcccaagcacaggagcgagggaagcacccgttatttttcacagatgagctgcctgaaaacacacttgagaagcaaaagcacagaagaggcatctcagtgaagtgaattctgtttacatcaacaaactatctcgtaaccaggcctgtgctttggagttttaaaacttccaaagacctgttcttgcttcatactcctagatgtgttctctttaaatctagtcataaataaatgcagtcctttattaaattggactaaagattaagttaattcgattttaaattatttactctgttagcttctgtttaaaaactgtttgaaattaaagatgctttagagagattcctttttcaaaaggaagagctcatgtttgcttctgtgttacctgagttttgggcatacatgaacccaaaaactcacacaacccacaggcacacactaggtggagcaatttgaagacatagatttccactgggtctcattttttccgattataaagcaacagtgaccccagcctgtacttaaccaaatacattaaaatatgttattttaaacccccaaaataagagacagtattaggaacatggcttatgcacatcaattgctggcaagggaaacgatgctttaaaaaggatggggagaagactcaatgtccacttctcagtaactgcctttctgattaaccatgagtcagtaacttcatctcatgtagccttggagtgacttcgctttttaaaactgatattccctgtcttacagaggcagtcagaggactgaggacatggtttatggagcgtaattttaatccctccccagtgaattctctgggaaacacagcgaaggccagagtgcaggaccctgggacctcgcagtttcttcactgtgcggtgtgttaggcgagctggagaccaaggagggtgcaggactgggactggtccttctctcactcctgtctcaccttcacccagtggagctccaaattcatctgcttcatatgttgtcattccagtagggtgaaaaggtttgaagatcagaaatggcagcctagcctttgactgtagtaaagctagattcagatctaatcgagtcctgtcatttatcagagttgaggttctgaggaagtcaaagtgcttaatgataggccagaaatagaaatgactcacgtcaacgtaagaatgagtaatatattgtatgtaaaatgacacagttcatgatgtgtcctctcatgagccagggagagttccaggtgtcagagacacagtggggaacatttcgtggcatgcacaaagcacatgctacacaagcattagtgccttccaccttccctctgtgacatgacctctgagcctgactgggcttaaagaaagtggttcagtggactgagtttgactgaactcagtgcccccttcgtgcccccacacccctcccactcccacatgacctggtccctttacaatccatgctctctgtgccatcccctgcccccaattcaaaaccctcttcactgaggtcctaacagagcacgcccagccctgagcagacagctcactgtttatggtcccctctccctctctgtccagcaaaaccttcctcttcgaatgtccatacccttctcagaacacggctttctgaaacattagcaaatacttctaataaaccaatcaagccactcctgagagtggagacaaatacctttatgaactttcacagcaaatgtattttctttccagcaaaggcctcccggagacacagtatcttactccaaaagatgagttccttgatgagaatttaaagcaccccaatgcacagctgagagcctgttccatcacacccactacaatgttaggatgagtcccgtcttggaggaattgaccctgatcccagaaaaggttcatttcctgaagaaaagcgagtgcatgatttgctcttgcattcatctgacatgtatgttcaaagtttgctgaatgtatcccctagaggttgggggaagcagtatcttaggcaacgcactgattttgtaacagattgctgggctaacctccgtggcttttcattccaggattagatatttgacgaactgtcaggaggaatgactgtctcttacacattgctagacatttctgtggcaagacttgtaccttattttaacattgtgctgtttgacctccactattatttgcctgttcatttatgtatgttcccacttattctaaagaggttcgaggtgacaggccttagaagtagaagccagatgtgatgttctgcagctactcataggaatgcatttattttatcccccagcaagctggaagggactacgtgccaatttcccttcacaatgctggcaactgtctcttgccaaacaaggcaaaacctttcctgcaaaacaccccagtgagccaaaaaatggaataattttaactaagaggcttttccccccaagctactactgacatgtatttgctcaaagatttagtccctggcatctgtgtggtgtttactacaattcactctgttccagtacggagctgagctctagacctagcagggctggagagtgcacccaaagagaacagattcctagtggacagaacggatatctttttttcctgaatacttttaaatgaccataagaggatcaggggaagagaaagggaagcaaagtaaattcacttgggaattactcaacttactgagattcaatgactgtcagaccacagagcttttattcacttaatcatattactctactgcttaaaaaatcatcccatggcctcctctcacctataaagtctaaccggtgcatggcagttaaggccttgccaccttcccctcctctcatattgcacagccagcagcttctcagtagcaatgcatgttctgcgcgtctgcacaggtcattccttgtgttggatgcctcttctcttggttggtctggtgaactcccactaatcctcccagacgcagctcactggtcacctcctctgtgaaatctttcaacttcccaaagttgactattgtgtctttgatgccgccataagtctgtatctttaccaaaatatgtattaatggacattttactaccccacaatataggagagtagtgagtgcagggctgtgtcttctaacttctgtctgaaccatcaggtgaatgatgaccagcaaggtacccagcacacagtccgttttcagtaaaaccttgtccagttgaaactgaactctggctgggttatccatgggccccaataccgctgccagggaccacacagaacaggtctactcctctgcacataaaggctctttgagcccatgagcagggacctcctgcttccagagttgactgttttccgttttcctagtatcttccatctcatcatagacagcgtttcaaatccctccttaatttcagttccacccctcaaaactagtttgtttttctatatcctttttaatacttcccacctcaaactgaatagaaaattccagaaataatcagactggtactatcatctctatcattttataatcaatattaatgcagcccaagatcacagtactaagattatattatactcttaaatgttgttaaattttgctatttactaaagccctaaatttttttcacatgttcttatgcatatttacatatttgaactttttgatccgaatagaaattttatatatgttcttgttatatttcatgtctttaaaacttggataccatttaaacatttagagatcttttgaactcttttttttctttcgagatactgattctatcatcccacctctattatcctccccatctacgtcactttggagatttgataaacctgtcctctgtatcttcattcgaggtatggaattatgcattaaagaggcccgagatggaaaaacaacactccagaatgacactgaatcatgtaacatcattttttcagtgtagctattcagttagctttgctaacatctaatgtaagtttcttgattacttttcgtcaaatccctttctaaagtctcgatacaaactttaccaaagaaagctgtgactctgtggattcattcgctcttggagaaaccaggcagcactgtgatgatcacagctttcttttccattccttagtaaccaatcctagattctttacccaagactgctaataaactcagtgggctattgattcaaaattatgtccttcacctttaaaactggaaacctccctctacctccttctctggctctttacaactctttaaatagcatcgtcagcaaattggaaacctcatctgctatgttcttagtgcctgggatataaatttaccccagagcctctgaatgaccttttgcagtcttttcatccaccttgatctcttccttcttgcctgctgtttcccttcatcacagcttcactccaatgaactcctctaccaggagcggcctccttctcagccttggcctatccaaatcctgcccctgactcaggctatcttgcacagtaaaacattagtggagccttcccagatgaccttcatcctacatggtctctccttactctgaactttggtccacctgtggtcattactattcatgctgagaaaatgtgtcgtgcagcaatccccactgccattgtagtcgtggctggtttaatatgaagcttctgggtctgacggtcaatggcactgaatgataaggattctaagctactctttcctagagatgttagtggttatgggagaagaaaattgaggaatttgttaccttttacatataaagagactaattcttactttcctactactgctaggccatgagttttgattattacctaacggtagtgagttattattcacgctgattttgccacgaacttccttgtcattactcaaactgctggccagggtcggaggtgcggcctgtgaccatggaacagaatgaaaaccactggctcatggagaggtcaaaccccgcctctgacctcattacgacagggcttcaagaaaacaaggaaacaatcccaacagtccacctcaatccacaggcgaaaggatactccagtgtgccttcagttcttcaatttttttcagggattcttgaacttccttccatacttgctcatcaccagttagcatatcagcatcctgctcaggccagaaaaggaagacaaataatctaattagtaataggcaaaggacgtgaatagacctttctcccagatatacaaatggcctgcaagcccctgaaaagatgcttggcatcatttatcatcagggaaatatataaagcaaaaccacagtgagatgttacttgatacccactaccatggctataatcaaaaagacaggataacagcaaaggttagtgaagatgcagagaaacggaaaccctcatacactgcacatgagaatgcaaaatggtagctttggaaaacactctggaagttcctcaaagggttaaacgtagagttttcatgttcccaattagagttaccatattaacagtcctactcctaggtatctacccaagataaatgaacatgtatgttcaacaaaaacttgttcacaaatattcacagcagcattgttcataatagccaaaaaatggaaacaactcacacgtctatcaataaaatatccagacaatggaatatgactccacaataaagtactacatgctacaacatggatgaacctttccacaataaagtactgatacctgctacaacatggatgaggcttgaatacgttacgctaagcgagaagccaatcacaaagaccacatgtatgattccatggatatgacatgcccagaagaggcaaatccacagagacagagtcgatttgtggttgcctagggctaagaggattggagggaactggagagtcactgctaatgggtaggagtttcttctggggtgataaaaatgctctaaaattgacaccatgctagttgcacaactctgtaaagagactgaaaaccactgaactgtacactttaactgggtgaatttcatcacaggtgaattacacctcaataatgctgatattttaaaaaaacagaagaataggataaatagttatttgttaggagacctacagctaaaaccttattaagtataaagtacaactacacccatgtgacccaattctgacttccacctaaactaaaaacaaaatcccccaacactgaaaaaattcaaaagaaaattatgagctaccatgtatgaaatgtctgccctcctattcagtaagcaggtcctctgcttccggttggccagtgtacgtctggcatctagcacagtgcctggcacatagtagttgcttactcagcacttgttgaatgaatgactgaaaaccacatgtgtgcacaatgctgaaggctttactgatatttactgatattgatatttactgatatttactgatatcgtcttatcttcacatagctcttctatgtatgtaagtatcttcacatagctcttctatgtatgtaaggtcaaatcccatggggtaacacaggcagggagtggaaaaagtctaccctgggtcaggcaatgagagggcacactgtctatagaatactaaaaaataataataaaaaccaacgaaaagtaggtctgatgtttattatgtgcaacaattcagaggtgaaatattcttcttccccccaggtcagagggtgtctaacatctttctccctaatatatcactgatcatacccagtttatacatgacaaaactgagactcagattaagtgacttacctgacaatcactagcctggaaccaaaatttcaccccaggtctgtttgattccaaaaggctatcttcttgtcaaatattactctgtttgccacagatactgctatggtcttttcagcatgctcagcaagtcctgcttatttaaagctgcactaacaggtagccaccagccaggtgtggctatttcaatttaaattaattcaaacaataaaaaactcagttcctcagctgcagcagccacattccaagaagctaacagccgcatgcggctgtggctaccacactcaacaacccagatacagaacagttcactatgtcattgcagaaagtcctgttggacagtgctgctttcaggtggctagtcaaagggtaagcactcttagaagacactattcaaaaccaggtgttcactatccatgagactttcaacgggtgtcagagacaagaaccaccctaggaagttacatgaaagcagggccagtgtgaaggatgacataagggtgaggaacgagggacattttcatactctagacatccccctggagactgtcatgtgcccgttgaaggaggtttatagaacgaccccatgagaaccactgccagagtcagtctgtgtttttgggaagaagaaatatcactcaagtgtgccagggcagaaacaaagggaggggcagagcaccacgaaccacagaaaacagatcctgagactctccttctgaggctggggcagtgggtgtgtgtatgaggagataggagcacttgtgtctgcataattgggctttgtgggcctctatgtgtatgtgctgtgtgtctgtgtgatatagtagagtggattttaaaaagacaccataggtgcactttttttttttaattctaaatacatccctaactttctgtacatggaggagggaggagataaaatgcccttaagaaggtaaacaacaggctggatgcggcggctcatgcctgtaatcccaccactttgggaggccgagacaggtggatcacctgaggtcaggagtttgagaccagcctggccaacatgacaaaacctcgtctctactaaaaatataaaaactagctgggtctagtggcacacgcctgtaatcccagatacttgggaggctgaggcaggagaatggcttgaacgtgggaggcagaggttgcagtgagccaagaccacgccactgcactccagcctggacaacagagcgagactctgcctcaaaaaaagaaaagaaaagaaggtaaacaacagtctcccttcaaatgcctgctttaagcccgtattcatctcctaaagatcacctccctctcctgcaccaaagccttcagcaacttcccactgcctcccagatcaagctcacccattagaccttaacaatcatggtcattcctgattgaatgttccagttttacatttcacaactggcagcttaaaccctagatctaagcaaaatgttagtctctatggtaagcagaataatggatccccaaagatgtccacatcctgctctccaaacctgtgaatatgttaggccacattgcaaaggggaattaagttgtagatgggattaaggttgctaatcagctgaccttaaaatagctgagagtatcccggactttccaggtgggtccaatataattacaagggtccttagaagtagaagagggaggcaaaagaggaggtcagggtgatgtgctgtgagaagaacttaaccagaagctggcaaaggcaaggaaccagtcccctggagtttccagaaaggaaggcagccttgcccacaccttgattttggccttctgagacttgggtcaggcttctggcctacagaactctaaaataataaatctgagttgttttgagatgctatatttatgatcaattgttacagcagccacagaaaatgtagtccctaacataccttctgctcctctggccactggggctctttgtgcctggccctctctgtacctggaattacttagttagatcactcatttattccattaacacttactgagtacctaaccaggcactgttctaggcagtagggatagagcagtaaataaatcagataatcatggtgttcatactgaagaggcaggtggaacacacggcaagagaagatatgtgcatgcgcgtgcgtgtgcgtgcgcgcgcacacacacacacacacacactcacacacacattttgttgggagaaaaacaaggaagagggatggggaatactggcaccagggagttcattttaaacaggatgatcggggaaggtctcaccaaagtgatatttgagtaaagctcatttaaaggaggtgaaggagtaggagacagcagttccaggaagagcggagggcaagtgcggacgcagaagcgtgcctgaatgttccaggaacatgaggccagcatggccagagcttgtggactgcagtgtgtgcatgtcatatcttccccacttaactgtaagctctttagagctgaatataggtcttattcttctttgatcctgcctctcccaaatatctagcacagtcttatatttaacaaatgctctgctgaatgtctatagcatggatctggaagaagtgaactaacttggtaatgatttgatgtctcttgtgtttatttcagttattcctcacaacatctttgaaaggcaccaatacttgttatttacagatgaggtgcaagataatcctgaagcttacataattggtccaaatgtccttctacccctaattgccgaggtaggattcaaacccaggtctgtctggctccaaagcccatgctctttctagtaccttcatgcttcaatttgatttctctcctggacttgcttaaaaggtgaaactcatatctgagttaatcaattcaaaatatcttcacccttgtttcctaagctctatctagtactagcaattctaagaggagagtaaaatcctccaacatagaacccacagcagatctcgtattcttctatcaagcagggtgagaccgcagcccagggcagaacaatttcatatgggaattacagtcacaactaaatttgccaccagtgaacataacctgattagctgttcttttaggttgatcctaagcctttatttgcttaacagaagagcaagcaagctttgaaactgctcctaaacatttagaaatgatacctctgagagcattttatattggagctagacaaagctacactcactaatagctatcacctccctggagtgttccactacggtaactgcctctcaggttccaacttcccctgaccctacccatcccactgtggctgctactcacaattatgtctacactgggtctgtcacgtctcccctctctccacaccaggctggaggaaaacattcagttgcacaggtgtataaacaggacagaaacagaaaaactacttagggaagcataattttaatcttctactttcctaatttgcaaatagaagagtaaattactgttttttatcacagtccctgaggtataaaattagtaaatttatatccttatttccattatttcatatccaaacacaaagacacttgatataattcaggacaaagttattcaggaaaaaaaaaatctctttgaattttacttttaccacataaaaggagcttgaatgggtgagtcctggaatttttttttaggggatggaaacattcattttacattcatttaaacatcaaatatactattgctggattttctacaaatgctaaaaagaattcagcctagaagcagaaggattcctaagaaagctgactttcctgggaaatgatcgagagaatgaagaacctgctggttccagcgctggtggcatctctgccctgacccactgcatgaccccgggcaagtcttccttttcctggccctcaccttcctcacctgcagaaggagcagctagtctggatggctgctatgtaaccactctagtgatttcagcagtgcagaaccaatttagctccatctctggtgactgctcttttgcacagccccggagaagtccttcaaaagcctgtctttattttaaacagtacaatcgtagagctagtttatgaaagacagaactgtgccgttgttctcaggtaagaacgagtctcatttgtccattctctctctgaccgcacaagccccttgaataccgccctcccagttcactcaccccattctttcccctcacagctccaccccaaaatcctacccacgcccatctctgacttcactgcacccactcttccaactaaaatcgccatcctgtggcttctgtcaggactcagcgtgttttctgctgtttcctcggctcaccactccatttaagtctttggctttcttcccgtttgtccttttgggacacagcccctgctgtactctatcaggaaaccttctctggttctgccttctgggttagcctggccctccaggcccctctgcacagcccctagccctgaactgacacgaatggtttcctggattgcctccccaggtatcctcagaacgccctgagggaccgtgacctcatcatagctgtattcccagtgcctgcaaggtaaatcactcggtaaatatttggtgatagagtgaatgagaagtgatcttccacaacccatgggcgacagtattacaagaataaaataccttaactccaccacaacaaagagaatcccaaccaagacaacaggttgttcctttcacagcacacgtctaccttgactctaatattactacactaagatcagatacgttcccaccgcagctgtgggtatttgtcaaatactacagctggcattggtcatcatttagagcctaagtgtgacaccctcccccagcacaggaaaccccacgccggctccggacccacgctttctgacaatcgcgtcaagggttatttggggagtgggctcgcttacctctcctggcttctacctcaaacaccatcctgagattctaatggcgctcttggcccagaggtccctcgctccatctatccctgcatgaatcagtgaggccacctacattccttcatccatagctgctgaatcaataccccaggatcatttccttaactgtaaaaataggtaccagatgatatgagatcatctcaccaccacataaaagggtatcactcaacacggttacattcaattggccaaacgcttcctttgggtttcggagtgggaagtttacctgccagataccagtagtcactgtgaattacaaagctacgtttcttccatagggaaagtttggagtccagccaggctagctgagtataaacttgagaaagtgaccacgggctctgtcaggttaaacacacgaatccatccagacccaccttgcagctcgaacacttgaacagatgtgttcacttagcttgcaagcgtttgatgttgaaactcgtatgctgggccaatttcagatggttctcattaaaaagaagaggaacaggagaaaggtaatctgcttcccagtacttcctgttatccagtactcatgcaaactctaattagattgaagagagatggagtataggatgaaaaataaaaaattaatgaacacttacaaacttttccagtaattcaataattcatgtcttaaacggaagaaaggtttttagttttagtttttaaagtagaatgaggttcaaatacagtgtctgcactcaagagagagattggaaagtcttgaaattaaaaattctgaggtaatttgcagtgtctttgactgaggtagtctggttggggcaatatactgggactagattaatatacaacatcattcaaaacctttatgattaaaaggagacatctgtgctggaaccaatttccacctcctttgacaaaaacaactgaaagcagttcagatgtaacttgaggggaaaagtggctctttcataaagcggaaaaatagtggctaaaaatagagcattcactgttatatcaactacagaccagtcagtggacattataggctggggaataaggaaaaggaaggaatgttctcaggttgaagcacgatcaaattgtagtatgttctaattagcaattaatcagcaaatgtacacaacgattaacagaaattagtgaaaaagaatgccgggcttggagccataagatgtggaactgaatccctgctgcatatccctgctgccgagctgtgtagtcttggcaagtccttcaaccttccagaggcccaatttcttcagtggtaacgattctctaaggagatgcaccttctcatcttttcctctgcaccctctagagttacttacgtcctaaatgtcacagtggcctgagttttcaatccccaccctacagggcggggaccaacaggaggctgactagagtcagctttgtttggtgggaaagaaaaaaatggtggaggagggagcacattacaatgtaatcaacaaccaactatgctgtgaccccacatctctgcacatcccattccctttgccgggaaggctcttcctcaacgtagtcatccaagcaaacttctctgatccaccacaaaccacaccaaacagcctctgacatccacaggcacaatccctgtgcacttcccactggctttcatgatgcttgctctactgcctggcggcaatgagcgtaactgtgatgcagatgaaaagcatgtcttccagatgctgtcatcagcccacaggtgaagtaaaattggctttaaaaggttattttttcatctatttcatgaaattgtgggatctcagtgcctttaacagatgtccacaagcaggatgtagcagggctctgaattgtgagtccaagcagctgcttgcatcctcgcaagagcccaaagttcccgcctcctgctgcttcacccatctcctgagctggccgaccccaggatggatgtcctcttctcagatgagagagcccagagttcctgccgccttctccttcaccggcctccctgagctggccgaccccaggatggatgtcctcttctcagatgagagagccttctcccgtcgggcagccccgtcactcccttggatccaactgaggagcacttgggcaaccaggggctgtgagcccaatccaaacaaaaatgctcgtggtgaggagaagaagtcatcaaacagctgaagccactggcagctctgttccatttcactttacattcccaccgtcgctgccagcatttgccaaatgcccatttagctttagatctcaggcagaaacagggctctcctgcaactacaaatttccacaaaccacacattcaaaccaactgcgatttcaaggttcaatctccagctacacagaattgccagaaggaaggggatattcccttcatagcttctgggaaacggagcacagccttgaaggtatgaagtcagaacttctagaaccaccaaaggccttttccggctacagcctcaacacctcccctccctctgtgtggggttgttcccatcccagtgaataaaactgcttctcagagaaataagcttatttgcttatataaaatcaagtcaacctggagagaataaaaacagcatctacacgttgagggcagtttgagagcctacctcttgtcagtggtgcttgctaaaaatgagccttctgtagaaaagcattttgtagaaaactagcatgatgggctgatatacaaggcagttaaacacacatgaatacatttaggaaggagacacttgcttgcaccctccccccatactggaaaggtatgttcctgatgtaataacatataatggggattagatgacacagagggctatgagctccacttgcaaatgcacattcagacaaattcttttcacatctgtagagagactaccaaatggatggcttaggctgctgtaagcccatactcacaactcctacccaagtcctgccaatactgttgtgtaaacgctaccaggtgggaggtttgagattctgggaaaaatgcaaagattttacaggaaaattgttctcctgacaatagccattaagataaagtacacctccaaagttcagggtgagttttgtcttaatgaagaccaaagctgcagccctcatctcctttaatcggccacatctccatcttttgtattttcttctttgaggacagatgctctcattctcctctgccaacagagataaaaatgctttaagctgccgcagaacagattcaagtgaggtttaaagggcagtgtcccgaaggcgaaggttataggataacctagatgtggccactccagagacattcagacatgggatgaatgatagcttgatttgggttctgtgctgttggcatgtaagactgtgtgacaggcagcactacggaagtggaactaaggaggccgggccctggtaccagctctgccactggccagctgtgaggcctagagtctaacagtgcctcctggctccgcttgcccaggtgagaactacattagggttaccactgacatggaaactaatccttccactccattagtcgcctatgtgtaaagtatatgttgtccatgaaaacagacctgaaattctgataggaaggttgctggggtttgtgattgtgcaacaaattgtaaatgcctttgttctgatttgtccctccttcattctattttaaactgagttttctcaagtataaacaaccccagccatagcacagagagtctacaggactgaagacaacactcaacatggtactaccttctgccaaaccaagaatttgacaatggttatttaattcacacattccctctaacatttgtatgtataatgattataacaggcaatattccaagcttgggtaaacatggtatttgcttatctgctaaagcgagcacatcagattatctaatctgtggttctgaattaaaggaatagtttagctggggtccacaatgacagcttcacataacaagtccctgagacacaagtctagacatagctttttaggaggcaatcttacgggtcatctaaagaaatgatttattttgacattagaacctctctcttaacatcagttaatggagggttccatagcgtcccctaagtcttcagagttgggctgcagaaattatcccgttctacaaacacttcataaggcagcactgaaatccttagaccatgtgtcacacaagccaaaagttcaaaagaaacatgtcgctgttcgagggaaagaaattactttaatctctcagcctttaaaaaaaaattctagaattgtattttgtatctcactggaaaaaaagccagtgttcctccaattattctaaaacaaaaaaagaaaagtctgtagtctgtgaatcaatccatacagagatctgtcccttgaagctggagggtgggtcaccccagagggcagtcacttggcctaaaggtctggtgaggagaacactactttgtaaagtttgggaggagagaggggtgaccagattccatggtacagctcttttgtgcctcacctcgtatccatgagacagactacacaaaatcaccaggacttagacgctcctgcaagcagctctgcagccatggaagtgaagtgctggctgacggcacggcgagccgcttcctggcacgccaacagaaagcacatgtctgcatttttgattccagtaaactccaggctggctctcagccagaggacctctttgtaatgtcaaagataaaagtactggccatgtttggcaccctgcctccacctccattctcttgtaaccgtctcataaaccaagcatgcattactgttaacagagtcttccagacaaaggtctgacggagcttcataaacattagcagatgacgatcagacaggtccctactgcacaggaaggaaaggaggtacagggaggggcaagtgatttcactcagaacatgctggaaattgtggggagagctggaaatagatattcaactatatactcagaatactcctactaccagagaactgctcactgagccgcctgagtcgtgcacatcttccattagaacctggcatgtgggcaacatcaaacctcaaatctgtccccagcagtataggtatcatctttatattgatatctgatgaagttcctcaaatttggatgttcaaaatggctttttgagtatacaagatgatataatgcttctcatacccctaatattcttcctcttgcccaagggaatgctacgatgccagtcacagaagatttaggaaatgattaccttttgattagtttttgttttcattttgggtcatactcattgtgggccaaaattacacagccctagctgtttgcctttaccatttctgttttactttccatttaacttttgagactactctgaaagtaagattttaaggtttgtaaatgcttaccaactaaaatacgcaaggatttcttttccggaggtaaacaaacttacaaatccctcttgctctgtgcaagaacaaggggtacccagaccttcattcagaggacttaatatgagaaagtcccaggtcttcatcaccagtggaagctggatagctctggatgtgctttttaaaatatgtatcagaggctttaattcactccagagggctgcagagagcttacttcctcccctatgctaccaagagtgtgcaaacacacagatacccacagacatgcccacatacacacacatcccaggaatatgctttaagggatactgagggctccgactttccctcaaactgcagacctgttgttcctccagctttgtctctcctctttgctgtaagggcctagtaaggtaaggtgggtatatacttagaatcacctcaggagctgttaagaatacagaccgggttccatcgaggcaaatgatatcagcatctcttgggggcaggcagataccggtatcttttctaagctccccaggtgattccaatgcacagtctgggccaaggaccatcagcgtggcctttgccgcctcagccattgctccgaatctctgcgatcatgctgtcactcttcgtgccgacatggttaagacttgctgcaagtattgatggttttgcttttcttttttcttgtctgctcaatctacagttctgtctcccatgttctctgcttttgcacaaatagtttatttacaatagacacaaaagtgaccaagtctgtggcactacggggaataaatctcatgcccttcaggtgctctttagctcaatatatgacaacatctccccagtgcactccagggccaggtactggatctgagaagacacagctgagatgtggcctcagcttacattccagtggttgaaacggccaaacaaatgtatcatttctaaataccgcacgtgataacagagaggtaagccctggggctatgggagcatagaggcagagccctctgcctggccaggatttagggaaaatgtcctggagaagaggatgcatgagtgcaggcttggaggctatgggagcacagaggcagagccctctgcctggccgggatttagggaaaatgtcccggagaagaggatgcatgagttcaggcttggaggctatggaagcattagacaaggagagacaagcaggaaggccagtagcagagaagagaaagaggtccttggggaggccacgctgttgggtgcttctggttcactcatgcatggcagggcggcgctgcggagacggggcagctccccggccctctgctgccctactaggtctgcagttacttgctgttcagaggctgcttttccttagaggctcttttccccactaagctgaagggctacttcagaatgagcccacagacccaaaaacataaagctgaattaaacggttcatcgggggaaaggggtggagataaaggtttagatatgaggtagagaggtagggaaggggtcagatcaaagaatgaatttgatcctgcatgggcaacatggagacatggggagattttaagtataatctctatgtttttcaaatatttacgtggaaaatacacttgcaggtgggagggactgaaggcggaaggtgttaggtagatgtttcaacaatccagaaagagatgacatgaatctgaataaggccgtgccttagcaacagtgagagaggaagagagagactgaagagaaaaggaacaattcaagagagtgtaacaagatgataacctgggagtaagtctgtggagagtagaggattccaggacaacggccatgcatctggcttcagtggctgagtgcatggcgaagccttccggtgagatggggaatgtagaaaggtgtttaggaaagggacgttcgcttttggacatgctaatataagatgtctgcagagaatccaggtacagttacccctaggaagcgggaaatatgaaactagacccagaagacaagtgaaagtgagaagtgtcgacttggaagtcaacgccacgcaggtggaatctgaagatatgcgacagaggaaatcacccaatccaacggggcccaagaatctcaggggcaaagcggagaagtaaaggagggcacggaaacgaaaggagagtgttcccaggaggaggaaggaagggacaggtggtgtggaactcaacaatggcatcaatggggaagagactcaaaggaggtcaatggatttgaaatcaggggctcaccgatgacatcagagagagcgtgctttggggagtgataactcctattgtgggagttaagagaaaacaaacagggtcattaagtgtgcagatgactcaaggggtttcacagattaaacaggaaacaatggttagaggcaagagctgagctggaaaaagagtttgtttcttataacgggaaagtgtgggcacgtttatgccacagggaaggagtcagtggacacggaaaggcagaccccaacagatggggcagcaaggggggcgaggtccacgaggaggcagagggtagggtcaagagcacaggtggtagaagcgggtggtggggactcggctttggcaaggaggtccccatttcctctaacaggaagagacagaatgggtgcagatagagttgcatctggaagtcagcagggtgggaagttgagatgggctttatgtctgatggactctttttccctatctactgaaatcaagagacagcagaggcttaggaggatggagcagtagtgagggtctgggagtgctatagagaatgggtaaaaaggggccagctgaggacaacttggcaaggaggaagcccagctgagggaaggccagaagcagccccagcacctgtctgcaggatcctgtgactttcacagccccattgcattacaggggcctgaactgcaggaatatactgttgatgtcatcagcagttggagggttggagagggacaacgcagggatggcaggaagagggcgttgagcttgtgagtgtaaacaaacatgggttccggcagagaaagaagggaagctgcctatgctaagattttcaaaagagtaatgccccttttctccaactacagtttagcccatgaaaccaatttgtatttgtttggcctccaggaagagcagtgttatttctttaatctaggtttcatgttaacacatctgagaaccgcttgcccatctccccatttccattttcagtgcagctataatcttgataatgagggcacggtagtcattaaactattggaaactatgagtctgaaaatgcttgacagtcgcttaggttcccatttgctttatgcatttctagtctgtacaaggttcacgttctagaacaacatctgagcacactgctcacaaacagctgataagcatttcccaataggactagatgacctacctcatagggtgggcctaagggctaaatgagataatatgcaaagtgctgtgcatagcaactggctcgcagtaaccgctaaatgcacatgagctgtgctgttacagaagagatggggagtaggcagcagaacactgcgatggagacgaagagtgtaagaggacaacgctgagtaaccgaggtgatgagaaacgcttcagtgctctctgagcaacgagaaagcatggaagagacagagtcgctgcttcaagcgtgtgagaaacatcaagagatcacagaaagctactcaattcttagggtttttcctttctccccaaagaagttattcttcatcaggagagagcagaataggaatcttagaaaagttcccatctttaattccagctgaactatattccaggacagtgaaagaacttggaaaatatggtcatgaaactattcttactccactctgaagaactgagagaaagggaatggcagcagaagaccagagtggcggcaaatatggtctcaagaaaataaaaataaaactctgtaatggaagtcttcaagcaaataagtcaatgtctatctttgaccaatgcttattaagaattttaaaacatggtgtaccctagagacagcacaggtgcgttgctgtacacaccagagatagcacaggtgcgttgctgtacacaccagagatagcacaggtgcgttgctgtacacaccagagatagcacaggtgcgttgctgtacacaccagagatagcacaggtgcgttgctgtacacgccagagatagcacaggtgcgttgctgtacacgccagagatagcacaggtgcgttgctgtacacactagagatagcacagttgccatgcacaccgctgctgtctctagtgaatgctgttcttgcagctgcagcaccaagaacaaatcctgccaatctgaactcatttaattccatggagattatacaagtatatggggcaaatattattaacaccatattgttcgatttcaaccaggatttgttaatatcttcataatattctgggggtaagataaggctatctggttaggatgagaaagtatatataggttcctggctggctggctgaacaaccaactatatcttaggattaactgatgtcagccttgaatcactccttggtaggaatcattttccttattttatagatataggtgagtttcagagatggccaactgcaggccaaataacaacaacaacatttactgagggtttattgtgctaattactttaaacactgtatcttatttaatcatttcaacgaagtatcaggtaaaaaccagtccaatccttatagaagacaagactgcagctgagaaagacaggttaacctcctcaagttcaagtagctacaaagtggtggagaaggacttgaactcccagttgtataattcagaaacctgagtgctctctgctacaccacactgcctcaaatattcaagtacttgaagactggtaggtgggacaagaaacctatttgctctttattgttccaaggggcagaactaagaccctgatgtaagtggaaagaggcagcttttagttcatgagattaattaactttacaatcacagttgcccaagagtggaacattgtgctcaaaaagagtgtgctgagatcagcactaaaaaagttcacattgagtacggatacccacccagggcacacactgtccaggagatacttgccctgggtaggcgggcctctaagggcccttcccatcctgggcttataggcccctatgaaatgattcttctacatttgttcattataaaaatatacagatctccaacaggataatggggatattcatgcttttgaccagattagaaaactcacatatctaagtataccaccaaaccaacactgtgttactcaagtctggtttcatcaactctggaatgtgtgcattcttggaggaggaaagaacaccaggggcatgaactgcaagcagaaaggaatctgtcatgatgataactggaaatatatatcctgtctttccaacgggtggtttacatgtgagtttgtaggtcttggtatggggaagtaaggtaggccatactcagtattacaaagtgttggaggaagagagggcaagaatatcccttcctgatagcccattgtttaaactaccatgaaattgttttatgagtaaaagtcattttgaagcatcaggtaatagagatttttggcatgtcctatagagcttaactccatgctaggcaaataacagtatttattcacatattcacttgcgcaacacaaatttattaggcactgtattgggcactgaggacaaaatacagaacaagactgatagggtcattagtactttcctaacaagtaagcaaatacacagcaaatataaaaatgatacgtaacgtttgctagtgcaatcatggaaataaaggcattgcagaaaataatgaggagagcagcacctgattttcatagggtagtcaaggatctctccccaaggaggtaaggttgaagccacgagctgaagaatgatgatgagctaggcaagcacaaagctacaggaagatgattttggacagagggaagccaagtgcaaaggccccaggacaagaaagagctcggcatattccagccgtgagcctgagccgagactggtagggtgaacaggagccaggccgcacaggggcctgctggtcttgttggggaagctggatctcccctccaagaaagtgggaagttgctcaagagctaccttctgaaaacattctctggcttttgcgagaaaactaaattccaagacaacagggtggaaacaggcagaccgcttagggaggctcttgcagtagtgtaaacaacagagaagggtgctgaagaaacactcacaggattatacatgttgctggaaggggagagaggcaagaagtgacaactgacctctgtcaatcgtgaggtcttgacttaacctcattctggcacgctgcttgggaaacactagctaggtttattaacccaactgtggttgccaccaacagcagctgctaaaccttcttctggttttcaacaaaaatcccccatatatcttatgtattcgcagctccctaagtcatcaaaccttcatctcatctgaaaagagagcctatctgtggcttgaatcactacaatgagccaaaaatcaatttataattttgggtaatagttctaaatctattttcaatcatgtgggggtgaggggtgttgagaggaaaaagtgaatgaagtttgagaaactagcaatgaagtctctcagtcaacaatttaatgactacaaaataaataaataaatgcactagtgtacccttgggtcccagttcttattcagttacacatctgttctgcaatagaatgagggagttaattacttttctatgacatgtatgtattttgtgagacaccacattgcaccagttaataatgatctaccttctgttgacacaaaacgtttaaattaataaaaaaatctaaatgatatatcacatagcaaagcatacttcactgaaaggctggatggcaggagtagtaattttcctgggtagaaataattgagatgagcttatggtagcatgaaaagctcaatcaataaagagacttatatgggcaaactgttttcaagagtacactctttttagaaagggtaggctgtgcttcgctaatagctaatgtagcagcactgtgattgttagagaaagaaactgagactgatacccagtaattgcccataattgacaatattagcaattttccatttgaatctgtctgttcaatctttagggtcagaaaagacaaatgtgaaaagggtaaaaacaatcccttgaagctctattaatactaaaaaaaatctttgtgctcttcactgagtgtacccttgtaactagatactaaaccaactgcattatggaaacagcctattttttccaaactgtataagcaatattaaatgaccttggaaaaatcgagataatatgtaaagtagactcccagcacaaagacggaagacatactctaaataaacttgacaagagtgccttgttcaagtctcaaaaccacccaaggaaaagtctgaaacccacaacatcccgtaattattttgctattttccacttattttgggttaaaaaacaaaagtctaccacttttctttcatttttaaattcattctcacttctttcttaaaaactaggggaaaaaaaccccaaaacatcaggactggagtcaagaagtttatttcctgtataataatttctttcttttggggtcccaacgctaaaagactattacttctttctgaccattcaagcccctgctcttcactgtccttcatggtttaaagcagcctttacccatgctggcccacagagtatcatgaaaggtccatggacctgacactgtaagaatttaggtacaaatctagcgagatgaatccttttctaattcttgcctatttttggcttttcagggagcttcatatactaggaacttcttctaggctattgagtacatagtaggtatttagtaaatgctggttgtcgtgggaagcaacagataaaggtgaaaatggccaaaacccagagtgggtgatgtaaaaaagaaaaattgtccaattttataaagtttcatgattttttttcctttagcggtaggatgtctaatatttctatttaatctcaaatattaaatttatacagggatatccaggtcagaggattccagaacttgaggattaggaagctttttagcaatgcagagatcagacagatgaaaaagactgttcttagaagacctgtacaaaacaaatgccaccatatcttcttaaaaaagcccaaaaggtcagtacatcgaatccaaatacctatagctgaagtctatttctcccaatcttagtgaggactgaaaactataggtctccctgaccatgatgcagcatggttgtctggggtaaatacccgaggttcattgtctcatgccagggtaatcgaggatgcagacacacaaagtgattttgagaacggaggtttaatgggcaaaagaaagagaaaagagaataagctctctcttctgcagggacagagaggaaccggagtggtccttccggttttgtggtgaaatgcatgggggtttttatagacaagcttgaggaggcagtgtctgatttacatagggcctgagagattgggtggaccaggtgtgatgtttgcatagcacctgaagaagctggccatcccaccctaatcttttattatgcaggtatctatctgggaggtagccatgttgtctgttccttactgtacacgtgattgacaaaagggaagatggtgccactgagaggtaaagccagcaggactttctgggttgagtggggacttggagaacttttctgtctagctagaggattgtaaatgcaccaatcagcactctgtaaaaacgcaccaatcagcgctctgtgtctagctaaaggattgtaaacggaccaatcagcactctgtaaaatggcccaatcagctctctgtaaaatggcccaatcagcaggatgtgggcagggccaaataagggaataaaagctagccacctgagccaacagcggcaacccactcgggtccccttccacgctgtggaagctttgttcttttgctcttcacaataaatcttgctgctgctcactctttgggtctgcactacctttatgagctgtaacactcaatgcgaaggtctgcggcttcactcctgaagtcagcgagaccacacacccactgggaagaacaaacaactctgtacacgccacctttaagagctgtaacattcactgtgaaggtctgcggcttcactcctgaagtcagcaagaccatgaacccaccggaaggaagaaactctggacacatctgaacatctgaaggaataaactccagacacaccatctttaagaactgtaacactcaccatgagggtctgcagcttcattcttgaagtcagtgagaccaagaacccaccggaaggaaccaattccggacacaccaccatgttgaacatgcctggcccccaggtagccttttcttattggcacagctgccagcattcacccctgcaagcttccagcttgcttgtctatgtctgtgactcgattttacaggctgttctttgttagaaaagatgtgatttggggactgcttttcattaaagggaaaaccttaccgaggacttccttaccctcactatctgcccaactaatttctttttaactcctatatcaaccagataaggcccctcctttctcctgcaggctgaagagtttgtatgcccttagtctttctttaaagtcttacttttctacagtgtttctctattagaggttctctctgtccctttttaagttatggggccactatatagttatggggcagctgcataaaaacgttcatggtcttttcttgagctaaaagacaattacataaaattaaggaggttagtatccacaatttttacaatgattttaactgaccttattcataacatgaagtagttgtaaaaagtagatattcatttaatatgatgtcaaactaaggtaattttcctcatcctctgaggctgcttgttactcccattggagtactcacccatgttgaacgcaacctaattgttcagaaataattaacatgtttttatttcagttgtagaaaacataatttattaattggctgctactttatgtgttccattttaaaaggcacaataaataagaaattagcataagaaggtattgaaaaaatgccaagattgactaaattctgagaaaagcaagataattccaaattaaggatgagtaaatttattacataaaggagtttaatgacaaatgtggagacaactgttttatgggcctttagctacagctttccaattttaatgttatagacaggaaaacattatcaacgctttcataattccaggattctaatttacatatcaaaacaagagaaagagaaagcccacatctctccttacttattagagttctcggggtctgaaaacggcttgtcaacaaaggttgaaagaagaggaagcagaagatatgctgatggctgcaactgaagcaatacaatatcctaattactgggaagtacagctagtttagagaccatcacaccctcacctcagcaattaatacccagtacaattggtaaatgttctaatctttaatagaagcacccagaaacagcctgtaagcagatgagtatttgaaacaaaccgtttgccatatccccgggtattaatcgaacccaaaagcatctcattctttgtgggggaggaagaaagctgccatcatagatatgcataagcagctctctacaagctcttcttctgggtgtaatgatgtgaaaaccatgctaatttccttgcccgatatttgaattttttattcttcatgcaatcatttctgacttcttggttctacacacactcacgtttttctggctattgcgggtcgaaaggccaacctcactgttctaacaatgacttcccatccctccatgatgaaaatgcaaaccctctgcccagcataggccatccctcaccacccactgctggccttaccagcctttatcctccagcaatactaaaccattagctgttccctgatgcgccatattctctcaagcctctgggacatttcacagggtgtgtccctgtcagaagcatgtgaaccagagcaactccatcttgaataggggcctggtaaaatgaggctaagacctactgggtggcattcccagatggttaaggcattctaagtcacaggatgagataggaagttaccacaagtaacaggtcataaagaccttgctgataaaacaggttgcagtaaaggagctggccaaatcctaccaaaaccgagatggccatgagagtgacctctagtcatcctcactgctatactcccaccagcaccatgacagtttacaaatgccatggcaacgtcaggaagttaccctatatggtctaaaaaggggaggcatgaataatccacccctcgtttagcatatcatcaagaaataaccataaaaatgggtaacccgcagcccttggggctgctgtgtgtggaggagtcattctttattcctccaccttcttaataaacttgctttcactttttggactcgccctgaattctttcttgtgtgagatccaagaaccttctcttggggtctggattgggaccccttttccagtaacatccccagactgaatctctttgaaaccatctcaatgaaaattcctatacaacctgtacatctcaggtcaatgtctcctgtgaagtctttctagactgaccagggattttttttctctttcattgccactatacttcaaacaggcttccagtaaaatcactgccacaccaaattaaactgtgtctgggtatctatctccacattagaatggaagccacctacaggaaggggacatctttcaatctcaggattcccatggttggcctatgatatatgtctcacatcatgaaatacttgaggaagaaagaaagggacaaaaggagagaaacagggagggagggagagattcaagcaggtttgctgaaagactggagatgaaaatggtaattatgggtgagtaataagcaaaaaaaaggagacttaagtctatttaagccctaagcaatataagacgccttatttccagagagttaatgttcaagctataaacagaaaagacttattcctaattctagtccttgttggggtgagtcagggctccctggactctccacagcagctaatgcttcagtctcttcttacatgatagacctgtcatggagtctcacccaagtgggttgtaaaagcactggccaatgtcagtctagggtcttaaatggacacttaaatatactaaattattcagtagtaaagccaacccaaaatatctatttttcctgtttatatttctagaattctaccatctaaagggcttgagaaattggacaaagatagtatgttaagtatttgaaaatgaatacataaatggaagtgatctctcaagaaaaataatgtaaataaataaataggcctaaaagttccctcttgatgttattttacctttatttaccttttaaccttgcttccacaaccaagggcagtacccacagtgctttatcaaaagagcactgccccagaattatgatacttgtattttctgggccggattgtccagcgtcactctatttgtgagtgacacaagtcatttctcctctctgcaaaatgctgatattgacctagatgcctaatgtttcttctagctattcaaatttaactgactttctgacaaaccacttagcttgtgtgatattcgatggatctaagtacaaagtatgctctctcacgtctaccttttaagctctgaaggtatgcaatcaataacatgcagaaagagcccaatctgagtgtcatttcagcaggttttaaagacagagtgaagaaatgcatgtgttctacatcaaccatgtctacctgaagcccaacagcaacttctcagagcagggaaagagaaagtggaaccacatttggtcacctaccatccctaatacacggagctgcattacatactccctgtagcttaccaatgccaccaattccccagcttcattcttccaaggatgcaatgtcactagagggcgcagttaatgactatataaatagtgagccccaagatagttattgtgaaatttaacctctttccatatcccaacagtgagctgttagtggaactttgtgtggcagagacctatagaactccaaagttaggtaaggtcaaacatgtcatgttttaaaggctttgagcatgtactatggaccaaaagcataagccttcaagttcactgttgagcccgattaacagataaggggaaaatgtactttttgagaaaaataaataggttatttttgcatggcaccatgttctcttaatttctatagagagtgagataacagaagtgactagaatacctttttctccttctaggacatccttcccattgacactggaggggccaactacatgttttaatcagagcccacagctgcccacacccactgcagagtgagctactctccaccaaccctgcagccctgaagtttctgtgaccactgaagaggtctgttttcagacttagggtcaaagtgtgggtgacctccaacacctactgtaatgaaggaataaatgtcaatagaagccttgtctggtctctgtcccaaggcattttattatttgtttcattgtgagattccaaatgtggtcttactcagaaaagaacaataattcttacatggcaaattctgaaagaggcatcaatgcaatccctctcaaaataccaatgacattcttcacagaaacagaaaaactaatccccaaatttatatggaaccacaaaaggtccagaatagccaaagccattctgagcaaaaagaacaaaactgaaggaatcacattacctgacttcaaattatactacagagctatagtaaccaaaacagcatggtactggcataaaaacagacacacagaccaatggaaagaaatagagaatccagaattaaatccatacatctgcagtgaactcatttttgacaaaggtgccaagaacatacactgggggaaggatagtcttcaataaatggtgccgggaaaactggatgtgcagaagaatgaaactagatttctatctctcactatataaaacaattaaccaagatggattaacgacttaaatttaagaccctcaaactacgaaactactaaaagaaaacactggggaaactctccaggacattggtgtgggcaaagatttcttgagtaacatcccaaaagcacaggcaaccaaaacaaaaatggacaaatgggatcacatcaagttaaaagcttctacacagcaaagaaaacaatgaacaaagtaaagagacaacccacagaatgggtgaaaatatctgcaaactacccatctgacaaggaatcaataactaggatatatataaggacttcaaacaactgaataaggaaaaaaatctaacaatctaacaatctgggcaaaagatctaaataaacatttctcaaaagacgacatacaaatggtgaacaggtataagaacatcccgcatcatcaaagaaatgcaaatcaaaactacaatgagatatcatctcaccacagttaaaatggctttgatccaaaagatagggagtaacatatgctgacaaagatgtggaaaaaaagggaaccctcgcacactattgttgggaatgtaaattagtacatctactatggaaaactgtatgaagggtcctcgaaaaactaaaatagaactaccattgatccagcaatctcactggtaggtatatacgcaaatgaaaggaaatcagtatatcgaagaggtatctgcacgcccatgtttattgcactactattcacaatagctaagctttggaagcaacctgagtgtctgttgatagatgaataaagaaaacatggtacatatacacaatggagtactagtcagccataaacaagaatgagatcctatcacttgcaacagcaaggatggaatgggaggacattgtgttcaattaaactagccagacacagaaagaccaacttcacatgttctcactaatttgtaggagctaaaaattaaaagaatttaactcatggagatagagagtagaatgatggttaccagagcctgggaaggtagtgggcaagggagggaacgggggatggttaatgggtacaaaaatataatcagatagaatgaataacatctactatttgatacaacagggtgaccagagtctacaataatttactgtacatttaaaaattactgaagaaatataattggaatatttgtaccacaaaagaaatgataaatgcttgaggcaatggataccccatttatcctaacatgattattacacattgtatgacagtatcaaaatatttatctcatgtacccataaatatacacgcctactctgtagccataaacattcaaaatttaaaaatacaaaaataaataatgtttacaaaagaggattggtctcttgggaaataaactgcagagacagcccaggatgacatccactttgtccaggaatctggggggaggggagcaatgacctggatgtgactctgtgcagtgccactcatgctgtcttcttactcagctgtacttcccttccttctgctatgtacaccccctcagtgacagcaatgtcgggaactgtaggggtgaagaggacagcacgagtagtgatgaaggacagtgatatgccccctaagtctggacaaaggtcagcttacttctggaaggagagcccaggttaggaagtgcaggggagcaagccaggaagaatacaagaatgaaaaacaagctgagctgagcatggtggctcacacctgtaatcccaacagtttgggaggcagaggcaggaggactgcttgatcccagaagctgaagactagcctgggcaatacagtgagactccatctctacaaaaatatttttaaaaattagcagggcatggtggcacacgcctgtagccccagctactgaggaggctgacatgggaggattgcctgagcccaggagtgagccatgaacacaccactgcacttcagcctgggcgaaagagtgacgccctgtctcaaaacagaaaaaagaaagaaagaaaaacaccaaccaccccagcacagtgaccactggaaccaaaccaaacaagaggcactaggcacaaaaaaagggggaagaaagcagagacaactaaaaattggaacaggaggagttaaaaaactgttaagaaaattatgtgaacaattcagagactctgatcagcaaatgatgggaactgaggatgctgtatttcttggaacctcccaaatagactatttccccagatcattcaataataataatggctaccattaccaagcatctaccatctcccaatctatacatatattatctaattatctaattgaacccttaaagtagctttgccaggtttagagtattctcattttacaaaagagaaaattaagaccatcacagggaaggtaacttgctgatgtcaaagggttggtcaacagcagaaaccagaaccatctatctgcaaagcacatgctctttccaccgtatcaagctgtcctcttatccaccatttggatttcatgtctctggccagttgctgatgctccggaactagaacccaacttctgctaaatctaactctgtactctttgtataatatcctgtggctttaaataagatattgactcagcaaatggtactagaatcattggctatccatatacaaaaaagaacattatgcatacacataaattaactgaaaatggatcaaattcctaaatgtaaaacctaaaactataaaatctaatatgaaacacagaagaaatatctttctcctcttgaattaggtaaagattttcagctatggcttcaaaagactgatccatgaaagaaaaatactgataaactaaactatttcaaaatttaaaacttctgcttttcattctgtgaagagaatgaaaagaccagctgcaaactgaggaaaaaaacatgtataaaacatatgtccaacaaaagacctgtgtacaggataaagaactctcaaaactcagtaagaaaacacccaatttttaaaataggcaaaagatttgaacagatatatcaacaattaagatgtacatgtggcacacaaacacgtgagaaaacacattacagtactgcaaattaaaaccacaatgcaatgttaccacactaaatgtattaggaggatgaaaaacaaaaagaaaatctgacaaaaacaagtgctggtgaggatttggggtaactggaactctgagtcattgctggtgggaattcaaaacaataggggctgctttgaaaaaaagtgcagcaatttcttataaagttaaacatatatttaccatagagcccagcaaccccactcctaggtatttgtccaaataaaatgaaaacttatatttgcacaataacctgtatgtgaatgttcacagtggctttgacaaccaccaaaactagaaaacaactcaaatatccttcacttagaaaaacaaactatgaaatagccatgtaatggaatactacttggcaataaaaatgaaccaactattgaggttatatattataaatgtgtgtacaaataacatggctaagcaaaagaagccaaatgaaatggctggttaatgtatatgatattgtggaaaaggtaaaatggtagtgacagaaagaagatttgggttagcaggtgctgggagtggggtatagacatggatacaacgcagtacgaaggaatttgggagtggtggtgatagaacgcttctctatcttgatggtggtggtggtggttgtggtcacagactgcatttatccaagtttgtagaactgtacactaaaaagggtgaattttactgaatgcaaattacactccaattctttaaaaagatagggaaggtctatctgttactcttatcactatagaaacagcatagtgaagaggttagggctatactcttgaaagctcccgttgcctcatctgtaaaacggcagtaagagtaaccctaactttgatatggttgtagagagaaatgagatgaggcatacagagaagtctgcagagtacctcgtgagaggtgaagccagctggacttccagggtggagtggggaattggagaacttttctgtcttacaaggggattgtaaaatgcaccagctggtgctctgtagctagctagacgtttgtaaaatgcaccaatcagtgctctgtaaaaacgcaccaatcagcgctctgtagctagctagaggtttgtaaaatggaccaatcagcaccctgtaaaatggaccaatcagcaccctgtaaaatgaacctatcagcactctgtaaaatgaacctatcagcactctgtaaaaggaaccaatcagcaggacatgggtggggacaaataagggaataaaacctggccaccccaaccagcagcggaaacccgctcaggtccccttccacgccgtggaagcttttgttttttcactcttcacaatacatcctgctgctgcttactctttgggtccgtgccatctttaagagctctaacactcaccgcaaaggtccgcggctccattcttcaagtcatcaagaccatgaacccaccggaaggaaccaactctggacacactagcacacaataagtgcccccataagctttagcaggtattctaatttccagtagtatctgaggaagaatcaccttattgtactagacttcctgaacactactgcgtacctgtggaccatgtgttgggctggggatggtacttggtacacaagaacacatactctgtatcacattagctgccatccctcaatctatcctctgagctggaggcttatgaagccccaaagatggtagaaaagaatgtgtgtgcaagaactggaaaggtgagacagaattcacgacaccacaaattgtggagagaccatcttttacccgaggtggacataacagggccacgtgaaggagcctggtgagcacagctgcctgtcctctggggagaaggcagagaagaagtgccacatcctgtgatgtggtgaacgccacagtccaaggcaaacacaatagctacattgtttatctctcagccaactttacagcccatcgtagcatgcccagaagcctctccccgtatgtcatagcaacactgcagacgggattatgtgattatgaagtcagtaactcccttccttgattaaacatgaactcaaacagacagtcattcactctgggggaaacccatttttctgcttgtctggagaagcaagacacaggtaacatacagcaatgttaggtttcaactaattaaaaatgggaatgaacacacgcacacgcacgcacacacttcttcagttccctgtcaaatcttcctgaggacaacatagtttggttatgatgaaaactttagaaacgggaaacattctgcttagattgttaaaattgagaacaacgcagagctggttgggctcatcatcccaccaggagacagttctgcttacaatttatctagcaaaatagagtaaggcagcagaaaaaatcttggtttcctagtgacctttaagtaagtgctcccatttcaaatagactcagtaccataaaaactttcttgggctgagaactttcatttcctttgaatataacttttgcgctaacattctttcatttcttcttcttcagacaatcattgtttcttcctttcactcaaacctgcctctgttccccggttttcacggtttacagggcatagcccaggtgatgtacagcccacatgggaatcaaggcagttcccacacagcaccagcacaaagtcatttctttgtagaagctgggcttcttcagggctgtgtaactcataggtgtcgtggagggtctcagaaggaaacgagggaaggcaattctgtgttgcagaaaaagagtttttctaaaaagaagctgaaataattaccagagacaaaaattaacattgctttatatttacagaagaaactaagaggaagtaggcttagaattgtagcatcagggaatgagaagtttattaaggcttctccccactacagaaccatttattaaactgtttccagaatggatacattttcacaatgatcctactcaatctctcttcatagaaggctctgtgataaaagaagatatagatcccctgctccacagacggctgacactgggtaaaagatgcacacatacttggaagccctcaggaaaattagatcattatcttctcgttttttctttgcctccaaagacttagatttttacctatgtactcgaaaagcaactgcagacttccaatcaagatgctgtaagttcaaacctggaagcgttcccttctactccaaatccatagtaatgacaggtaaaatataaaaacaggaaccaaaaatagctttgccaagtcaaaaaaaaaaaaaaaaacaggcaatgatctccctggaccaaaaatagaacagaaatgcaaagcaataaacaaagctgaagctccagggcctgaggtctggaagtaggtggcagtaggtacaagctgagtgctggtggttaaacagggaatacaaatgtttcacataaaaatggtgagtacagtcaaccttaaagcttaaagccagagaatggggtgaggctaccttgcttgacaaaagaggccgggataaacaaaaccagggctgatgacctgttcccctgtgctagatatttacaggaagctgtgggcctgaaggggccaaacagagccatgctctcttgtctaggtacacagccatgacgcccaccatctaggcaacacttctgcactagcctcagcatcaccggggcgcaagaggtccaaatgccattaagttctggttttgaactggaggctgaggggcttgggggaggcaaaactaccagacagaagggaagagcacagaaggagtgaaaagaacaaaacaaaaaaactgtccactaaaaatgagcctgccatacaaaattccagaacactgagtgaaatgcaatgctaaccaactgaaaacaatcagaacataaattccctccagtaaaataaacttcatggaactaacacttaaaagaagtgtgattagaatacccaaagagatgaataatgtagtagcatgcattaaagtaaaaaagaagttataaaaccaaaataggcagaaataaaacacagagacgtgaaaaagaacaaatttgaaatcttggaaataaaaattggtctttaagctgaaccagtaagcagaaagtatccctagcacctgacttaagggagctctaagtttaaaaacacggacaaaatgccagaagctaaaatgggttctctctgaggagtaggtcgtgggcaggagcaagagaggaaaggggtaccattgttttcaactgtgttagagtactttaatttttcaaactatatacatgtattactttaataaaaaatcaaaataagaaatgtaaaagcccatttgcaagaaataacactagtgaaggattacctgaaggatttgcagtcactgctttcctccatagagactaaattgtattcttggaaagaaacaaaccatcaaagagatatgatcttagattacctaatttttcacgcttctagttacctcttttattaagaagtattaatttggctgggcacggtggttcacacctgtaatcccagcactttgggaggccagggcgggtggatcacttgaggtcaggagttcgagaccagcctggccaacatgttgaaaccccatctctaccaaaaagtataaaaaattagccaggtgtggtggtgcgcggcgcctgtaatcccagctattcagggggcaaggcaggagaattactgaaacctgggaggcagaggttgcagtgagctgagattgtgccactgcactgcagcctagaagacacagtgagactgtctccaaaaaaaaaaaaagtattgtcaatcagctatgatgaagaatattatagaaatcagtgatttcactcgctgtggaagtccagtaagaatgctttgtgagtgcctcaggcctcagtgcagggaaaaactgctctggctgtgttttccttcttagggctactgtgaattttgaaagtagtcttttaggtttggctgctgatacattaagggtaaattcatcatttttctagctgttatatattgcttctaggccttttggttaagctcaagtgtagtacttctagctgttacataaaggatcatatggtataaattctgcatactaaactactttcatcttatttgtcacttttatttctcaaacgaaaataaaatttattgctgttgtattacatatgcaagtagatacatatatacatgtgtatgtatccttgtgaatgtgtgcgtgtaagctacttcaaaatcttttgggtggaggaaagggaacaattagataaaggaaattggtattttgaaacagaaaaagggaacaaaagcaggttgaatgttagggtcgcaactagagagcactgaatggcaacctatgagtatgaagttgatcctgagtgctaaagataatgctgaatgcttgaacatttctgagcaaagtaacaacatgagaatagtggcatctgagagagtttacctaaaacagtgtgtgccaaggatgaaaagaaagaaattgagagcccggtgaataatcaggggctatttcaataacctagcagtgaggcaacagagctttgatagactgatagacatggtgtttcaaaagaattaactctaacaggacttaggaaagaaaaattgacatggcaagtaatcatagcttgtttgttttttgcaacaaggcatgtgacatccaaagcagcacgctatgttcttgccacaaacttatggaaacaatcaattccatttggtctgttcagctcctattgccttggattctgacctgggcaagccatgaggacccaaatcattcaaaaacctccctcagaaggtaagttttatttttttccagaaattaagctgcagctgattacaaatgacaactgtaaatatgcaaattatacttgctattaaaagggttcctgccttcctgaaacaaaatactgtgtaagtccaataatatgcagatgtagacacataataaatattgcttgatgcagaaaactggtgagatgaattttctaggttccaagaaaagcagaaaaataagcttggaaactttaaatccaggaactgaaaattaattttgattgaactaatgttgaatttatgatcttttgggaatgcactaagctgaatttacctctgtatttttttttgaggcaaattgatagtacagagatctcagaggagtgtttatatcactaaacaaaattctcaaatagaaacttaaaaatacaactgaaaaattagttgcaaactaagtttatattctcatctaagtacatactctactctcttccactagaaaatatttcatggaaacatgggaaaacaggagcggggaggggccctatggctgtctagtgtaattctttaatgttacagaggatggaacgaatccagagaggttcaatgacttgcccaggaccattcaatgtgttagatacagcatggactataatccagcagagtaatcaagtactgttttcatgacaccattagacccatctcaatattttaatggtcaatgttatatgttaacttgagtgggccacagggtgcccagatatttggtcaaacattattcatagagtgtctgtgagagtatttctttatgagcttgccattggaatccacagactcagtaaaggagtctgctctctctggtggcacttaactaaccagctgaaggcctgagtggaaccaaaaggctgcaattccctcaagtaaaagcaaaagagaattcctcctggcttactgcttgagttggactgatcagttcttcttggaacttgggcctgccagcttttggaacagaacttacaccactggctctcctggttctcagggcttcagacttgtcctgaaactataccatggctcttctgggtctccagcttgccaactgcagatcttgagacttctcaacctccataatcaggtgagacaattccttagaataaatctgtttctccaccccatcttgttggttctccttctctgaaaaaccctaattttaatattaaacgaatctttagctcaatagagtaaagaaaatggtctcagtgggtatggtagacattatgcactagctacccaaaatccatttaacacctctcttttctcttgacttcctcttgcataaaggctaaaaagctaaaatacagttcctagcctcttctatagctaaaggtggccatatgacaccattctgaacaacaaagtaaatgacatcatttttgagcaataaagtgtaggtagatatccttaggaggtcttccctttgctctttgcctcttattaccccatcttttttctccagagcttagatacactgactggggtttggaagcatcagtcatcttcagactgtaaggacaaacccacatgctagggatgactatggaggaagacagaaggatttcaggtccatgatgagatctatgagtcgctgctgtcatcttggattacttctccagaatttttagaacatgcaccccacctactaaagctacgtttagttgggctatctgttatttatagccaaatcctttcctaatatactattgcagcccagatgtcacctgttacaataaaactaagatcactatgacccccattttaataaaagatcatcattcattcactcaagaattttctgaagatccaccatattcatggcacctaagaggaactaaattcaagagccttctcatttccaaccaaggatgctggtggaaagctaccttgctaacattccagatcatggtctgggaggaatcccagggcagtttcccatgatttctgtcattcttgcctgtggcaaaaggctaacaataaagtagattgaatcttcaggagctattagaatattcaacttttcccacttaattcccttattttcaaaagttcttcttaaggcaaaatggatcatgttcatggactcctgcagcattagaatgagctcagggtcctttctcatgcagtgagagcaactacctctcttgattcatgttgccaatgggagttacagtgagttgtggtatactggcaggagcattaggtttagtcatgacatctgggtgtcagacttggttttgccactttttcctttaagtcccaggggtaagtcctgggataagtctcagaggcatatctctgaacctttccgagtttcacttcctaatttacttataattactcagaccaagaaagataacaattacgaaagaattctagtgaggtaaacattcttccaaagtaagatttctttagacaatctgattatgtgaaatatttcatattggacctaaaaataagtaggtccaacatgaaaaaggtatatgagtaacagaagaaaagtccattcattatcttcatggcatttactttgtctctcctttctcagagtaaaagttgttacataagtgatctcaatctaataatgtgctgcagtggaaaagccttatggagcaaatgttaaagaaacagagagacatcatcaagatggctgactagaggcagctggcactcatctcctccaccaaaaagaaggaaaacagtcagcagataaccacaggttaaacagagcatctaagagggaacaatggaattcagcacaaaagggacagggactctccaaggcacagagaaagagggaagataagcagcagtctcagccgggattggctcagagccaggaaaggctccccattgtagggaaaaggtaagcaagaaatctccagttgtccacattaccaccacagatgcctgccatcctagccacaggagagctgctcagcttcacaggccctgagcctagtatagggagttgactggagtccatcatggaattgttcccaagggcattcatgctgcattctagtcacccctcaggacccaaggtgctgtggcatggcaccattttaagagcccagcaacaaccagactatatcctgccctggaccccagaagcccctccattccacatccctggaatgccactgatattcccccatatccactcagagggctgcagtatcatgaggccagctggaccaagtggtacagccagatatccagtactctagcccacactgtgtcctataccctggggaccagcagaaccagtgcaccagggaggctgcccccatgacaaatggagctgaagcacattttcctcaaagcatgggagctgcctgcctggggccactgccacctacagcgatgccaccccttccaaggacaaggccaccacacacctgtacatgccttcaggggacctgagaaccagctctctggggcacaatgtccagaggccccatctgtatcctatctgggggctggaagataggataagcctgcacatggcatcaaggaaattgaggacaggcctgggtcaacccatctccagtggtgccatatgcaccattacaaggcctgcagacagtctcatgtcatttagacacctaaggaccagaatgcctggcccactgccaccatcaccagtacctacatgtgccaacaaggggcctaagaaccagcccacctggtgtctccatccccagcaaaggttgcccaagcctccactaacaatcacagcctaagccactaaagaacctgtgatcactgctgacactgattatggacaaagaaataatatgaagaccacagtactgttcctacccaaaatcagagctaaagaactctacccaacaaatactgtaaatatatctacatgaaaaagtcattctctatgaaagccaatccaaaaacttagaagaagcaattatgacaccagatgcacagacgtaaggacacgagaaatgcgaaaaagaaaacatgacacctacaaagcaacacaataattcttcagaaaaagatatcaaagaaaaggaaatctatgatatgcttgaaacgaaatgcaaaataatgacctcaaggaaactcagtgatatacaagagaacacaggtaaaacaatatgaaaaactcagaaaagcagttaatgatctgaataaattcaaagagatatcgtaaaaagaaccaaagagaaatcctaagactgaagaattcaatgaacaaaattaaaaaatataatcgagaagcttcaacaataggctagatcatgaagaaggaatttctgaattgaaggcagagcttttgaaataacacagtccaaaaaaggtgaaaatctaacaaaaaagaatgaagaaagcctaagtgacatatcggacatcataaagtaaaaagtattcaaataccgaaatttccaaaaggagaagaaattataaaagtcagagaaaacaggcagagcaagatgctggaatagaaagcttcaccaattgcccccacccccacaaggacaccaagttaacaactatccacacagaaaaaaacaccttcatgagaaccaaacgccagatgagcattcacagtactggcttttaacttcctattgcgaaaaggggcactgaagacatagaacaaactgtcctgaatcgccagtgccacctctccctgacccccagcagtggtgcgtggtgacaagagcatctctgggtgctagggaagggatgatatagtttggctccgtgtccttacccaaatctcatctggaattgtaactggggcttgcatcccctgaaataacagcctgagctgtaccttggcctcttttacccacagctggagcaggtgggatgccccaagtcccgaggctgcacactgcaggggggccctggaccctgcccataaaaccattttttacctcctaggcctctgggcctgtgatgggaggggctgctgtgaaagtctctgagatgccctagagacattttccccgctgtcttggtgattaacatttggctccttgtttcttatgcaaatttctgtagccagcttgaatttctccccagaatatgggtttttcttttctaccacatcgtcaggctgcaaatgttgactccatgtctcacatccaggtcatgtggggattatgggaagtacatcttgaattgtaatccccataattctcacaggtcaagggaagaacctggtgggaggtgattggatcatgggggctgttttcctgagacgggggtgagttctcatgagatctcatggttttataaggtgctcttcctgctttgctcttcgttttctctctcatctgccaccatgtaagacatgcctcttcctcttcactatgattttaagtttcctgaggcctccctaaccatgtggaactgtgagacaattaaaactctcttctttgtaaattacccagtctcaggtaatatcttcatagcagtgtgaaaacagactcatacaaggaagaatacagcaattgtgaggcactgaactcagtgctgtcctgttagaggagaaaggaaaagcaaaccaaactcacctgatgttgcccacagagggagcatttaaactagccctagccagggggcaatctccaatcccagaggtccgaacttgagtgcctgcaaacctcaccactgagggccaaagtactgttggcctctaagtaaacctgaaaggcagtctaggccataacgactgcaactcgtaggcaagtcctacagctgaactaggcccagagacagtggacttagggggcatgcgacatactgaggcaccagctgggacagccgagagagtgctggcgtcacccctcccctggccccagggtgcacagcacctggctccaaaagagaccccttccttctgcttgaggagaggacagggaagagtagggaggactttgtcctgcatcttggataccagctcagccacagcaggagagggcaccagcagagtcgtgaggcccccattccagaccgtagctcccagatgacatttctagacatactctgagccggaagggaagccgctgccttgaaggaaacaacccagtcctgccagcattcatcacctactaactgaagaacccttgggccccgaataaccagcagtgacacccatgaattacatcgaaggccttgggtgagtctccgggacttgctggcttcaggtgagactcagcacataaccagctgtggtagctacagggcaaaactccttctgtttgagaaaagcagagagaaaaataaaagggactcaactaccaacatcttaggtaccaagaaccccaagaatgggttcctggggtccctgactccaagacttgagtcttagcatttctgggcctgccttcggccggagggcagtcctctcccctgactagagtcccaaatccctgcaacattcaccacgagctgactttagagaccttgggccttaagggaatgttggcagtaatctggcaatactccatgtggccaggggtaaaggtggctgcggggtgaggctcctgtgcctttggaaaaaggagggaagactgagaaagattgagtcttacagttttagtgccagctcagtcgtaatacaaaagaataccaggtagacttttaaggtctgactcccagacagtacttctggacccacctggggcctgggggacctcatggccctgaagggaagggcataggccttgctggctttgccacctgctgattgtagagccccagacccttgagcaaacacagtcagcagccagggagtggttacagcaggtcttgggcgagacccagcactgtgctggcttcaggtctacataaaagcagaaacatggaacaatggaacacaacagaaaacccagaaacaaatatacacacctatggtgaactaatttttgataaaagtgccaagaacatagaaaagacagtctcttcaataaatgatgctgggaaaactggatagccatatgcaaaagaatgaaactacaccactatctctcaccatatacaaaaataaaatcaaatggattaaagacttaaatctaagacctcaaactataaaactactacaagaaaatattaaggaaaatctccaggacactgggctgggcaaagatattttgagcaataccctataaacacaggcaaccaaagaaaacatggacaaatgggatcacatcaagttaaaaagcttctgcatagcagaggaaacaatcagcaaagcgaagagacaacccatggaatgggagaaaatatttgcaagctacccatctgacaaggggttaatcaccagaatatacaaagagctcaaacaaatctatagaaaaaacaaatctaataatctgatcaaaagacggacaaaagatttgaatagacattgctcaaaagaagacatacacatggcatacagacatatgaaaaggtgttcaatatcactgtcagagaaatgcaaatcaaaaccacaatgaggtatcatctcaccccagttaaaatggcttataataaagacaagcagtaacaaatgctggtgaggatgtggagaaaagggaacccttgtacactgttgatgggaatgtaaattaatacaaccactatggagaactgtttggaggttcctcaagaaactaaaaatataactaccataggatccagcaatcctactgctgggtatatacccaaaacaaaggaaatcagcttatcgaagaggtatctgcactcctatgtttgttgcagcactgttcacaatagctaagatttggaagcaaactaaacgtccatcagcagatgaatgcataaagaaaatgtggtacatatacacaatggagtactattcagccagaaaaaaatgagatccagtcatttgtaacaacatggatggaaatgaaggttattccattaagtgaaataccagtctcagaaagacaaacatatgttcttacttatttgtggtatctaagaaaaatcacacgttcttatttatttacttatttattactaaaaaatcacatgttcttacttatttgtggtatccaaaaatcaaaccaattgaactcatggacagagagagtagaaggaggcttcccagaggctgcaaatcgtacgtggtttacaggggacgtgaggatggttaatggggacaacagaaatagaaagaatgggtaagacctactatttgatagcacaatagggtgactatagtcaatgattacctagttgtatgttttaagataacttaaaaaatgtaatcggatcgtttgtaactcaaaggataaatgcttgaggggatggataccatattttccttaacatgcttctttcacattgcatccttgtatcaaaacatctcatgtactccataaatatatgcccctactatgtacccacaaattttttaaaaaataaaataatttaaagtcagagaaaacctatttaacgaaataacagccaaaaccaaaggaattcatcaccactagactagctctaaaaaaaattcttaggagagtcctatatccagcagcaaaaggacaatatttgccatcatgaaaacacaccaaagtagagaactcactgatagaacagatacgcaaatgggaaaaagaagggaatcaaatgttatcactacagaaaaccaccaaactgtaaaggcaaacaatacaagaggaagaggagaacaaaggatttacaaaacaatcagaaaacaatttttaaaatgtcaggactaagtcctctcatataaataaccataactgtaaatggtttaaattcccccaattaaaagattggctggataggtaggaataacaacaacaaaaagaatctaactatgtgctgcctacaaaaaaaatcacttcaattgtaaagccagattaaaagtgaagggatggccaggcatggtggctcacgcctgtaatcccagcactttgggaggccgaggtgggcagatcacgaggtcaggagatcgagaccatcctggccaatatgatgaaaccctgtctctactaaaaatataaaaatcagctgggcgtggtggctcgtgcctgtaatcccagctactcaggaagctgaggccggagaatcccttgacccagggagttggaggttgcagtgagctgagatcgcgccactgcactccaacgtggtgatagagtgagactccatctcaaaaaaaaaaagtgaagggatgacaaacaatactccacgcaaacagaagccaaagctgagcaggagtagctgtagtgtatcacacaaaatagacattaagtcaaaaaacaaagagagacacaaaaggtcattaaaaatgataaaaacatcaattcagcgataggatataaccattgtaaacatatatgcgcccaaactggagcacccagatatacaagacaaatattattagggctaaatagacagagagaccccaatacactaatagttggggacttcagcagtggacagatcatctagacagaaaatctacagaaaaatatcacacttaatctgtaccacagaggaatccagcagatgtttacagaacatacatccaacacctgtagaatatactttcatctcatcagtaaatggaacattctccaagataaatgatacattagtcctctaaacaaggcttaacacatttttagaaactgagatcatatcaggtaccttttcagactgcaatgaaataaaactagaaatcagtaaaagaaactttggctgtacaaatacatgaaaattaaacatgcttcttgggtcagtgaagcaattgagaaaaagatcaaaaactttattcaaacaaatgaaaatggacatacaacatatcaaaatgtatgggttacagcaaaagtagtgttaagatggaagtttatagcaataaacacctctataaaagaggtaggaagatttcaagttaaaaagtctaacaatgtatctcaaggaactagaaaaacaagaataaaccaacatcaaaattagtagaaggtaagaaataaagatccaaacagatctaaacaaaacagagattaaagaacaatacaatacaaaagatcaatgaaacaaaaagttttttgaaaagataaacaaaattaataaacgacttgctagactaagaaagaaaaagactcaaataagtaaaatcagtgaggaaaaaggggacattataccagattccccagaaattcaaagcatgattagagactgttagcaacaactgtatgccaataaattggaaaacctagaagaaatggataaattcccagtcacacacaaactaccaaggttaaaccgtgaagaaaacagaaaacgtgaacagaacaatagcaagtaatgagatagaaacagtaataaagcctcccatcaaagaaaagcctaggacctgatggcttcactgctgaattctaccaaacatttaaaaaagaatgaataccaattctactcccactattccagaaaaattaggaggaggaaatacttccaaagtatatatataaaaccagcattatgtaaaaccagcattaccctgatgctaaaactagacaaaggcacaacaacaaaaaactaaaggccaatatcactgattagcatagacacacttttttttcaacaaaatactggcaaaccaaattcaacattaaaaagatcattcatcataatcaagtgggttcatctcagggatggaaggatggttgaacatatgtaaatcaataaaggtgatacatcacattaacagaatcaatgacaaaaccatatgatcatttcaatagatgttgaaaaaaactttcaataaaattcaatatgccttcatgatgaaaaaaatcttaacaaactgggtatgagggaaacatacttcagaaaataagggccatatatgacaaaccccaagctagcatcacacttaattgggaaaaactgaaagcccctcctttaccacgtggaacaagacaaagatgtccactttcaccacttttactcaacacagtactggaattcctagccagagcaattagacaggagaaaaaattaaagggcattcaaattagaaaggaagaattcaagttagccttgttcacagacaacatgatcttacatctagaaccaagagactccaacaaaaactgttaaactgataaattcagttaagtcgcaggatacaaaatcaacatacaaaaatcagtagcatttctatatgccaacagcaaacatctgaaaacaaataaagaaagcaatcccatttgcaacagctacaataaaatagcataaacacctaggactaaacttaataaaagtgagatctctacaataaaagtataaagcattgataaaagaaattgaagagaacataataaattggaaagatagcccatgtggattggaagaatactgctaaaatgaccgttctatccaaagcaatctacattttcaatgtaatccatatcaaaatatcaatgacactctgcacatgaaaagaaaaaggcaatccggaaattcatatggaacaacaaaagcaatcctggacaaaacgaacaaagctggaggcatcacgttacctgacttgaaaatgctctataaaattacaaaaagcaaagtaagcatggtactagcataaaaatggacatatggaccaatggaacacatgaaagaacgtagaaacaaatccacacatttagtcaatggagtttcaagaaagtcatcaagaaaatacattgagaaaggaaaatctagatagcccatatgcaaaagaataaaactagacccctatctctccccatatacaaaagtcatatcaaaacagcttaaatatttgaatataagacctaaaaccatgaaactactataagaaaacattgggtaaacacttcagacattgagctgggcaactacttattgagcaagacctcaaaagcacaggcaaccaaagcaaatatagaaacatgagatcaaatcaagctagaaagcttctgcacagcaaagaaaataatcaatgaagaaacaacctatagaattgaaaaaaaaatttgcaaagtattcattggacaagagattaataatcacaatatataggaactcaaactcaatagcaaaaaacaacccaattaagaacaggcaaaatatgctgaattcatagaaatggccaacagatatataaaaaaatgttcaataacattaatggtcagggaaatgcaaattaaaaccacaatgagctatcatctccccagttaaaatggctactataaaaaagtaagaaaataacaaatgctggcaaggatgtggagaaaggggaaggctcacacattgttggtggaatgtaaattagtacaaccactatggacaacagtaaggaggttcctcaagaaactacaaacgcaactaccatataaccaaacaatccaaacgttggatatagatccaaaagaaaggaaatcagaatatcaaagagagatctgcactcccatgtttattgctgcactattcaaaatagccaaggcaggggtcgacctaaatgtccatcaataagtaaaaaaaaaaatgccatatatatatatatacacacacatatacacacacacacaacggaatatagttcctctatgaaaagtaataaaatcctgtcatttgtagcaacatggatggaacttaaagacatcacatgatgtgaaatatgccaggcacagaaagacatatctcatgttctcactcatacatgggaactaaaaagaaggtgattttatagagatagtgaatacaatagtggttttgaggctggaaagagtagtaggtagagggattaagaggggttggttaatgcatacaagattacagctcaataggaggagtaagatctagtgttcagctgcacaatagggcaactatagttaatagtttactgtatatttcaaaatagctagaagagaaaatttagaatgttcccaacataaataaatttttgaggagatggatctcccagttacccagatctgatcattacacattgtatgctggtatcaaaataccacatataccacacaaatatgtacaactatcatatatcaataaaaatgtttaaaaagcaataaagagcatttaacttggaagaaatcacattgtcctccctttgcagacaacatgaccttatatacggagaaactaaaagactccaccaaaatacccttagaactgataaattcagtaaagctgcaagatacaaaatcaacatgcaagaatcagcagtgtttctatacaccaataatgaactacctgaaacagaaatcaagaaagtaatcccatttacactagctacccaccccccaaaaaaagacacctaggagtaaatttaaccaaggaggtgaaaggcctctgcaataagaactataaaacattgataaaagaaactgaagagaacacaaatggaaaggcataccatgctcattaattggaagaattaatattgttaaatgatgatactatccaaagcaatctacagattcaatgcaatccctattaaaataccaacgatattcttcaagaaatagaactaatgatcctaaaattaacatgaaaacacaaaagaccccaaatagccaaggcaataccgagcaaaaagaacaaagctggaggtatcacactacctaacttcaaaatatcccacaaagttatactaacaaaaaaaacatggaattggtataaaaacagacatatagaccaatggaacagaacagaaaacgcacaattaaatacacattatttataggcaactgattgtcaacaaaggcaccaagaacacacagtggggaaaggacacctcttcaattatttgtcatcagaaaagtggatatccacgtgcagaagaatgaaactaaacccttatctgtcaccacacagaaaaatcaaccaaaattaattaactactgtgagcctggaaactataatactaaaagaaaacagttggtgggactgtaaactagttcaaccattgtggaaaacagtgtggcgattcctcagggatctagaactagaaataccatttgacccagccatcccattactgggtatatacccaaaggattataagtcatgctgctataaagacacatgcacacgtatgtttattgtggcactattcacaacagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccacatgttctcactcataggtgggaattgaacaatgagaacacatggacacaggaaggggaacatcacacaccggggcctgttgtggtgtggggggaggggggagggatagcattaggagatatacctaatgtaaatgacaagttaatgggtgcagcacaccaacatggcacatgtatacatatgtaacaaacctgcacgttgtgcacatgtgccctagaacttaaactataatttaaaaaaaaaaaaagaaaacataggggaaacacttcagaacattggtctaggcaaagattttatggctaagaccacaaaagcacaagcaacaaaaacaaaaatagataaatgagactgtattaaaccaaaatgcttctgcagagcaaaggaaacactcaacagagtgaagagacaactataaaatggcagaaaatatttgcaaattatgcattcaaaaaggaactaatatccagaatatacaaggaactcaaacaactcaacagcaaaaatatcacaaatattccaattcaaaagagggcaaaggatctaaatagatatttatctaacacatatagaaaaggccaataaaaatgcttatcagcaaccatcaggaaaatgcaaatcaaaaccaaaatgaggtgtcatctcaccccaatgagaatgactattatcaaaaagaccaaaaaaaataaaaataacaaatgctggcaaggatgtggggaaaacatactctcatactaggctggtgcaaaagtaattgtggtttttgccattaaaattaatagctacccactcccaaaaaaagacacctaggaataaatttaaccaaggaggtgaaaggcctctacaatgaggccactgccattacttttaatggcaaaaactgcaataacttttgcacccacctaatagtatagccattatggaaaacagcatgaggggttctcaaaaaactaaaaatagaactaccatacaatctagcaattacagtactgggtatttatccaaaggatagaaaatcagtatatccaagggatacctgcagccccatgtttattacagcagcactattcagaaaaactaagatgaaatcaacctctatgtccatcaatggaaaaatggataaagaaaatgtggcatacatacacaatggaatattattcagtcatgaaaatgatattctgtcattcatggcaacatggatgggcctagaggacactatgttaagcaaagtcagtcaggtgcagaaagataaaatactccgtgttctcactcatatgtgggaattaaaaaaaatggatttcatggaagtagagagcagaactgtgggtactagaggctaagaaggtggggagaggttggttaatgaacacaaacttaggaggaacgaatctgctcatctgcagcactgtagggggatatggttcactttattttattgtatattctcaaaacgctaaaagaggattttgaatattcatgacataaagaaatgataaatatatgaggtgacagatatgctaattaccctgatttgatactacacatagtatacacataattaagtatcactctgtatcccaaaatatgtgcaattattatgtgtcaactaaaaacaaaaggaaaaaactataaggataaaaaacagatcagcggttatcaggggttggggtaggggtggtagggttgactataaagggacatgagggcacttttttgggaaacgaaaccattctgtatcttgattttgatggcagtttcatgactgggtttgttgaaatcatagaactgtctcactaagtagggtaaattttttgcatgtaaattgtacctcaacaaacctgattttattttaaaaaacatttttaaagaaataaactaggtaaaacttggtatgttgtttaccgagcaataacttgtcaatcataacgtaattcaacccacttactacatatgttctactagcactctggccttcacccatccttttaattaaatatttaatgcctacattcccacttgactctaaactccacagatccttacctttggttaaatcggttaaatctcagcttggtgggtgacaaaagttccaggaaacaaaatatatgcagttcaatgagttatcttatttatctgtttcctaccatgtactgagggtcattacttttgggtttatgaaatctaggcagagttctctgaagatcattgagattttgccgtggaggtgtttcaatctggttccatactacataccttgtcctgggtttggcaacggaaacagtcacattcaaagcagtactggtccctcagctgcttccggcgctcctcactggtcatcagcatatccaggtagcagatggtgagctgtgcaggccagagagagggaagcgctgaaacatctgctgtgctcatttctttaacaaatggttattattattgctaattattggagtaaaacttgtttttattataaaccaaaaatataagagagaaggtactgcttatagtttctctacccaaatgatcacacgtaaatttttaatctatttcctttcagtctttgctatgtggtaaatatatatgtatcatatatttaaagaacgggtcttatgatctctacccacttttgtatcttagtttttttcactacaggaaaatatcaaaaactgttgtatgtttactaaggtttgctaataaattctataaccattagcaatcagagaagccaaattaatcctggcaaccgaaagggtggcagatgatacagccagattgctcttaaattctaaccaattctatagctgcctcatggaatttaaggtcatccaaatttggtatctttgaaatgagaaaacagttctcttatttgtatctaggtttggaaaaaaaagggggggtagaataatttccaaataggggagagtttaacttgagagtaccaccactgatggaagcattcaaactgactgccttacaccctttcagagtaatatcccctgcctcggatggtgaagggttataaatgagaggatatatttaaaggactcctcggacactctctaacactgagtcccattaagtcacgggtctttaggcaacatcataatgcttgagcattttgcacttgattagatctcttatgaaagtctaattcaaaatccagaaaacagaatgcttgatcttcccctcaacctgttccatctcggctagagcattctcactctcagttgacagtaactcatcttttgacttatccaagttgaagcctcagagtcatccttgacttcactctttcctttacacttgccatccaatccaccaggaaattctgcgggctccaccttaaaaactacccagaatcaaccactttttaccttttccagtgccaccatcctggtctgagccatcattacctctcacctgtaaaatgtaatagtctcacaactggtctctctgattctttctccaggccccctgcactccaccctctagccagagtgattcacataaaatatgtcagatgacatgttctgtttgaaacatcacaacagctccccactttgcctgagtgaaggccaggtccttctaactccccaagtgcaattcaaagtatggtccccgcattggtgccagtgcgcactgtgggttaccagtccatgacgacatgagtcaagaaacaaagtcaatatttagaaatgttttttactaatttggtaagggtaattttatgtgactctaataataaaacattgggctttaaaaaaaaaaaaaaagacagggtctcactgtgccaccaaggctggtgtgcagtggcatgatcacaactcactgcagcctcaacctcccaggtttgggtgatcctcccacccctcagcttcccaggtagctggggctacaggcatgtaccaccacactggctaattttctgtatttcttgtagagatggagtttcgccatgctacccaggctggtcttgaactcctgggctcaagcaatccttcctccttgacctcccatggaattacaggcgtaagccactgcacccagcccttcatttttctaataatttattttcactagattttataaaaatactggtctgcaatagattatgaaggaaaagaaaaactggtccttcgtcataggtagagaagcaatggcttcacataatcccacctgttccctctcatttcccagtttccctcattgctgctgctccaccaggctggcctcccgtctggctccacacacactcctacctcaaggcctgtgcactggctgttccctctgcccttctgccccgtttactatgacaacctccctcatcgcctttgagtttcagtcaaatcccactttctcgttcaggtctaacctcaatgccctattaagagtaacaacccaattcccttacctgctctagtttttcttttcctgtatcatatatcagcttgtaccagactgtagaaattacttctttgcttttaaaagtagaaagtaatcatggcggtatgtgtggtggggggagaagtgaagactttggcagagcaagaaggcaggattatccactgaagggatgcaaaaaactccctagagcagaaaactccatgtggtttttgttatacttaaaagaaagcatctcatgtctacaaagcatgatcttacttgtttgaaatcatagtagggcaaaggcagccaccctctctggcagaaaacaaagctttgggaaggactctctcaagctgtaggggtgatggtggatggctgggctggccagccagatctgtcaaatccaccatggccgtcaccatcaccaacgggacaggagtcacagcctgatctggctggctggctctccatagattcttcacattaggcaaccataacatgctgctccacacacagaaacaagaatatctgcccttaagagatacagacaatgacgttactgagtatctactgtttgtggcgaggcagcatagcacagtaaaaactggcaaaggtcttgggttcaggtaacactgaagactgcacccagatctcttgataagtctgatgctctttttacttttacatggctgcttctcatacttggcagggagagagggctgtagaagaagctggcgtcccttaaggagtgtccgtagcaccgtcaaacctaaaatactcacacctgtgttagagaatgttctgtggcaactgagatccttcagctgagacaacagccactttttgatttcctccatgtttctcttgcttcatgatctgaagccagggttgcctctgaggcacaaagggtcacctataccaggcaagttcctcttgtttctaatgaatgctatgttccaaattccaaataacctatttccaagctcactttttgaaacagcctatgagtaagtctgggacagtagatagattcatcttatactatcaggctctgtgggtcccagtttccttacaggaggtgaggtagcaaatgagcgcatccctatgtcccctcttgggttaactctaggacactaattctgaatccagcccaatggctcttagtcatcaactcccattatcagagcaggtaaatggacagtagttattgggagattacagtgtgcccagtgtgaagccactaactccagggcctgtcatgccagaaaaaaatgtgcttgactaacccaagactttattacaagggccaaaactcatgagtgatcttgtcaggcagtgaatggccaacaggagactagttatttcatttaaccccaataaatgggctcctaaagcctccctcggcatactgtaactgcctggaaccattacctggactacgcaatggctttctaactggcttccccgctgcctgcagtgtacctttcatcttctaaactgctttgagagagatcttcctaaaactcacatgtgatcacgtcatttctctacataaaaacttgcgatggtttctcactgcccttgaataaaggcacacaaggatttccctcagctgtttttctgtctgcctttctagcctccatgtctctccctgaaccccagcctgtcacagttatgtacattgctagacctctgaaacaatgaacaccatgccaacatgtgtctgggcatcactggctaagcgagcctctcctccacactcagcctcctgagagcctctcatcctccaagcttggctcaaatacacctcttcctatggcgactgccccattacctcagagaaagccacccatttttgtgcttcttttatgccaatgaagtctgcagaatatctggttatcaattgtgaagtgcttaatggcaaaaatattttattcatatttttgggaaaaaacagccagattactaactggtaatgacagctaaaatcatgttattagccaaagataaaaacctttattaaagactcattgactcactagttgtaatggaatatctgctcagtaaatgtaaggctcatttagtgggaatgtatatgtgaaacttggccattgatcagtagacaccttaatggcacagaacaaaattgcattaaaatattaatgccattgaccactgctctgccattttagtgcagctcttatagaaaatgcagtaaatcatttctgacattagagtaatataatgaaggagattttctagatcttgaatacatagcttacattaaaatctcaagacaaaatgaactccttttccatgaaaccatcttttcattgtctacaactgagtggataagatgagcaagttaaggccggccacggtggctcacgcctgtaatcccagcactttgggaggccaaggcggtaggatcacgaggtcaggagattgagaccatcctggctaacacggtgaaaccccgtctctactaaaaatacaaaaaattagccaggcgtggtggcgggcgcctgtagtcccagctactcgggaggcagaggcaggaggatggcgtgaactcgggaggcggagcttgcagtgagacgagatcatgccactgcactccagcctgggcgacagagcgagactccgtctcaaaaaaaaaaaaaaaaaaaaaaaaaagatgaccaagttaaaattagaccttgtttcatttctagaattccgtgatcacagttatgaatgtttctgttaatactggctctgaactggaaaaaagcctgaaaaatgtcacttctttttaaagtcaaacctgagtatctttgtgtctcttgtttcacaagttgtgtccttgtttcacaaatcctgctaattttatcttcttaatattatagtcttcaggtaccctatcacaagccaccacctgagctccccgacttcaggctaccactgttatctcttccctggattattacatcaccccgacgctcattctcccaaccttgcctacacatagaaaagtggtcatacaaaaataagcaatgagcaaaggacatcctgttcaataaacggtgctaggacggctggctagccatatgcagaagacacctaccttgtaccatatataaaaattaatacaaagattaaaaatttaaatgtaagaccacagactttatgcaccctagaagaaaacctaagaaacaccattctggacgtcagctttcggaaagaacatatgactaagtcttcaacagcaattgcaacaaaaacaaaaattgacaagtgggacctaaactaaagagtttctgcacagcaagagaaactatcaacaaagtaaacaaacgacctacagaataggagaaaatattcacaaactatgcatctgacaaaggtctaatacccagaatctataaggaacttaagcaattcaataagcaaataacccaagtaaaaagtgggccaaagacatgagcagacacatttgaaaagaagacataccagcagccaacaaacatggttttaaatgctccacatcactaatcagagaaatgcaaatcaaaaccacaacgagaaaccatcttacaccagtcagaatggctattactaaaaagtccaaaaataacaaatgttggtgaagctgtggagaaaagggaacacttatacactattggtgggaatgtaaattggttaacccactgttgaaagcagtttggagaggagctcagaactaccatttgagccaacaatcccattactgggtatatacccaaagaaaataagtcattctaccaaaaacacacatgcactcacgtgttcatcacagtactattcacaatagcaaagaaatagaatcaacctaagtgcccatcaacagtgagctaaaaaatgtggtgtatatatatatatatatatatacacataccatggaatagtatgcagccataaaaaagaatgacatcatgtcctttgtggcaacatgaatgcagctagtggccattctcctaagcaaatcaatgcagaaacagaaaaccaaacccagcaattacagatttctcataaattgtggaaacaaatatttagagaatctatcgaaccaaacacccaatgttctcacttataagtgggaactaaacactgggtactcatggacataaagatggcaatgacagacactggcactactagagagggaggtagggcaaggggtgaaaaactgttgggtaccatgttcactaccagggtgatgggattcatcacaccccaaagctcactatcatgcaatatacccatgcaacacagctgcacatgtgccccctgaatctaaaataaaagttgaaattatttttttaaaaatcacaattaggttactaaatattcttttagcttaattcaaaaggtaaatgaaattacatttcttttacacttatccattcttaagaatggggcagggacttttataatgaatttaactgtgaaatcacaatttagttatttattgaatataatttaataaaaccccgttaaaagtaattttatcatcttaagccaaaaacaaaaatcaaacttgtatgtatttgtattcaacagcctaaacctgaaagcaccggctcatttcagacttaaaggtaccttcatttaaagtgaaactggtcataacactttcagcttcaatttcagaggagcatgtattagaacaaagactgcctatagaaaatgttaatttaagaatggaaaataatctgtgtagatgtcatcatggaccaacacttctatacacaaaccaaatgttattcaacagttgtagcaatctttcttgccgagtccaaacatcagccagaccacctccaccaaagaccaattattctgctttgatacgtaagatgagatttactatagttttgatagattctctaaatatgtttccacaatttatgagaaatctctaatgtcatattttttttttggacactcaccatttgagctctacttttcccttcaggaaactctaatcacaaatggaagaagaaaatcactatgtagtaagcatcatgtgctgggcactgtcctaggtaaataatttgttacttcaatcctgagaatgaagctttattactaaccccctccacactgcgtagtagtaagtgtagcactgaacaaatcatttcccagtttaaaccttacattttcttccataaaataaaaaaaatgaatatgtaacattatctgagttttctaagattccaaagatggtacagactacttaggtcttactcaattttgtagtccttgggttttgttttttgtttttacctattaggcttcatctattgcttcctaaattgaatcaccctataaatattccctatcatcatagccatggtcgtatatacaaaaagtgaatgaaaggcaaaggaaacatcacgtttcaatcatatggttcaacgagttgagaaaaactcacactacagcaacagtgactgaggtaaaattgaatgtacactgagtaaaatgtttcgtttgtgatatcccaaatctaactcaggggttagaattgggtggggttttaaaaattgttttcttcaagtgttttatgtatagtacatacaataaaaaacagtaacatttgtaaacatgcaggaaaaaaaaaacaagaaaatctggccacgcagttcctttgctgaaacccttcaatcatgtcccgctgctcgtccttctcccttacacaaatatttactgggcgcctcctatagaccagccaatgttatgaaaccttcagctaaaccaaggtctgtgataaggctcccatggggtttgtcagtctgatccctacatcttccctcaaattcgggtcacatctaaattctttcgtcgtctattgatgagaactgcttcctactccttgaactcaccattctgtccctggcctctgtgtctatgtctacaatgccttttccagcctcatccaactctaactccatggatcctttcagagtctaggagtcagtcctctggaagcattccttaaccactctccactccctccccttactaatcactcgagtgctcctgctctgagctgctgtaagcctgtgcccatttacaccactgtgcatcttaattctattattgttttctgttctctgtcagtttcctcaactataccttgaactcttgaagtcagggctgggtcttaataatctttgtattagagaaggtttctaaaactgctaccaactcctgacatccagtaaacatgcagtgaattcgtttaatggtttagcaaataagatgactaacagaagaaacagactgtcttaatcccaaaagacatcagattaagactgacattagggatactaatgcattcaacttgtgtcaatcacatttctcccagttgatatggcgccagagaatgctggcagccaatggcattatttgtaacagctacaagttattttaaccaggaactaccataagactgctttggcctacccagctttcctccctgatccatgttttataaaactatcagaacaaatgaatctcatatttaagataattttgaaaaggtagccatcagcaatccagtcaagtgagccatgacttaaatgatattacacatctctctctgtaggaggcggctgaatgaggagacaaaaatccaaagtcaaataaaaaaaaaagacccaataactcagcattacaatggagagccttaaatagcaaagtattataaatgttgctggtttgcaaggaaactgtccaaagagggtccaaaggatggatttatatagagagaaacatggggtgagaaatttccatggcaacttctgttatcacagaccttgtgcaattttccagctctccttgtgtgaggtttgaaatgctcccatcttaaactggcagtagactggctttcatattcccttcctttcaggagccatgggacaccactgaggactgccagtcatttgtaaatgtctgagactctattccagctttttttttttttttttttttttctgagatggagtttcactctgtcgcccaggctggagtgcaatggtgcgatcttggctcaccgcaacctgcgcctcctgggtttaagcgattctcctgcctcagcctcctcagtagctgggattacaggtgtgcgccaccacacctggctaattttttgtatttttagtagagacggggtttcaccatgtcggccaggctggatgcaaactcctgacctcaagtgatccacctcccttagcctcccaaagtgctgagattacaggcatgagccacggtgcccagccctattccagctcttattttatctttaagaagtctcattaatttactcaacaaatgttgattgaggaacttctgcctcagttgctgttgagtcttccattgtgaatcccatattctgacactcagatcccaaatagctcatattaaaactgtgggtgccctaatgagcactaaagccaaatgcaaagttcatgataggaaattaccaaaatgtctaaaattttttcccaaggaattttaactttcaaaaaattaatacataatatttatacatatttatggggtccaggtactattttgctacctgcatacgatgtgtaatgatcaagtgatggtatttaggttatccacgacctcatgtatttaccatttttgtatgttgggaacacaaaatgtctagatttattccttaatttaaagctaatatttgtacaataaataggaattaccctgcttaatcaatgcctcaaactgtcttttctcatggctctccctctcccctacctctgctccaaggggtcagtttgaaaggcataggatatattttagttgttgggggatggctacaggcattagttaagcacacgccaaggacacaagtcttctccaatgatgcaacaatcccacacgatgaagaactgtcccattcaaaatggcaatagtgtccccacaagaaatactgccggtcattagagtaagctcaatataatagagagtcgattcaacaaaaagttatcaaatgcctcctggatgcaaagctaagtgctaagagatacagaaataagacacgattgtctgtcctcataaagctctaaatagagaggtctccaaaacagccataatatgtgccaaaaatgtattaataaccactataagcgagaactcaaaggaaaagaacttcttctaatatgggaaatcagggaaagagttacacaagagatgtgattgaaagggtatcttagtccattttctgctgttttaacagaataccacagactgggtaatttataaataaatttctcacagttctggagtctgggaagcatgatgccaaaagcatggcaccggcatctggggagggccttcttgctgcctgataacatggcagagggcgtcacatgaggtggcagcaggagtgtcctcttcttataaagccaccaatctcatcatggggttcccaccctgataaccttatctaatctggattacttcccaaagactccacctccacaaagcatcagcaagaatttggggataaagttttcaacagatggaatctgggggacatgtttaaatcataacaaacagcctcgaagggcatataacattaagacaaagagacacagtggacagaaacgatgatgaatcaggggaaacactgttcagcaagacctacaaaatggaatggagaaatgtttattctcttaaactggtatatatgaaggacttgtggggagaaccttctttttgttgagaagatgccttgctaagtaccacagggaaaaatatctgagtctgaagggctttacactgagtggaaatgtctcgtatttggcaagagggaggatttgcttgttgctccagagatggaaagagaaagatgtgaaaaagtgaaagcagcacctaaagacaaggtgtcttattcaactaaatgaaaagcaaccacgggagaatgactggcagccgagcctaggaaaatagaagaaactttctttgttgtttctgaaaattccaaccaactctaattgcttttgtcaagttacttggtttgttttttaatttgcaaaaacatcgtcatcatcgacaacagcagcagccgctcttcagcccccaaatgaatattgctgaaaatagatagcggtttcatctcttacctgccttgaagtcctttgcggccccagaaaaaaaagagaaaaaactacattgtccatctcactgacatctatcccagtatatttcatacactggtcctaaaatctggaaatttagcgagtagttgtataagaagtggctccttccactgaaaatcagtttggggagaatcttgtcaaagccaaatccctgtctacataaaatatggtacctctgagttgaggttttattggctgagtgctgcataaatgcaataaaagctttcagtactgttttccttgcaataaatatccactttagcaaattggaaaggagaaggaaacggggttctggaaagtagaaatatctgtaactcagaactcagcatgggtagtcactgtgcaaaccagtgcaagcttaggttcagagccctggagcagcccgtttgcagctgtcttgtaagaaggttctgcaccaaaagaggctggctggacagtctgtcaaactggaggggtcaaggccagttcactgctggaggtcatcctccctgtcctctattccctttgcatctttgctgaaatgatcacccagagatgctgatgggtttgtcaagtcccaatgtcagcctgagacagtataagctgtttgctttactagcacaaagttaacatgcatcattaccttcaatgtagccagtggccttccgagtgaagaagtcttggggatcccactcacaagctgggatgcccccccctgcccacggaaggatatgagaggctgctcagctgttgccactgaggagatttcatgaattccctgtgtgtgcataaaacacacaccctctgtcatacacaaactcctctctctctcacacacaggacaggaactgtcatcatccagaaatatggtgacctctcccctaaaaaattagcccatttgtaatttgggagaagaaaggataggttgctggggagaggtgactgaactacaaatactctcactggcagaaggacaatgaaaagttgtcccctcaggcacaatcagttttagggacgggccgagctgagagggtctttgataggaaagaaggccaggctgggaagcatgagtttccttacctcctctcccacctcgatgtctcggactgctcgcagtaagaggtggggcccattgaacacaatcgaacagttggggtcacagctgtgattgagcaaagagatactggaaaaaaaaaggggggaagactgtcacagctcagcaggtagagtcaactaaatttaacaaatgcagtgggtaaaatacaccttcctttggggggcagcagcaggtagggttgacaggatgccaggggttcagtactcggggatgcattcacagaaatgtcactagcacacctcccacgaagtgcaattctcctcaagatgcaggctaactagggaattccgtcatttaataataaaaaaatttcctgagtcctttttggggattggggcatagttgactgattagataacagtcaataaggcaacccaacacgaaggtcagaaagaaactgactcagaaagaaatacttagacagctgggtgtggtggctcacgcctgtaatcctaggactttaggaagccgaggtgggtggatcatttgaggccagcagtttgagaccagcctgatcagcatggtgaaaccctgtccctactaaaaatacaaaaaaattagctgggtgtggtggcacatgcctgtagtcctagctactcaggaggtggaggcaggagaatcgcttgaacccaggaggcggaggttgcagtgagccgagatcgcaccactgcactccagcctgggtgacagagtgagactccatctcaaaaaaaaaaaatactcagacataatgggatgcagcagccaagataccactgacctctcccataggatctcatttgttgagctcctttggagaaatggccgcctttgctagaacatccacactgaaaaataattaggactatttgctcttaaatagagagctgacgttattttgccacctacatcctgatgcatcctgggccatggtccagtcattttattaccttggagggacatttcttaccatctgggaaacaaaatggatttaagctgctatcaggaattggtaataattagaatgagcacttactatgtagaaacactttcttgcacttgagcatgttcatcacatttaatcctcacaacaatcttatgaggatcatttacaggtaaagagactgatgcacagaaattaaatgacttgctcaaggacatacagctagtaagtggtgatggaatttggaccaggtggcctgaacgcagagcccatgctttgaatcatcctatgttactgccttttgagaaccacctaccagtagacctgacctacagttaatgacaattgtgagaaataagaaaaaaggctgaattcttagattcacaattattagaaagtctaaatttgtatttggactcttatggcataaaaacaaaatgaaactgggtgtgcctatagtgcttgtggagagacggtttcatagctcagtggtaagagtcagctcagcaatagctggagagagcattcaggggccaaagcctgagagttttcttgcctccttgagtgaaagggctcagagtgtgccaactcgaaagacaacatgaacccaactgatacgtacggcaagtccggtgaaatcagcatgtgctgcagctcaggaaactggggaataaccaaaaatcagcccgatggttaattagcacccaccgtcctcaacttcttcacccaaagtccccctgagaacaagagtttagttctgagatctgcccctttgttaatatcacagcatataatgtggggttataaaactgttttctttcaacttaacattttccatttttttgtaatttattgctaagttttaagcttggctcttgaacaagctgcagcaactgcctttctaactacctccaaagggctggggatttgggtgggaatgaaagtgtgtcttccagtacatgaagtaccatacaccatacctgggatataggccaacaccaacttcctgcatctccgcattacagatggtgaaagagttgcagatcacctgtaaacacaaggggaaccatcagtattactagagtcacttaagaaacttcatagccaagagaataaaaaacgttcaaacccaaatgtaggagcatcttagtagttgcttaagaaagagccaagccaatcatggatgctctttgacttacaacagaatttatctgggatatactccccctaaaaacatcaggtggttaagtgcagaaataccaacctcctgggagaaaaaaaaaaaaaacagacggaaaccagcagaggaaccattaatttcagtctcattatccactaccccaaagttacagttacatgaactgttcaaaatccagaatatgaataagctatttattgaaaactagactcctgctgtatcacgattttttcaaactgcatgcagtttccaaatgccactgtgtatctgttcagtgatagcaacttgtctcttactcctacagaaagcgaagtatcccgtgactgagcctgtcgtctgatgcgtgttggtgaagaccacagggagcactggaggtcatttagtcaagccatggtatttaccaggagtccatcactgggtacatgacacagtcctgtcttatgcagggacggagcagaagcagtaaaaaacacaatcgactgtgctcaaggaacttaaaaacctcgtttgtgaaataaggttgatgtatgaggtcacacagaaccatggaaagagcactggaccagaatcaggaaatctagattctggctaaaatcactgcttcagacaggtgcgaggaaaagagcagtgaagaaaaacaaaacaaaagttcctgcctccgtggagctcaagttctagttgaatacacagattttttaaaaaacccaatgatagaaaactgtcacatgtagataaatgccaaggagagaaacaaggtccttacagagaaaaaaagttgtcaagaaagctctttaggatgagttgacatttaagcaatgacctgaagggactgctgaaatgaacgtgtgtatttataggcgataaaggctcatatcaggagaaagagcaagtgcgaaggccctacgctaggaatgcccgtggtaacagaggaacagcaaagaggctagtgtgaccaaagcggagcaagaaagtagggggcaaaacacgagctcaaagacggagtgggatcacttacggccctactgccatatttgggttttgctctgaagaagatagaaagccactggattttgagccaaggcatgaaggagtctgacttctgctttaaaaggatcattctggctgttgtgtagagaatgggctataaaaaggtgaatggaagtggagaaaatggttaggaagtcactgctatagcccaggtgatagacaatggtgactcggatgtcggtagcaggagaactgggtagcacagccaacaggccttacttactgcgggacggcttgtggggaatgaaaggagtcaggataatgctcgagtttttggccgaagcaagtggaagatcatagctaccatttattaagatgaggaagaatttaacaggaacaaatttggttacagggagttgagagcaagtccaacagttctgttttggttaagttaaatttgaaatccaagccaagactaagaatgaacaattggagttcacaagaggagttgcgcctagagatataaatttaggatgaaacatgacaaaggccatcaaaaaacaaaaaaaggagaagaggctaaacatttgagatgaaccagagactacaaatggatgctgacttgttataaagtttctgtaaaggaaaaagtgatgacgaatttctcaaatcaggtttacatgaaagaacacgaagtatgaaaacacactgagtcctctgagactcttccactgctccaaacagctcttacatgaaatctagtgcactctagcatgatttggcttttttccctctaaatatataaaattgcagtttcaaatcaggagcaaaattatacatatatatttgtaaacaaatgctaaattgctttaaggacaactattttgcattaagcagcaacagtacattgtctatatatacttatgtataaattggatggtaaaaatataagacagaaagtcctacgtttaatttttgaaattttaaacatttttaaatgtgtataatttgggaagggatacaagttttaacaaatattttaaagtataatgagaactttagttgaaataatccaccaacaaaaaaaccaggtcaaacacatctgatctgttaacttctgaatcaaaccagcatggttttttcctggactatgaagcaaattaacggttttttcaaaataggaaaaatctttatcagtttttttccatcggtttatttcatggattctgatggaatgtttaagaaggaaaagctaacaagaggaaatgtcagcttgcttgtctcttccactgggaaactcttcctgatttcctaagatgacttccctctttagcagcatttatcatactggatcattatttacccatttacttgccatcatacacaactggatcgtaaaatacttgggagggcagacacagtgtttcattcatcactctagtcctgtacctggctcaaagcctggcaaacagaagacactaataaatctatttccttttcttagagacaaggtctcactctgtcacccaggctggagtgcagtggtgcgatcatggctcactgcagcctcgaactccggagctcaagtaatccaccctcagagcctccggggtaactgggactacaggctggcaccaccacctctgactaattttttaaaactttttgcagagacaggagtcttgctatattgccctggctgaccttgaactcctggcctcaagtggtcctcccgtctcggcttcccaaaatgctgagattacaggagtgagccatagctcctggatttcatctatattagtctgagtgttacgtgttagtctttctgggctagtaaacagaaggtttagttttttgcctactctcacttttatttaaaatgctggctccatccagcactatctcaattaacaacctgacaggaaatatttttgacatacacaactgatagcaacagtggatatgcagaagctctctggcttttttttagtgcaagaataggtagataatatgtccatgtgtgctcaataatttgaaaggaattgctctttatatcaagaattaaaagaatggaaataaagcccagaaataaaagtttaaacatttttcaaagtactgtctttgtgaaaacagttttcttagggaattgcacaggttaaaacaattaatgaatgcttacttcacaaaaagataacatttagaaaaaaatattaatggtactacttcaataaaaaataaatgcaactgggttaatgaattctttctaaaaattaagcttgagtattactttagaaatttttaccatgtcttaaaactaaaacacatatttaaattgttttattattgaatgcaaagttatatttactttctgtaatttttcctttaaactaattgaaagccttcatatataatattatagtttttctagatgacaaaaatctagtgagttgtcattgagcctctgtattttataaaaacaactacagtgaaacttaaaatgttctgtgaaccaaattcttatgtcatttggttcagagtctaggtccagaatctgacatttgtgtcctgaggttagcaattccccggtagattagacacaaatagcaaaatcaataccaacacacaaagtgaataccttacaaaatgagtgtattaccatgtattcaaatttcatatttttcctgaaattcttaggactaaaggctttgtattgtagcagcagttaaactgagatatttgcaacacaagagaaaatcactactaagccattatcttgcaacggtaaaaatcagaacagccataagcaaactcacaaccaatcagagctgagtaattctacaccataagacaagaacccagccacttcccagccccctcccccaattactgaattctacacagcctatttcaaataatactttcaatttcccaatatatatacaaattttaaaacacatttaaaaagaaggggattcagtttctgaacacaactatacagaggtttcctccaagaccatctgcatctcctttaaaacttttctgtctaaaatgttcagtacagtgtctggcacagaagactttaggcacatcaagtttactaactagagggactaaatatgagttttcaaaacggagtttaatgtacttagttttattaaaccctggacagaaaaactggaaggaggaagagttggcaggtacgaaaaccagaagcagaagcttttacactacataactgcctctgccccccggcaccccgactcctagaactaatatttctctaactttaaaagcacaataagaattttaatcagggtatatttttctctacccacagaatatgacaggttattaagtacagatttttttccagaatcttctcataaaccttaagagattaaaaattgtatctcccaatccctccttatctgtatggcaaatatttatccatccttcaggacccaattcagtccttgcctgtcccattgcctcttttggtcacatagttaaagggtttgaaatctccaaaccagaacagcgggaggggaccaggctggcgacggaggtcagctcaggagaggagaggctatacttcttaaatgatgattcgcaaatcccagaatccacaaagtgttaccggaaggtttacgagagtacaggtgatttcggcatctgtttcaatttcaattaaaaaaaaaatccataatagaaacaatgaccaactacatttccctttgccaggaagttgctggagggtctcaagttttaccagggagcatgctgtaaggttgcggggacaaaggcccatgctcacgacttagtcactaagctgcatcttcactacactgctagtcttgcgacagtttgacattatagttttccattgtttcttagtcacgttatttcatttgcaaacctaatggacccctgattaaagacagaagcaagtaggagatatgactccaaagcacaatgtagacaaatggggttgcatcaaactaaaaagcttctgcatagcacaggaaatggtcaagaaagagacaacccacagagtgggagaaagtatttataaaccatacaacggataagaggttaatacctaaaatatataagaaactcaagcaacacaatatcaagaaaacaaacaacccaattttaaaatgggcaaaggatttgagtagacatttctcaaaagaagacatataaatggtcaaaagattcatgagaaaatgctcaatatcaccaaatgctcaatcattaggaaaatacaaaataaaatcacaatgaggtatcacctcatgcctgtttcatcaaaaagatgaaagataaaccttggtgaggatgtggagacaagggaattcctgcacactggtggagtctacattagtccagccattatgaaaaactgtacagaagttactcgaaaacctcaaaatagaactgccatataatcaagcaatcccatttctgtactcaactaactaaaataagagatatccgtgctcccactctcacgtgcactgcagcatttttcacattagctacgatatggaattgacctaagtgtccatcaacaaatggatcaagaaaatgtagtatagatacacaaatggagtaatattcagcccttaaaaagaaggaaattctgtcatttgcaagaatatggatgaacctggaggacagtatgttaagtgaactaagccaggtacaaaaagacaaataatccatgatctcacttatatgtggaatattaaaaagtcaaactcatagtaatagagtataatggtggttaccagaggcatgggctggggagagaaatggggagatgttggtcaaagggtgcaaagtttcaccttcttcacaggaggaataagttcttgagatcaccacagcatgatgactacagttaataataaattgtatatatatttcaaagtttccaagaaaaaatttcaaatgcctcaccgtaaaaaatgacatgaggtaagggatatgctaaattagcttgatttaatcattccaccttgtatacatttaccaaaaattcacattgtactctaaatatatacaattgttattcgttaattaaaattttaaataatttaataagacagaaagcaaggatgttgaaaaacaagggaaaatacataaaatgataattctataaatttgtctcaagatgctttatatcatgacttaccaggttgaaattcttatagagcatctcaagacatctctaatatttgaaaaaatgttaggaggagaacatacactgaatacgtaatcttatttttttttttgcagatggcgtgaagaccacgaaagtccccagtgtgtgatttggaatgtgcttgcactttgctacctaaaacctttcttgtcttataatcgagaaaaagaacatagaagtcatgaaacataatccagctggtttcttaaagagttaattataagaatgtgaagcatcaggtcatgaaagcaatatgcaacctaaggcccaaagcaataatatttcatttaaaaatttgtgttgattaaggccaggcgcagcggctcactcctgtaatcccagtactttgggaggccaaggcaagtggatcgattgagcccagaagtttgagaccagcttgggcaacatggcaaaacctcgccactataaaaaatacaaaaattagctgggcatgatgccatgcacctacctgtaggtccagctactcaggaggctgaggctgcagtgagccatgatcgcgccactgcactccaatgactgtccccgccacaaaaaaaaatgttgtggtaataatgtttttacaaaactaatttacagcaggttaaaccatgcgatatcacgtgataaaggagaaaactaaaaatttgtctttatatgctatgattattaaagattttacaaattcactttgtaatacaagtcaagtaaaaaataaaataataatattatttaagaaaactctttatcccaccacacatgacaatatatttgggaatttgtctttctagactgagatacatccaactgttttcacaactgcagtggtgtctgtcccatttcaagctctggccacaaataagtctgcagtgcacactagacacacaaaatcctcaacaatcacttgtcaaggctaaaatcaatatcaaggccaatatcataaggaatggcaatcataaaattgtgctttctattttatctctctcccacagtcaaactgccaaatgttagcaaatgaagcccctttagataacatgctttctaaaatccacagattttcattttctaaaagctttactcacaacagaacttataaacaactatccttgctaatagcaaaatagtcacatatttgtccactgttccttccctgaggctcttacctggcatttcacctccttaaagccatctgatgaaacaagcacttaccacagatgtctgtcaaatacgtagagaaggtataaagctctgacacatcattttcattgtttcattttcttcccatatcctgaggctcagaaattcttcaataatttattacaagacatcattataggtttccatagctccacggtcacatctaccaatttcatttagatgtgctcctacccaaaaggtttatcacaatgaactgaactttctcccatgtatcgcacttaaagattcttttgttcagcttaaatcttcaaaaacattctcttctatgatactctagtttcattattctctaagtaagtggtgtggaaatccacccccagcagtaccaggacgcctcactgtaatcttactcccagtactaaattcctaaatcaagtatgctaggtgctgcatagcacctgactgaagttgaattagatatggcagcgtgtggctcaagttatctgtttttccgtcaaattaatggagaaaaggaaactacagaaaaacgttacacgtgaaaggtaagactgcacactaatcaactgcttaaagtaatccccaaatgaaagatacagtgcgtgctgaggttcctttcactatgtagaaattaaggtgaatattctctccgggtgaacttttggcaggcaagggtttgccataccgatgatgcctgacatctcagggagtgaaacccagaagcaggtatttcacatgacagtagctgaagtgtgcatgactcgtgtacaagctgtgcgggcccgcatgaaggtattttggggactagtgcgtggctgtttctggcagccaatgacaggctagatggggagcaccttggggggccactccttctttggttgcccaagcatgcctgatccctggatacagcccgataacctagtgggcaggagccagggaagaacaaacacagatcagacgagagagagtcacaactttaattatgcagtcaagaggcatcaagaaatgagtctctgaggtcagacagcccctcttttgatctctccaggtatgctcctttatttttggaaatatagaaagaaataaaagaggaaatttatcatggcttcattccaactcctacactgttcctttgtacagaagtagctcataattcttccccttcttcttccagacacttttatagatggccagatacacaaatcagactggtgggatttcaatgcaaggatatcatttgatcttttgtcttctcttctggtaccatttttaactagtcaccatcatgaatacataaatagtgccattcccagcctctttcctgaccagattcctgagttggtaagtagctaaaacaccagcatactgcccctacaccgcttcagtgagttgctgcagcaatttgcaaggaaggttcccctttcctgactcaagagttcatcagaatgtgaagaaaagaggagttcaagaccaccctggccaacatggtgaaaccctgtctctactaaaaatacaaaaattagccgggcgtggtggcctgaggctatattcccagctactcgggagggtgaggcagaatcacctgaacctaggaagtggaggttacagtgagccaagatcacaccactgcactccagcctcggcgacagagcgagactccatctcaataaaaaaaattaaaaaataaaaaaatttaaaaaaaaaagaatgtgaagaaaatagataatttagaaaagtagattaaacatattttcttttgtaatggacattgctgaaaatacagtttgacaaactcttcttagctagttagcaggaccctcttgactaagaaagcattatagaagtatcggtttaaaaagatagacaggccaggcaccatggttcacacctgtaatcccaacactttgggaggccaaggcgggtggatcacgaggtcaggagatcgagaccagcctggccaatatggtgaaaccccatctctactaaaatacaaaaaattagctaggcatggtggtggcaggtgtctgtagtccaagctactcgggagactgaggcaggggaatcgcttgaacccaggaggcagaggttgcagtgagccaagatcgcaccactccactccagcctggcgacagagcaagactccgtctcaggaagaaataaataaataaatagccaaaccctggcctagaggagacaggctgactgttgggtccagatctggtccccatcaacttttctagtctcttctctagtgtctgccttctcatgttttcctctcagttttcctgtcttcacaccttcatgtctctgccaggtggaacagtcccactgcttagaatgttctcccctccttcctctagctactgaaataccactggtcccttaagaacggttcgaaagtcttttcctgtgggaggccttcatgtcattgaaaaagaagaagagagagggacagctgcaatcactgtggctccagtcggtgccggggagactgggtggtttggactgggaggaattctccacagtgcagcatagcggctatggcaaatcatggccagactgtttctttaggtgggtcacagatccatccctcctcaccttcccctcagggaatttcagcaactccagccaggggtttacggacagaactctgatctccccgggacacagcactggggggaggggcagctatggtctctatgttcagcagacttagtctttcctgcctgctagctctgaagagtccatgcagtctggacaaggggaactccccccagcgcagtgcacctgctctgccaaggggcagccacactgcttctttaagcatatccctcatcctgtgcctcctgactgggtgagacctcccaactggggtcactagatacctctgacaggagcattctagctggcatcaggtcagtgcctctctgggaggaagctcccagaggaaggggcaggcagccatctgtgctattctgcagcctccactggtgatacctccaggtgcaggaagcacccaggtgaatacggtctggaatggactcagcaaaccacagcagccctatggaagagggtcttgactgttaaaaaaacaaaacaaaacaaaacaaaaaaaaacagaaagcaccactaccaccgacatcatcatcaacaaaaaagactccacaaaaaccccacctaaaggtcaacagcctcaaaggtcaaaggtagataagcccacaaagatgagaaagaatcaatgcaaaaatgctgaaaactcaaaaagccatagtgcctcttctccttcaaatgactgcaacatctctccagcaagggcacagaactaggcagagtctgagctggatgaaatgacaaaagtaggcttcagaaggtgggtaataacgaacttcactgagttaaagtagtttgttctaacccaatgcaaagaagctaagaaccatgataaaacattacaggagctattaagcagaataaccagttgagagaggaacataaatgacctgatggagctgaaaaacacaacatgagaacttcacaatgcagccacatgtaacaacagctgaacagaccaagtggaagaaagaattctgagcttgaagactgtcttgctgaaataagacaggtagacaagattagagaaaaaagaatgaaaaggaatgaacaaaacctccaagaactattggtttatataaaaagaccaaatctacgaatgattggggtacctgaaagagctggggagaacaaaaccgagttggaaaacataactcaaggtatcatccaggagaacttgcccaacctagcaagacagaccaacattcaaactcaaaaaatccagggaaccccagtaagatactccatgagaagatcaaccccaagactcataatcatcagattctccatggttgaaatgaaagaaaaaatgttaagggcggccagagagaaaggccaggtcacgtacaaagggaagcccatcagactaacagcagatctctcagtggaaaccctacaaggtggaagagattagggatcaatattcaacatttttttcgtttgtttgttttgagacagagtctcactctgtcacccaggctggagagcaatggaacaatctcggctcactacaacctctgcctcccaggtacaagtgattctcctgcctcagcctcccgagtagctgagattacaggtgcatgccaccatgccaagctaatttttttgtatttttagtagagacaggttttcaacatgttggccaggctggtctccaactcctgacctcaagtgatctgcctgcctcagcctcccaaagtgctgggattacaggtataagccactgcaccctgcctcaatattcttaaagaaaataatttccaacccagaatttcataactggccatactaggctttataagtgaaggagaaataaaatccttttcacacaagctaatggtgaggaaatgtgtcaccaccaggcctaccttgcaagagctcctaaaggaagcactaaataaggaaaggaaaaactgttaccagccactacagaaacacactgaagtacacagaccgatgacactatgaagcagctatatcaacaagtctgcaaaataaccagctagcatcatgatgacaggatcaaattcacacataacaatattaaccttaaatgtaaatgggctaaatgccccaattaaaagacacagaatggcaagctggatgaacagctgagacccatcagtgtgctgtgtttaagacacccatctcacgtgcaaagacacacgcaggctcaaaataaagggatacaggaaaatttaccaagcaaatggaaagcagaaaaaaagcaggcattgcaatcctagtttttaacaaaacagactttaaaccagcaaagatcaaaaaagacaaagaagggcattacataatggtaaagggttcaattcaacaagaagagctaactatcctaactatatatgcacccaatacaggagcacccagattcataaaacaagttcttagagacctacaaagagacttagactcccacacaataatgggagactttaacaccccactgccaacattagacagatcatcaagacagaatattaataaagctattcaggatctgaactcagctctggataagtggatctgacatacctataaaaatctctaaccccccaaaacagaatacacattcttctctgtgccacatggcactcactctaaaattgatcccttctaattgttttactaattggaagtaaaacactaatcagcaaatgcaaaataactaaagtcataaccgtctctcagaccacagcacaatcaaattagaactcaagattaagaaactcactcaaaaccacacaactacatggaaattgaacaatgtgctcctgaatgactcctgggtaaataatgaaattgaggcagaaatgaagaagttctttgaaaccaatgagaacgaagaaactatgtaccagaacctctgggatagagctaaagcagtgttaagaggggaatttatggtactaaaagcccacatcaaaaagctagaaagacctcaaatcgacatcctaacatcacacaactaaaagaactagagaaccacgagcaaacaaaccccaaagctagcagaagacaacaaataaccaagatcagagaggaactgaggacagacacacacacactttccaaaaaaaaaaaaaaaatcaaagaatacaggggctgagttttttttttttttttttttaaataaaataggccactagctagacttaaaaagggagaggaatcaaacagacacaatgaaaaatgataaaggggatatcaccactgatcccacagatatacaaccaaccatcagagagtactataaacacctctatgcaaataaactagaaaatctagaataaatggataaattcctggacacatacatcctcccaagactaaagcaggaagaagtagaatctgaatagatcagtaacaagttccaaaattgaggcagtaatagcctaccaaccaaaagcagcctaggaccagacatattgacagctgaattctacaagaggtacaaagacgaagtggtaccatttattctgaaactattccaaacaattgaaaaagagggactcctcgctaacttattttatgaggccagcgtcatcctgacaccaaaacctggcagaggtacaacaaaaaaagaaaacttcaggccaatactcctgatgaacatcagtgtgaaaatcctcaataaaatactggcaaaccaaatccagcagcacatcaaaaaacttacccaccatgatcaagtaggctccatcccagggatgcaaagctggttcaatatttgcaaatcggtaaataaatgtaattcatcacataaatagaaccagtgacaaaaaccacatgattatctcaatagatgcagacaacgcctttgagaaaattcaacaccccctcattgtaaaaaccctcaataaactaggtattgaaggaacataactcaaaaatattaagagccatatatgacaaacccacccagccaatgtcatactgaatgggcaaaagctggaagcattcctcttgaaaactggcacaagacaaggatgccctctctcaccactcctattcaacacagtattggaagttctgaccagggcaatcaggcaagagagagaaataaagggtactcaaataggaagagaggaagtcaaattgtctttgtttgcagataacatgatcctatatctagaaaactccatcgtctaagcctaaaagcttcttaagctgatgagcaacttcagcaaactctcgggattaaaaaaaaaatcaatgtgcaaaaatcacaagcattcctatacaccaacagacatgcagagagccaaatgatgaataaactcctattcataattgctacaaagagaataaaatacctaggaatacagctaacaaggaaaataaagaatctcttcaaggagaacgataaacctccgctcaagaaaatcagaggacacaaataaatggaaaaatattccatgctcatagataggagaaatctttattatgaaaatagccatactgcccaaagtaatttatagattcaatgctattcccattaaactaccattgacattattcacagaattagaaaaaactattttaaaatccatatggaaccaaaagagagcctgtagagccaagacaatcctaagcaaaaagaacaaagccggaggcatcatgctaccaaacttaaaactacactacaaggctactgtaactaaaacagcatggtactggtacaaaaacagacatatagactaatggaacagaatagagaactcagaaataagactgcacatctaccaccatctgatcttcgataaacctgacaaaagcaatggagaaaggattccttatttaaaaaatggtactgggggaactggctagccatatgcagaaaactgaaactggaccccttccttacacattatacaaaaattaactcaagatggattaaagacataaatataaaacataaaactataaaaaactccagaaaaaaatctcggcaataccattcaggacataggcataggcaaagatttcatgaagaaaacatcaaaagcaattgcaacaaaagcaaaaatggacacatgggatctaattaaagagctttcgcacagcaaaagaaactgtcatcagagcaaacagcctacagaatggaagaaaatgtttgcaatctatccatctaacaatggtctaatgtccagagtctacaaggaacttaaacaaatttacaagaagaaaacaaacagccccattaaaaaaatgggcaaaggacatgaacagacacttctcaaaagaagacatttatgctgccaacaaacatgaaaaaaagctcaacatcactgatcagagaaatgcaaatcaaagccacaatgagaatctcacccactcagaatggtgattaaaaagtcaagaaacaacagatgctggcaaggctgcaaagaaatagggatgcttttacatggttgatgagaatgtaaatttgttcaatcattgtgcaagagtgtggcaattcctcaaaggcctagaagcagaaataccatttgacccagcaatctcattactggttatatacccaaagaaatataagttattctactacaaagatacatgcatgtctattttctttgcagcactattcacaatagcaaagacaaggaattaaatgtccatcaataatagactggataaaaaaatcatggtacatatacaccatggaatactacacagtaataaaaaggaacacgatcatgttctttgcagggacttagatggaactggaagtcaatatcctcagcaaactaatgcaggaacagaaacccaaacaccacatgttctcacttataagtgggagctgaacattgagaacgcatggacacagggaggggaacaacatacactggggcctgtccggggattgaggggcggaagaacatcagcataaatagctaatgcacgctgggattagattaatacctaggtgatggggtgatagctgcagcaaaccactatggcacatgtttacatatgtaacaaacctgaacgtcctgtacatgcacccccgcagttaaatttaaaaaaggaaacagcacagcaatattaaagatagtactgcctgaaataccacaatttaggttttttctctgaagagccagaaaggagatacaggaagagctgaatacaagtgacaaagaatctgaacaggagaggagagatggtctcagagttgttccaaacttacttgtcctcaaagctctcctccaccaccttcctccaccgcatgtggaggccacctaaaaatcacaccactcaacacattgttttctatcaaacaggtctttacactaaatcccaaatatgttgtccatgagaggaacatctgacgttcccacgccactcacgcctcaaagcacttcacctcacctcttccagttctccaatcccctcacaaagaagctatgagtacagtatcttcatgaaagaaaggtaagagaactcaacagacgcttctgaggctacatggtccgatgttctcacgcatcaaggaaatttggtcaaaataacctttgcagaaaactcagttatgaaggaagtacgtacaggcagagtggggagggggttaagctaaaggtcgggtctgaaacacagtgttgtacactagacccatcagaaggatagatttgttcattcattaagggtctattatgtaccaagcacagcgccaggcactaggaagaaaagaggaaaaattgtcccttttaatcatgttgctattatttcaccgcccaagtaaaacaaaaatgtaaaaaactccccatttctctctaattttgacaaattttagccttcctcagccaaagattattttcctgactattggccatatttctttgttaagtcactctgtcaaaacataagttgcaataatgcggggcagcgtcgaatctgccagatcaatttagaaacaaatgagtctgctgctcttccgtggccctgggaggcgggctggcctccacgtactgtcagatcgtccacaggaagaattgctggggattactgaagaccagctgggaagcgtcaactaaaatggatggcctttgaattttccactctcccattgtctaactatagccagccgccattcccaaattaatgccacagagagagagatattctctcctaaggcaggctgcaaagataaatcggctacaaaagagcaagtagctaaaggaagaaacagaaaatgaagccttggcactctgtcatgtgaatgtcacagtatttgcaggaattcatacacggcacaaccagagacagaatagaaaagtaagcttccttcctaccccggtcctcctccatatccccccaaaacgaacccaattgtttcctgttttgtgaatgccttctgctaccccatgtcaccgtattttaaaacatcagggattcagttgctttatgtggggtaaaatgtgttaaatgtgcctgcatttctaaaccatcggctaatgagattttattaggaagagcccagaaataaattaccagaatttaccagaaagctataaaatggagggattgtgaggattaaatgagaaaatacatgtgggccttggaatgactcagggcatataggaagcttagtaaatggtagcaagatcataattattaccatagttcgatcaactgtaagacccactcaataaacagtccacaccattatgttacgtaccactaagaaaaaacactaccaattaaactgtcagcctgtgtattataaatcagatatctcagaattaatgaaatacagtatcactacatatacctctaggtttccagaagtaagtcacagtgtacgtaactagtgacaaagattctttacttggccaaactcagaggagattctttacttggccaaattcagaggagattcacgcctctgaatctcctaggtccatccgtgttgttcctcaaaatccagttttagcaaaagaaccctgcctagccggtttcgccagaacctcggtactcagaatcttcatgttcctcatccttcaccaccctcgggtgctgtctgatcaccctggcctgtcttcagcaagaatccagttaggtaagaggggcctcaaggtgactgagaagatgcatctggaacttgcttcctccacaaagaagaatcgaaacagcaggacggaatcgcaactggaaacagcaggacggaatcacaactggaacagatcatctaacagagaacagtggaattcaacatggaagtgacaggagacgcctaaggcaagaaaggagagggaagcaaggcagcctctttggctgggaccctgaagaggctccccactgtgtggagagagtaagtgagagatgcccagccgtccacattcccacatggactcctgtgatccgagccacaggagagccccttgtggtccttagactaacagagtgctgcccggggaccacgctgtggcactgctccagggagggagcttgtgctgggccccacatactgctcgagtcctaagcagctacagcacagcaccattttgagggcccagcttccaccaggcagcatcctgccctgggccccaaatagcccttgaatgtccacattcctggagccccattgatatcctccaccacagccactgctggctcctgctgctgccagggctgaagcacaagccactagcagtgaccctgtggccccagcagcaaggccaccatgcacatacaagtaccctaggacaggttaacccacctgcagccaccacctaggaccaaagcacacactcttcaggacacctggcccagttccaccagccccagtgaccaggcaagccatgcaaaggcctggggattgccctaccccgtccatccaccactgtgggcagctgagcagttcctctgcaagcctgaggatgggcctgcccgacctgccgctaccagcacatctagcatccattgcatgtgccaactgcaggcctaaggaccggactgcccagccgggtgcagccaacaccaacactggccacttgggagccaggggatcctcctgccattgctactgccattgcctatgccacgcccattgcccagacgcccaaggaccctcccacccagcacactgatgccacctaccaccagcacccaagcaagccaactggatgcccaagaactgacatgcctagacttgctaacgtggatgccagtgtacacagccttgaggccaaggacaggcacatttagcccaccaccgccaccgtggggcccaaggactggtgcgcccggggtccctgtccccagcaaaatttcactgcagcttctgctaacaaccacaccacccagagccactgaggaaattatagacaccacggatgccgatacagccaaaaaagaaaaagaaaaaaaatcatatggagactacactaccgtgcgcacccagaaccaaaaccaaagtacccaaccaaggccggatgcggtggctcacgcctgtaatcccagcactttgggaggccaaggcggtggatcacttgaggtcaggagttcaagaccagcctggccaacatggtgaaaccctgtcttcactaaaaatacaaaaattagccaggcgtggtggcacacacctgtagtcccagatacttgagaggctgaggtggaagaatctcttgaacctgggaggcacaggttgcagtgagccaagattgtaccactggactccagcctgggcaacagagtgagaccctgtctccaaaaaaaagaaacccaccccccccacccccacccaaccaaccaagaaacaacaaattaaaaaacacagtgcccaacccaaacaccactatagacctatcttcaggaaaaatcctcccctgtgaatgcaaatttaaaaaactggaaggagcacaagtcactgtctgtggaagagaaagcgaaaaataaataaaacaatttaaaaatggataataaataaatggaagaagcaattgttagaccaggagtgcagacatcaatttaaggacacaagaaacatgacaaaagcaaggacatatgactaagaaatacattaattctccagcaacaggttccaaagaaaaagaaatttaaaacatttttattaagtagtaaaagaagcctgacctaatactgttaggtgaggttagccagaatcccccttacctggatatttcctcttggtaattttccatctaccgacccccacactgccccttggctaccaattcccacgtgcccacaatgtatttggagctgagcctaatctttctcccccagtgcaagacctggttgcagtggtccctgtacctatcgccatggtcctgtgctttaacaaacaggactgagtatttttttctgtaacagcaggatctgagtacaggttgttggtgtcaccacagccacactaggccctgaacgtctgaccaccccctgttcttggagcctcagtcactacacagattggctcgctctggccttcttgactcttaacattgcccagaaggattcaccaccactttcagcgtcatagttctttgctttcaccattccgagtcggtcgtcatagaatatgctatcatatgtcactcaaaatccaaaatatgcctccgatataaagttacactgcttatgccaagtcagtggtcttgccaaatgtggccatactctggaggtgactttgtgcacatatgttcccagtattttctatccatgctcagttaagcagtgccatttcccttggcacagagtttaaattagttatttgcaaacgtaaattcacatttctttttcacctatcacaccgctctctctaaataacagagtaaaaacacttacgcagataatttgggtagggaaactggggatggatttcacagtcattcatcattagcctgacaagtctttgagttagggattgaacactccggcatattagttggctatttgttattgagagcaccagctctcaagatcacaggacatataaggtaagtgatgaaggatacacaatggcatttagagaaactacacaagaactgaagaaaaacaaggaggcacattgtttctgcatcactcttattacctgcaaaccaggggatggataatttaaaataccagcggagtccacggcagccgacagcctgttaccttccttggttacagaaagatgcgggggtgaattacccactccatggctgctttaccgcgatgcacagtacacgtcagatctcttgaaaatactcgtcgtggctcactttgggaggctgaggcgggtggatcacgaggtcaggagatcgagaccatcctggctaacacggtgaaaccccatctctactaaaaatacaaaaaattagctgggcgaggtggtgcacgcctgtagtcccagctactcgggaggctgaggcaggagaatggcgtgaacccgggaggcagagcttgcagtgagccgagatcgcgcccctgcactccagcctgggtgacagagcgaggctctctctcaaaaaaaaaaaaaaacaattgccatgatatagtcaattcctacctcctacgagtctgactgtgctgcttgtgatctgaccaggagaactctccacttttcccctgtgttgtcctttttcataatccctgcttagtaatcacttccaccaagaagaaacgtctcaactttctcatgtgtgagattcaaccagtcaccctactcttcattattacaaacaaaaggtcaagttctccttttcttgagttatatacagatttaattagttatttctaataaaaaataaaattccacatgatcctttctttccctctagctttattttgcacaaatgctctcatttcccccctacatctaaatgcaaaacagaatatattcactaaaggaatcagggtttgatgattacagcaaacaactgcatttgcatatgtgaggtttccaactttgaattcaaagacaataaatagcaaaatgatttagattagaatttgccgtttctggaaaaaaaatgttatcaatgacaggaaaagaaatgttggtgtcaaagaaaataaaacagaaatacctgtaaataaagatgagtatctatcaattataccatgataaagctgggtgggagggagattattactgtaaaacttgtttgaaggggaaaaaattaaccaaagcattatcaataaacgactaaaaagctgaaacgtaaggatcactttgggaaatgaagcaaaatcaaacaccaggaaacaaggcatgaaaagaaaaggattaagggaacagatgagttgatgacaaaaaagttacaaagaccaggaggaaaaagaaatatgagaattaccgattgtaataaagaaaaagaaaaagactgacaagcataggaaaaaaaatgacgtttttatggctgcttgatgatagttcagtccattgtcaacctaactagaatcaatcagaaagccgatcctcagaagcaaatgagtgaagaggcctctgggtaaaggctgagagtactggttgatgggcatcactgttaccactgttctcacctaacttgagaagattgtgatactagctccccaaatgctcctgttaatggcatgtaccctactcttagcaggtctcacattctgtgcaaaaacactgaaagtcaacataatatgttttgtagtgtaatggagacagatcaggtttttactaagctaaaaggagatacagccttggctacgcactcgagcagaacgctgtgaaaacgcatactaaaatgatgagcctgaactccccacataccctcaagtgcatacagggttgtgtctctgcaaaagcctctacccattgaggtttccttgtgcaggggatagtctgtatctagatgctatatcaaggtgaagatcaagtatctttagttttcataaaatactagattccaaacagaaaggtaattatcagacagagtaggtggcaattagaggctgagcaggaggctctaagaatctaaaaggaatttggtcggcatgtgatcatgaaatccccaaaacattccagaaagtgataaaaataaacacctttgggtaaagtgttatttccccaaagaggaattgaagctagttagatctctttggtcataatatatattatcagtatatctggagaaagaaacaaagcaagattaccttttcttcttcttcttccatagtttaaatttgctacattgggaaacttcactgcacattaatatatcaactccaactagaccaaaatctttcaattaactaaaaacattttttaggatgtaactctgaaaaaaataaaaagtgagaaaaagcaaacataaagtaaactggcttaaaagtagggttcagtttgttttgttttgtttttgagacagagtctcgctctgtcacccaggctggagtgcagtggtgtgatctcggctcactgcaagctccgcctcctgggttcaagcaattctctgcctcagcatcctgagtagctgggattataggcgcctgacaccacgtctggctaattttttgtatttttagtacagacagggtttcaccatcttggccaggctgatcttgaactcctgacctcatgatacaccagccttgtcctcccaaagtgccgggatcacaggcatgagccaccgtgcctggccaagtagggttcagtttttaaaaataaacagcagcaacaacaaaaaccccacatgtactttcaaaagtatgttctgtgattactcttgtgcctggttcttcaaacaaacacaggacttttcacaaatgaagcctgcatgttcaatgctgaataagattaaaacgtgtttagctcattgtacctacagaaacacaacagaacttcagcaagattttcaacaatgattattttaattttaaaaaggattttgtgtaactttgtttaaatctgataatcctctttacttcaaaaaattaaagaagaaagtgaaagtaatacttggaagcaaaatgaaactaacacgaagtgtatcaggtacttttccacattaactcactgatgtaattaaattacaaatgctcagcgtcctaaggggtcaacactgtaattaggaaaagtgtatttctccttagtccttataccatttgccctggtataaatgcttgtagtaaacattgttactctttctcagacaagcgttttaaagatgctagttaaaatgtagttggtagctagtttcctgagtcaatatggcaattataccaataaaattgcagatcaagatgagccagaggcagtaaggaacaggccaaagaaaaacaggaagaaaaggggacgataaagaaagtggtaggccaggtgtggtggctcacacacctgtaatcttagcactttgggagactgaggcgggcagattacttgagcctagatgtttgagaccagcctgggcaacatggtgaaaccctgtctctacagaaaatgctaaaacattagccgagcatgctggcaggcaccagcagtcacagctactcaggaagctgaggtggaaggctcgcttgagcccccaggaagcaggggttgcagtgagccaatatagcaccactgcagccactgtccagccttggtgacacagcaagactgtcgcaaattaaattttaaaacagtggtagtttattccaaattcatgtgctaatcaaatcatatctctgtgccactctcacattcagccctttcttcccgtttccactgcaggtatttgtctcctgtattcattatctcttacttgcaactttccaagtcaatctctctggtccctgtctttttccaaaccattctttaaattgtcatcagataaatcttttttaaaaacagatttgattttacaaaagagaaacaggagatctacccagtagttgcagaataaagacaaaattctctcgtgtgacatcaaacgccccctataatctactcccatcctgtgtttccctgcacccaacacgtatttcagttatcctggcttctctgtcattcccaagtcaggttgtgggcccatgtggtgttttgtttttgtttttgtttgagtctcgctctgtcgcccaggctggactgcagtggcgcgatctcagctcactgcaagttccgcctcccgggttcacgccattctcctgcctcagcctcctgagtagctgggactacaggtgcccgccgccatacctggctaatttttttttgtattttttagtagagacggggtttcaccgcattagccaggatggtctcgatctcctgccttggcgtcccagagtgctgggattaccggcatgagccaccgcgcctggccgcccatgtggttttatgtcttttctttttttttggcatatgattgccaggtcatagcttttatatctttattcatagtttcctcttttaaaaatatctttttcactactgcgatcgctcataattttattcatcctttaggatccggcttaaatgtcacctccttcaagaaactttcctacatccaaatagatttacctgatacctgagtatagatagtacagtatattgttataattgttctattttagtattattgttgttaatctactgtgcctaagttataaattaaactttattgtaagtatgtatacataagaaaaaacagtatacatgaggttcagtactatccatggtgtcaggcaccctctggggtactggaatgtatcccccatggataaggaggcactaagcaacatattgtatgtttagctttgcatacttttggctacttacagatggaatcatactgcattgatgattttgcaatttgttttgggttttttttttttttggctcaacattatatcctaagattcatttatgttgatgcatgttgctatagtttatagctgacagacctcttgatgtgtcttctaggaggcgcttatgaagagaatttccataggaacactgtttgtaaatgcaaaaaattacaaatgaccctatgttcattactaggttatacaaatagataacattattttctattttttcatttttcagagatggggtctcattttgttgcccaggctggtctcaaactcctgggatcaagcaatcctcctgcctgggcctcccaaagtgttgggattataggcgtgagccacagtattcagcctcttggtattttctatactagcacctactaatgtatatggcacatagtatactctctacaataaatgctttttaagataaacgaatttgagaagaaaagttatgtctgattcattgtggcttcctcatccatagaggccagcacatgctcagatgctcagtcaagatctgatattcagccacaaaaggctagcagtggacaggcaggaaataatctgagctgacacaagtgagggagcaaaacaggacgtgtgacgtgttgggtgcctacccctagcgaggcaggcagagcattattttttatgaggttaattccacctgcttacttttgagtcctacaaaccactgtagttcacaagaattcctttcttctcttgtgactctctgtctccccagcctcagctaattccctctccctgtctttgtctccctccttctacttctcctcctcctcctgtactactcccctactcccctgggtatgagcctgcttcggtactctgggaagggtttagtgatggtggtaaaaactgacttcttgatttccttccttgcctgccagcgaagtcatcttccagcaacttcttccattctgttggagcaatgatttgtctctcactatgccatcctttggtttgaacattgcatacccatcttaaggcagttgatccaccctgcttattgcctttttggcatattggatgccagctcttgagcagaaccaaacccctggaaaactgatcaccatctcaacatcttattaaactaattctcattttgctaaactagaaacgaatcatcaggctaacactgccagtgaagatgcaatgtaagacaaattataccaaaccaccaataggcatgtattcatctgcagcaccagccaactactctcaaaagaactgatacagaaaatgatgaaaaggaattaaatccaaaagtaaagagacgactgccaactacagataagattttccatgaaattgagtattattcggttcatctcactctgacttcattttattacagtttagacctgactagctaaaaaaagaaagaccatcgctttgacacacaatagaagtaaaaataaagctgacatgtcaccctttccttcattcctgttttcaatattcaatcttccccctttccctttcccatcacctactacactcacttccactgtaacatttctttctcctctcttagaaaagatccttagaggaaattaaaatgtggccagtccttactctttaacgtcaacgtttctctcagcatgcacttctctaacttgagctatcatttcactaaaataactcaactctttcttttctgaatcttccctagcgttgctgtatttcttacacccgcttggattcatgcccactcgctgctcaggatatattgtgtctatacttgagtaggcacaaaatgctttttcaaacaaaacgtatctgtcatatcagtactgtttcctccatatacgtcaaccaaattaaatagcttccctgaccttttgtctactttctttgccttctgagtatcctcatcatctaactcttggcctggtaaaacaggatatgtggaaaagtcataacttaccttcctcattattttctctatcaagccataaaaagtaataagggaaacctttactttgggcttaccttcactccaaaatgtagaattgtgtggttaggtttaaaaaatgacagaattcttgcaagaaaatgttaatctaatgttagaactcctagcagacaaggtagggacgctgaatgtaattattcagagactttgagaaaaaaaaagcgggggggagaaacaagcgggttttctatctgcaatgagcccagcactttatgaggtgcctgtctagattctttttttaccacgaaagttgggagaagctactatcaccctcatttcacaaacgaggcttctaaggctcaaagaggcttaagtggtgccagatattgaatccaggtttttctgatcctcatgttccaaagcaggacaagttaaatctgaaagcatcttaagaggaatgagctataaaataacattctgacaatacaatcatacacgatgcagactgcttatccatgaaggcccttcacaatctggcctctgcatcctttcctcacccttcctctcatcaccggccacaaatctccctttttccagccctacagaacaccatacaccattttctaaagtgctgtgctgatgaatgtactttccacaggctctttcattcgtgtgactgccctttctcttgcttcatctatctcctactccaaaacttagctcaagggttgcctccttcaggaagcttttcctcattctccagtctgatttaggttctcctcctccgtagcaaagtacatacccctaacaataccacttaccccactgaaccatcattgctgatttacttgtctgtttcttttactactagggttattcctagaaagaagaagctacattttatcctactttgtatctctttcatatagtacagtgactgacacatcataggtgctccagaccccaaatagaagaactgggacagaaatcaaagggtagtatatctgggatcaccaccctgggggagtgggctatctcatgaaccagtatttaagcagaggctagataataactttcaggagcattaagaactcttttttgttgttgtttggtttttttgaaacagagtttcattccgtctcccaggctggagtttggtggcatgatctcagctcacttcaacctccgcctcccaggttcaagcgattttcacgtctcagcctcccaagtagttgggattataggcgtgtgccaccatgtccagctaattttttgggttttgtttttgtttttttaaggagagatggagtttctcaaaaaacaaacaaacaaacaaacaaaaaacaaacaaacaaactctggccaggttggtctcaaactcctggccttaagtgattgacctgcctcagcctcccaaagggctgggattacaggcatgagccaccatgcccggccaagagctctttacactaagtgaggagcagtgttaggcaagccaagacatccatgcttgctctgttattctacggctcccgacagctccagatcaaagttttctgatgaagatgggccaacatctcagaagacaggatggcacaacagtaacacaactatcatagttagaaaacctgggttctggctctgacttggttgtgtgatttttggtagacagtcccaaaagtcttgggtgatttcatctcagtttccctatttataaaacaaagggtgaaaggtaagctagggggagctgaccaactagatggtctgttaaacgccttccagtgctaagagaattgccttattttcccattgctcactgtgttctcttgtgaccacctgaaggtctctgccagctcatcttataccagtgctgtcttccctgtttgatggctcatttctctaaataaagcataacattcacagaacaaaatgagtaaaatctctgtttttttagttcactggacaacatcacttttcttttttcatttttgagacagggtcttgctctgttgcccaggctgtagtatggtagtgccgtcacagctcactgtggcctggacctcccaggctcaagtgattttcctacctcagcctcctgagtagctgagactgcaggtgtgtgccaccatgcccggctaactttttccattttctgtagagacaaggtttcatcatgttgcccaagctgctctcaaactcgtgactcaaatgatccaccagcctcagcctcccaaagtgctgggattacaggtgtgagccacatgtgctcggccacatatctttttattttaaaatattaataaaacaaaattatgcaggtaaactctgagtccaaagggaaattggcattgacttacaaaatttaatcagatacttagaattcactgagttaacacgtgcatacttgaccttgcttgatgcaaagatctgtgatatgtaatcatttgctacttcactgaagatgtttgaatcctccttgttgtaaggttgactccacaggaaaagactgattcacatggctttgttatcattggctttctgttatgaaagcagacaatttaggtcaagggacaacaatctatttttctgcctgaaaatgaccccgacatgaaaaccaactgatagattggttcatttctattaccagcactaaagaatgggcatagggctgggcacagtggctcacacctgtaatcccagcacttagaaggccgaggccagcctgggtaacatgggaaaacccccatctctacgaaaaaaagacacaaaaattagtcaggtgtggtagtgtgtgcctatagtcccagctactgaggaggctgaggtgggaggatcacttgagcctgggaggtggaggttgcagtgagctgagaccatgccactgcactccagcctgggtgacagaaaccagactctgtctctaaataaataaataaataaataaatggcataaattagccttataaattactttaatcctgaatttatagaatcgttacacatctagaggaattacttaactttttcagatatactttgcatttttcacagagagaaaaataattacataggcattttcacatttggaagttcataactccctcgggacctattccacaggaaggccgaaggccaaaggtctcttgtatattatctagctccttaaaatggcaacatttaaaaaaaaatctaacctccttctcccccaaatcaattcagtttgttgaaattcttccatatgccttaaaactaccaagggaaggcagagtcagacaaggtttaaatgtttgtaggcatctgagaaagaattgaaaacaatcagagtagagatggtggtctactctgcattctcccttgggcgctaccacaaaggcacttctctgtacccatcagcagagccgcacatgctctctcttctcatagaaacagggtcaaccctcatttctaggaacataattttcaaccacaaagttcccttccattttttactttcctgacatcagtctgctaagtgaagatatctcggtaagaactccaattttaaggggaatgaatctttacagaatgtactttatcttgtcagcactttgaatctaaatttccttctcaccctttcaccctaaaatatcagcttgcatcaggcacaaaggaagatgcacagctgcaagtgctcaagatgactaaggaaggaaaagcagacaagtcactaattactctccaaactggaggcctaaatcatccttctcttctacctgttgtttctggaatagtttatgtcagtaatggaaaatttaaacactgtcatataattccattttttttccccactccagctcttaaaaacatcctagatgttaagatgtgtagcctaggacagtggttttcacacagtgctctaaggaacctttagagccagacacacagaggaggtatcaataggaggggtctgatgccccttcgacacatgttactataattaacatgtattttgagactgagaatgtaggctccatgaaagccgggattcctgtttcctcacagccatcacctcgtccttttaacagggcccagaatacagtaagctgccggataaaagttttttgactgaataaactgcacggttattacagctgggaactgatttcgctgatttccacggtaaccctgtgaggcacgtatagtagttatcctcactttgcagatgggcaaactgaggctcagagcagcctggcttccaagaccctccttctaaacatcataccacatgacacagcctcccacgtgagccagcagctgtatttcatctgttttacatgtgaggtttcccaccatttgactggagaaaggtcgatgttaggggagaaaaaaccatttaaaaaccaccaacttcatggtgaaatccaaaggctgcaagtaatcaatctcactccttgctctgtttttcctgccacccttgggacttgacgcaagtggcttaactgctcattgtttcaggttcctcatcttattttacaacctatcttgcaagatgagtatacatgaaatattagaggatcctgatgttgtcagaagtgtagttttgcggatgttgatcccagaattgtgaaacaaggacacggttgagatgatcgctaaactctgcctgaagttcaacgcctctgtcattgaagaccttgcacagtgccgtccacatggttattttattcctccatgtccttaccaactaaacaagccatatgattttaggtttcgtggccagacagcctggctaagctcctatcaacatgtcagccagatgaggtgaagagatggagaaacaaacctgcatgtgggttgcgtcgaacaataaagagaaaacagagaccaaaaatcttgtgccaaggtttgacctcaacaaccgcaaaaccaatcattgctgtgttgtttcactatgtttctagaaacatccatagaggagaaaccaaagtcggcctgaatacatgttaatagctttcacgggcttacttctgatattttaaacaggcaacaaaaaagaaaaaccaagtttcagatcttgccagaaattggggtttcacttaactgtaaaacagtcaaggggagtttatcaggtaagacacgaagcctttctttataagctcttataagactagagaccactggattgccgtgcagttactgccgctggcattattttcttagcacactaagaaaaataaaaatgttcaaagtcctgtttttaaaaacaggatgagacttctggcttctgatctggtatgtaagaagcttagaagtcaccattccatcctaacaacaagtaaaaagctaaacaaactaaaaaatcaaccattcttcttacacatttgagatgctagatatattagcttaatttaattattccacattgtattaaaaactcacaataccactttgcatcttataaatatacacaactataatttctcaatatacagtgttaaaaaaaaattcttagatctgccaaagaaataaggtcacagggcaagctgctgcccccaagactagagagacagaggggcgcatacagagcattgcaacttactacaacagaaacctccatggaaatcagtacccggtagaaacctcaattgtactcgacatactgctgggggtctagaatgaacaactcttcgagtttaaaactccagaggtgcccatcatggggagtagggagggataagcttttgtgagtttttttttttccaggagctctagcagggcctcgcagtgagtatcagagaaaaattcccttatgcttccagtggaaaaaggaggaaaaggaccattttgaaaaaacaccagagatcagcaccataggaaaaggaaaaaagaaaaagaaaaaaacaccagagaattatgttcttaacaaggttttgccctccagagaaactaaccagaccctaacttgctggggctttggcagagcctaacctacctggggaaggaaaatacccaactccagtccactctagtcatcctgtcccacaagaaaacaaacaaacaaactgagaagcactgagtgaagctcacagtccagggtcatgggctcactagaagactgagacccactcacaggactacaggagaacaattccattctgagttagtccactttgcatttgctataaagacgtaaccaatgctggctaattttcaaagaaaagagatttatttggctcacggctctgcaggccatacatgaagcagagtgtaggcgtctgcttctgatgagggcctcaggaagttcaccatcatggcagaaggcaaagaggggccagcatgtcacatggtgatggagggagcaagaaaagggaaggagagccagactcttaacaaccagctcttgtgtgaactaacagagcaagaacctgctcatcaccaaggggaaggcaccacgccatgcatgaggggtccacccccatgatccaaaacctcccaccaggccccacctccaacactgggggtcatatttcaacataagcttcggaggggacaaaacatccaaacagtatcactccccagtgatttaccaccacatcactaaagacccattcacaattctttttacccagtacatcatgacatccgtctttcagcaaaaacttaccagacatactaaaaggcaaaaaacacagtgtgaaaagattgaacaagcatcagaatcatagtcagatacagcagaaatattggaatcattcgacaagaaaatttttgaaaatgatgaataagctaaaggctttaatgaaaaaaggacatgaaagaacagataagtataagcagatgaaaattctaagaaagcaaaagtaatgctagagatcaaaatcattttaacagacttgaataatccttttgaccaacttattaggagactgaacacaactgaggaaaaatctcagcttgaggatacgacaacagaaacttctgaaatgaaaaagcaaagagaacaaagattgtaaaaaaaaaaaaagaatatccaagaactgtaggacaactatgaaagatgtaacatacatataatgggaatattagaaagagaataaagagggaaaggaacagaagaaataatattcaaaacaataatgactgagaaattccccaaattaatgtcaaacaccaaaccacagatccatgaagcttagagaacactaagcaggatgccaggaaaactacctctgggcatatcatatttacaactaagaaaatcaaagataaagaaaaaaaatatttaaaaaaataccccagagggaagaagaacatacttcagtggaggtaaaagaaaaacttttgttttcttattcttaattgatcaacacacaatatctttttcaaaataatagcaacaatgtactcaattacgtatgcatatatatgcttatgtataagtgaaatgaatgacagtgatgattccaaagatgggagggaagaattgggaatattttgttattataagatatttgcactactgataaagcagtttcatgttattcgaaaatggacttggattagtagtaagtgtatattgcaaactctacggcaaccattttaaaaagtaaaaagaagtataattaatatgctaataaaggagagaaaacagtatcatataaaatccagctttattcataatttccaaaacttggaagcaaccaagatgtccttcagtaggtgaacaggtaaactgtggtacatctagacaacagattattcatcactaaacagagattagtcatcaagccatcaaaggacatggtagaaccttaaatgcatattactaagtgtaagaagccaatctgaaacactttatacggtatgatttcaactgtatgacattatggaaaaggcgaaagtatgaagatagtaaaaagatcaatggtggccagagatgagaggggagggagagatgaacaggtggaacatgaaagattttgggggcagtgaaaaaagtctgtatgacgctctaacagtgaagacatgccattctacatttgtgcaaactcacaggatgcacaacaccaagggtgagccctaatgtcaactcgggagtctgggagataatgtgtcaatgtaggttcatcgactttagcaaatgtaccaatctggtttgggatgtttatgatgatgggagataggggtggggcagggaatggccaagggttatatgggaaacctctatgctcaattctgctgtgaacataaaacggttctcaaataaaaagtttattaattttttaaaggatttttacacaactaagccttgataaacatttaccttctttcttcttcatcataattatttttccgcattattttgctattttccttctctccttctctctctctctttcttttagagacagggtctcactctgttgcccagcctgaagtacagtggtgccatcacagccaactgtaacctcgaattcctaggctcaagcaattctcctacctcagcctccccactagaactacagacgcctgccactatgcctggctaatgtttcagtttcttcgtagagatgaggtctcattatgtttcccaggctggtcttgaactcctggcctcaagaactcctcccaccttggcctcacaaagggccgggattacaggcgcacatcacgatgccagacccaattttgctattttctagcataacatggtatgcacacattaaattaaatgtgaaaaacaaaggcaaaaagaaaaataaatcaacaaaagttctccaatcatgactaaaatcatggactatttccttctaatcttttctacaggctgatttttaaaaacattacttaattcatggagaatatcaaccagagtgctcaagatctggcccttgggaagacaggctttcagatcatctcgagtccttatttcctttctacccccaacctctgctgtgcctggtgctcagggcccctctccagaaaccgtcactctgaagatgagcaggcacattcaaggctgtagggagtacaggggaggatctgatgcagtctttcaaatactccttttcttttaaggtccccatatgaacctatcccccctcaggacctcacttcattaatttctgagcctttctgagcaggaaatatgcttgcttctcatcgatatccaccactgtaggcactcagatcccacctagctccccactgttaattcagtcatcagaactccaactgctttttgtcttcattattgatcaatgtgttataatgacttttgattccatcaaaagtagaatttgtttttccattcctcattctccttgccattctatggtgatggatgatttctgagagaagaaagaggtagaaatctctctattccatcacaattcttattcttacatggtattgtaataccatattatctttattaatctggctttataatatatttcactgtctggcaggaacatggtcatttcaaatttgactgaatgtttcaaaaaagtattttctatttgtctttaaagttatgggcaacttaccagataagttgaaaagaagttcaatatcctaaattcaaaatcctaaattttcacatgtagaccttcctatcaactcagacaatgccaggcacaaacctatgatcagtaactgctgagtgattgtgaacaagccatccaagaaaagtcaaatgcataggggcatttgtggaagtgtggagttgtctctgaaaagctgttgcactgtgaacttgtttcagcctgagaggcaagaaaggctggcctgtgattacttccggtgtctacctagtgtgaaatgtgttgagtcaatgaagcatctggaacagacttagttcaactggaaggttcatgactgggatgcttcctggagccctcagaccagagggcagacataacccaagaattgcttcttattaaaggaacagagacaaaaacctaaacagagggataacggcagagcattaaatgcagataattccatttgcgactaatttacccaaataaaatagcagaaagcagctttcagtggaataatttaaggcaacaggcaggagagtggcgtgaactattattttcatatttccattgcttacttgtcacttccagtgaatatttaacttttgagcatccactttgtggcttaaggatgttcctaacttccccaaactttgcatccttgaccagtacactacaatatttattcacaaccctgggaaatacctatgggaaagttactgttccctgaacgaaatacatgaaaatccagatttctctactcgctgacagtttatatagataatgctacttccccctcaatttatctctactctgtttcaatctacacactgctgtcagaacagcgttagaccacagatctgagcactttaatccccccctcaaaaatggcccccctctgctcaccagctccatgctgaggctctcacgtccttctcatgatataacccccatctactgagacactcagttctcctcaaatgaatctattctccattccctgactaagctgcagcgttctcacctcagtgcctttgcctaggctgtgtcttccatctgaaatgccctttaccagactactggaatgacaactctccttcaaggcccaagtgcctcctatattaaaacaataatggttagaactttccatttcaacaaaatgatgcagaattcaccttatattgaaaaaggcaggtagtgaaggaaattcagtgtacgagtaacaatgcacctcatgtaaaccactgtgaggtaaagaaaaggcaaggactttaaagccagatattcatggatttagctccctggtctggcatctttgaatcttgtgactcggggcaagttactcaagtcttctggaactgagttttctcctctatacaatggacacaatggtacctgtgttgcaagtgtggactgtagacacaaaccacgcgtttcccatattccatttaataattctgtgctgccctcgtctttcccgcgttgtaaatttcagccttctcaggtctgtgtctttctcctgtgccgttcatcagtggaggcttagttcccagtgctggtggaagatgcctccgtacactgttaaggaggcaatgctttctcttcctatcattgataatattctgcatcatagggctatgagacctccaggcttcagagattaccactgtgtcctgtggaggcaacctctaaaaagtatgtaattctgattttcttagttaataatgtgtcactctggtaacactatttaaatgggtctctattttctcaaaacgtaagtacttctgagttctctttgttaagccagaaggggaggcaaaagaaaataactttgctagctttcttatttaaattgagagcctgggatcaatgaaaatcaacacgggtttgctgtgagaatgaaccacaataattaatgactcttcagtggctagaacataaaagatagctagtgttagtgagaccatcagcaacaatacaactgcacaacttctactaacaataatgacatggacactgttctgccagaccttccagtccacaggcctttgaggccttagccaagacttttctctactggaggggtaaaaaccactaagcaaagcctcgcttgtctgagtcagctgagtctcatagccagggtatttgtctgaccctgttttcagtgctgaatttgccatcctgttgtaaatcagtcagcacaaactcagaaacatacccgttcatttacttaacagcacacaatccttcaaagggcaaagtggtttgaggaaatccaaactaaccaaggggggaaaggccaggaacacggattcctctgctgaagataaatggtagctatcaaatctgcacacaaatccctgaataaataccaacagcattccttcgtgttgttttgaaattcaaactacattaggaaaagagaaaggtgccttactttttgacataccactaagtcttcactccatcagaatgctattagcattagtggcagattttattacctctctaagtgtgtataaaaaccaagtgtctctaaaaagtattatttttgttgacatttatcataaagactattaaaacaacatataaaaatgtcaatgttgactttcttcagagaaatagaaagaactacttaaatttcatatggagcccaaaaagagcccatatagctaagacaatcctaagcaaaaagaacaaagctggaggcatcatgctacctgacttcaaactgtactacaaggctacagcagccaaaacagcatggtactggtaccaaaacagacgtatagacgaatggaacagaacagaggcctcaggaataataccacacatctacaaccatctgatctttgacaaacctgacaaaaacaagcaatggggaaagaattccctatttaataaatggtgttggaaaactggctagccacatgtagaaaggggaaactggatcccttccttacaccttatacaaaaattaattcaagatggattaaagacttcaatgttaggcctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaagtatcagaggaaacaggcaacctacagaatgggagaaaaattttgccatctatccatatgacaaagggctaatatccagaatctacaaggaacttaaatttacaagaaaaaaaacaaccccatcagaaagtgagtgaaggatatgaacagacacttctcaaaagaagacacttatgtggccaaaaattatgaaaaaagctcatcatcactggtcagagaaaagcaaatcaaaaccacagtgagataccatctcacaccagttagaatggtgatcattaaaaagtagggaaacaacaggtgctggagaggatgtggaaaaataggaacacttttacactactggtgggagtgtaaattagttcaaccattgtggaagacagtgtggtgattcctcaaggatctagaactagaattaccatttgacccagtgatcccattactgggtatatacccaaaggcttataaatcattctactataaagacacatgcacacatatgtttattgcggcactattcacaatagcaaagacttgcaaccaatctaaatgtccattagtgatagactagatacagaaaatgtggcacatatacaccacagaatactatgcagccataaaaaaggataagttcgtgtcctttgcagggacatggatgaagctggaaaccatcattctcagtaaactaacataggaaaagaaaaccaaacaccacatgttctcactcttaagtgggagttgcacaatgagaacacgtggacacagggagtggaacatcacacaccaaggcctgtctggaggtggggctaggggagagatagcattagaagaaatacctaatgtagatgacgggttgatgggtgcagcaaaccaccatggcacgtgtatacctatgtaacaaagctgcactgttctgcacacatatcccagaacttaaagtataattaaaaaaaaaaatcaatgtgtcatttgagtagctcattgcacccaaactggctattgcacaatttcagtttatacaatctattaagagaacgcacacgctctcgtctggttagaacgcattcttcttcctgagggaaaacctgagcttaggttgttctctctgaaacatccccactaacggggatgtcccttgaaggccgcagggactctaccttttatctctaaatctctggagcctaccttggtgcctggtacatagcagtcactcaattcatggttggtgggtttatttttttaaaaatagcagctgtcatttaaccagatgctgctttgtgggaggccctttgcttacatgatcactaacacttaaaacaactctgtgaaggaggctaacaaatcctgccttacagttgaggaatctcagatttaggaagattaagaaacttgtccacagctacatacctggtcagtgagtaaaagattcaaactccaaagcccagctttgcagagtctgaagcaaacactacgctgtacagagtctagtcacctatagtcactgctgatcttgccatgtctcgggcaccactgatgcctcactataactgaaccaagtgggaagggggcactgatctgaatgtattctgacaacagaccatgccctaggatgtaagtccctggtacaagactgttttcattattcttactcctgtctcctaaaagcaggcaagaaaaccagtttttgatagattagaattgcactctattttcattcggataccaagtcctgagacaccttagctggctaggtaagtctggtggtgggagacctgctcctgaagccataagcaagttaacatatgtgaatttcctctgtaaactccacatggctctatgacaacaacacagtgttcaatggtatcacggtggtgaaaagagcacagatttttaaatcagatataacagaattagaatctgcacctcccccttacaacctcatcatctagggcaagttgagttaattaacctctcaaatttctaattcatcatctggaaagtgtacagaataatctgcacattgcaggatgtggtgaatattgctaggtgttcaccaacatctgttctcccttgctcccagggcacaggcctgaactacgtttcccagttcctcccccaacccctggaatcaggcacagctacgtgactaagttcgctccaactgagtggaagtgaaagagttgggaactgcttctggagctaagccttgagactgtgggctggccctgctgggctcctttttccacttcttgtgaaggcctgaggggcggtggagcaacaccatggaaagaatccgggccctgaataacagcatggagtggagtcacccacccacctggtacatacattacacaatcagtgaaaaagaaataaatgtctatctcctttgaagctactcaattatcattatgtccctttgttacgagaacctggccttacctttgccaacagtgtttttcccacctattataatgcctggcacaaattgggtactcaataaataaatgatgtcattgctgctgctgttaccactactgccacacctaccatgcaaagcagttcccttcttacacacattgaaggttccacggccacagacacaaactgctgcccttagctacagaaaggaaagttaatgaaatgaagatggctctggaggaaaacaaaatcaaaactttcaactctagaagaaatagcttaaagcacatgccctattgaaggacaaacacttagctaaaacagccatcatcattgttgcttttgttaggtattatgtttttgaggttatagcaggaaagcttatagacacagcacaagaaggaaatttaggaaggcatataatcggggtgtccatgttatacacagggtgttcacccaatctgcaaatgtttattaaactattcaccaaatatttgtgaaaccaacgaggtaccaggtatttgctaaatggaggtacagataatagcctcaccctcaactttcacaggagttttatcacaaaaaaaatcaaatgaaaataagtagcttattgtgtacatgtgacaagggaaaaaggagaggaacaaaacctacccatgttgtgaggctgcacgagagagcaaacataccaaagaatcttgctttattttctcagcgaaaagagttctagtgcacccatcagttgctcttgtaaccagacactgtccaaggagcatcagaccatcccaactcaagaacaaatgtcccagttagccatggctaaagaacacttcccttaataacgtcttttgatcggcacgaggaaatctacctatatgagtacttttttggggggttcagtgagtcactcacagacctatttctcaccaagtcattcggaaacgtaaatgtccagaaaaataaattttaaatatgataggacttcctggatgttaaattcaatttcagagtattttctcatatgagagtcattttgtaaaatagacttttgcattttaacaaaatcatcatcattaatacctatgcttataggtctaaacagtttcaatcaagtcacaaactaaatcaggctgcccttcctccagaccctgacttgctaacagatgccactatctgttcaggcaccctcctttcctcttcccacctctctcaaagccactcccactgtgagtatcctcactctgacacttgtgtactggaagatgatttttcaatgagaaaaaatctctctttaaatgacatttttcaaatttaatatgactaagttctgcccccaaacctactccttagatgggaagattcattcccatctgagagatgacagtatttatttttctctaatacatgagcagtattataaaaccttcccccatttctccccaatccatgtcatccagtctatcagagtcatgacaattctgaccccagaatgtatcttgaatctatttcatttttcccatctcctacatctcctatgccaacctcctaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcccagggaaagccatcgtctccggcccagggaaagccatcgtctccggcccagggaaagccatcatctctagcctagggaaagccatcgtctgtagcctagggaaagccatcgtctccggcccagggaaagccatcgtctccggcctagggaaagccatcgtctctagcctagggaaagccatcgtctctagcctagggaaagccatcgtctctagcctagggaaagccatcgtctccggcccagggaaagccatcgtctctagcccagggaaagccatcgtctccggcccagggaaagccatcgtctccggcccagggaaagccatcgtctccggcccagggaaagccatcgtctccggcccagggaaagccatcgtctctagcccagggaaagccatcgtctccggcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcctagggaaagccatcgtctccggcccagggaaagccatcgtctccggcccagggaaagccatcgtctccggcccagggaaagccatcgtctctagcccagggaaagccatcgtctctagcctagggaaagccatcgtctccggcccagggaaagccatcgtctccagcccagggaaagccatcgtctccggcccagggaaagccatcgtctctagcccagggaaagccatcgtctccagcccagggaaagccatcgtctccggcccagggaaagccatcgtctctagcccagggaaagccatcgtctccagcccagggaaagccatcgtctccggcctagggaaagccatcgtctctagcccagggaaagccatcgtctctagcctagggaaagccatcgtctctagcctagggaaagccatcgtctctagcctagggaaagccatcgtctccggcccagggaaagccatcgtctctagcctagggaaagccatcgtctctagcctagggaaagccatcgtctctagcctagggaaagccatcgtctccggcccagggaaagccatcgtctctagcccagggaaagccatcgtctctagcccagggaaagccatcgtctccggcccagggaaagccatcgtctctagcctatgttattgtgacactcttaacctcatctcatgcttgaccccttgaatccattctctatatacttctctagacagaattagaatcatctttttacaaacatgaaggattcagtcacacccacatttcaaacatttcaatggttttctgctacttcagaagaaaattgaaacttcttcaaatggcctaacacggctccgcttgatccagcctctaccacacaacagccatccccactcttctagccttgctccctcatggcatggctttaaatgccaccattggaggaagtccatccttaatcacaaaaccgaaaggaggggccacgcacggtggctcacacctgtaatcccagcactttgggaggctgaggcaggcagatcacttgaggccacgagcttgagaccagcctgggcaacatggtgaaacctcgtctctactagaaatacaaaaattagccaggtgtggtggtgcatgcctgtaatcccagctactctggaggctgaggcaggagaattacatgaacccaggaggtggaggttgcagtgagccgagatcgtgccactgcattccagcctgggtgacggagtgagactgtctcagaaaacaaaaaacaaaaaaccccaaaacttaaaagattctcccttgcatgagaatcttatttgccctccacttaccaccatttataataattcctctttttgtttccttcctgccctgttattaacacctctgaaggttggccccatgcagggaacatactacttttatagtgcactcggctggcaagcagtctttcttactttctctgtgttgtgtctatgtatacacagcatatctgtgagggagatattaatattattcccattttacagataaagaagatgtgaagcatatggaggctaagcccctccctccatcaggccacagagccaggtgcaagcccagtctcaccccagcatcctggctcctgtcagctgtcgtttatcatcactatacaccagcacgcctggctctttgtaggagctgagtgaacatgggcagaaggaatcgtgaagtaaacgcttccaagtcggaacatccagagacatttggttcctctctaggtgctcttacccattcctagttctactatttatgctgggaggcatcttctgtcccttactaattgataagttcatctagggcaagaatcatgatttatccatcttcgtgcctctcatgatacccaacagtaggcgctcaaaaaacttttcctagtgtgtgcaggcatttaaaactcagtagaaattaaccacaattgcaatgaagtaaaattcaactaagagttcccacaaaaaataagtacaacagtcaccattccagtcatttatagagctgatctgaatccagaggtaagtttccagaattaaagagctgttttatagactgcgtctttctacttcacgagtgggtagaaatcatctttattagaaaaaaaataagtgcgggagggcggggggcagagagaactatttcaaaaggtttttccctgtttgtcctaaatcctccagagcaggcagttaaacgttgagtccagcgtttcggagcctggccagtctattacaggccttggtggtgaaaggcagagtggcctcatccaagctttgtctctcgtcagcaatgctacctgtgctggcctttccgccttacttcccaaactcctctcccatttctcatttctgctcccatttccccttgttccctccaacactacgaaggcaaattatggggctcaatactgagaagtcctttccaccttattgataatgaatttctttcctgggaaacacctgggaaagagaccaaaaattcaggacagtacagcctaatctgaggtatctgtccattcttggcaggtatgcattgctaaaagcatgtgactactaccgtatatcagagagcccttttatggaacgtggctctctgctccatgagtgggtggaaataatatttagtgaaaagaagagtctcggcatcttaatgaaagaaacctagataggagatgagtcatttaaaccctctctctgtcatcacacagaaatagcttgaagaaagaaggagtcaactcaaatgcccaaggagggcaatggcaacagagatttgggaatcttttccagggtaaaaacaactgggatgggctaggggtgaataaggaagttccatcctgtctaaaggtgtctgttatggggtgaattatgttccctccaataagattatgttgaagtcttaacccccagtaccctaaaatgtgaccttatttggaaataaagtcactgtagatagaatgagttaggaaaagatcacactagagagtaagtaggcccgaaattcaacatgactggcatcccagtaagaaggtggccatgagaagacagacacaaggagagttccacatgaagacgggggcagagactggggtgatgcaggtacaagcagggaacaccaaggacagcctgctgccaccaggagctacgggaaagaaacggaacagtctgcctcagaaggagctcaccctgcccacacgccctgatttcagacctttaccctcagaattgtgaaaaaaattttgttgttttaagctaccctgtttgtggtatgtcaccatggccgttttaagaatcgaatacagcatcccaattcagacttaaaaaacgcaagatgaccaaacccagccccggcagctagatggtctctaattccaatgctcactattcagtgggcagtcacatttctgtcaaaaacaaaaatgcagttacaaaacattttctggctaaacaatgcattctcctggatctcacacatcagaattatcttccagatcccaggggtgagaagcgcagcttctgcgtcagacaccagtctagtggacatcgcacgctagccctgccactcgccagctgtggggctttgggagctctgtgcctcagtctcctccacctataagtgggaatgatagtgaagtcggcctcacagatgaggatgcagggcacactgggaagcctgctgaattacaacgagggggagaactcagcaacccaagcggcatgatctctatcacaggctgcagcactggattttaccttactgtgcatgatttttcatttgctttactgtgaactcacctaggacggggtccaggccttggtcacttttgctctccttgcacatgtgtggcaggtagtcagacatgcctcgggaatgaaggcaggaatgtacttcatcgactccactcctgtgatgtgagatccctgagggcaggacccaagtcctacatcaaccctagagcccagcaccaggtaagaggccacacagagggcaacgaagtcattgtgttggaaggacgtctgtagatgtattgctcaactctgccaagctagcatgggagcaggaattaaatgcttcattccagtttcaaggtctgagtttgtctgtttcctttctgcttatcacacacatgacatgtagaacaaattagggtgatgcttcctcactgaggctttttgggaaacctattaaaccaaggtggaaaaaataattcaagaacatgacaaatgcagctgtcagtaactctgcaacaggcagcaaatgctgagaaatgcacttattctctatggctgccgacgttgactggaaagctgctttgcagtctgggaaacaaatccctactccagactgtatgatatggattctgtctcagtggattggcattgtctagactagcagtcaacaaactacagcccatggtacctcggccactgtttttgtaaatcaagttttgttggtactcgtccctgcctttccagttatgtattgcttatggctgcttttgagctacaaggcagagtaaagcagttctaagaaagacggtatagcccagaaagcctaaatcattcactatctgaccctttagagagaggtctgttgatccctaacttggagtatcccactgtgattacacttaaaattaagcttgaagaggacagaaaccttgtttatctgggtcagacctatctagacgatgacctacctgatttatagtaggtgctcaataagtctgcaaagaataaacatgaggccaaataaatattgaggttttaggacaggtagtgccaacagcacacagtgctaaggggatgcctgctgggctagaccagtgtcccgaagctctgccctttttgagaggatgaggatctgccactgctgggtgtcccttggttaactagctacctgagagccctctgggagccctgggctgcacagacaaccaggacatcttcattttaagaattcaatagcattgagctgtcaggacagattaaacctgactaagaagaacctttcagaatccttctatgtatatacatttacattagaaatgttttaaaggaataaacacttgcaaagcggtttaaatttaaaggttcccttatacaactgaacccaaaacagctgtcagaaaccaaacatttataaatacaaatgctcaaggtaccaagtgaaaaaaagatttttagatctaaaagaaaaagtccaatctatcctgccataacaaaagcaaagaaggaaacagaaaagccagactttctgagaatgatcctttaatgttaatactgaaagcatgtgtaagttctggctccaataaagttgtttatggttagagttaagtaagaaggggtcctttaacttgggaaacgattacatagaacttgttgcagaaagaaagaattccatactatttctctttttctattttgtcctctcaaagaactgttgcttccatgcatcaggtcttcaaaccaggcttgggcaggcgagtctcccagccctccctccagcctggctctgggtgcagacccacggtcatggggaccttgagcacgtggggtcttcttttaggagggtttgtggaactgtagctctttacatagcccagagacattctccctttaaagtttttgggtaatgctcaattccatctttaaagaggtgggagttttaatagcacagctgtaatagaatcacatttcgagtttttgagacaggatcttgttctgtcacccaggctggagtgcggtagcatgatcacagctcattgcagcctccaccttctgggcttaagtgatcctctggtctcagcctctggagtaactgggaccagcatgagccactgcagctggctaatagttttttgtagagatgaagtctcactatgttgcccaggctggtctcaaactcctgggttcaaacaagtgtcctacctgggcttcccaaagtgctgggattacagatgtcagtcactacatctgtcccacatttatatttaaatagaagtagcatcctatagtctcaatttctgatcaaatgtgaaacaatcaaaatgtcagtctgagagttgatctaatataatagtaaaggctcacttataggctaaatacttccatcaaataaatcttaaagtaacattttctaattcaggttttgttttgttttttactaatccccttctaaacccacttaatttgtatttaattcatattcccaataataaaatcaaggaactacggaaacattgcatattccactaaactgtgtttacaatattaacaaaatctatttactccatagaataagcaaaaactcagacaagaattgactcactgggttcgctttgaggactgttatattccatttagaggtaggatttccttatttctttcgtagccacacctttggagatgtggccaagcattctttacacgaaacaagaaacacttgcaaagcggttcaaattcaaaggttcccttatacagttgaatccaagactgctgtcagaaaccaaacatttatcaacgcaaatgctcaaggtactgagtggaaaaaaggttcttagatctaaaaagtccaatctacccttccatagcaaggagctggggctctgcatgatggtagatgacttccaacgtgatctttccccccatgctaccagctgagaagacctcatactgaaggtcttcacagagacaagatgcctcatctccctggccttattttgtggcagctttcgggacattgttttcagttataacttttcagactctttcaccccatgggggttgtgttcccatattagaattaatataaatgcattttcatcaaaaggaaagaaaatagaaaaagaaaattaatgactagttacagcaaattcattatttcccctaaaaactaaacacatcaaaatgctgcttctttatccaaattcttcaccatattgaaatcatgaaatgaaacgacaaccagctttcatgaccagctaagaaacgcatttgatgagatcaaaagtccagcacgtggccccctgggacccacgaccagatgcccatggcagatttttaaattgtttgacttttcttcttaaaaatctacgtcctgttttgctgttgttcatttcaaacctcctgtgtgggagtgttaataaaatctaacatctgtaaatttctcatattggtttgatgaatccttgctcaaacattctcctttattctggctctaaatgatgtgatctcagccatctcctgaaagtatccaaagattaagacaaagatttaaaagccccattgaaaccacaaacaaaaagcccctgaacacctcaagactgagtctcccaacacaggctatgatggaatcgtttcggtttcaaggaatcagtagcaagaagaacagtcagctcctgctgagaaagggccaggaggaagagtgtaatgagggagagaataaaggtatgcttcagcttaaaactaatcatattataggtcaattagaatgcaacatttccaaaaccttaaatgtgtatttcatttgagtaaactcaatcaagtctactctttttttttttttttttttaaatggagtttcgctcttgttgcccaggctggagtgcaatggcgcggtctcggctcactgcaacctctgccttctgggttcaagcgattctcctgcctcagccacccaagtagctgggattacaggcgcctgccaccacgcccgggtaatttttgcatttttagaaacagggtttcaccatgtcacccaggctggtttcaaactcctgacctcaggtgatccgtcccgccttggcctgcccatgtgctgggattacaggcataagctactgacccagcccaaccctactctcatctcaggattcaatggacaaaactgcttcctagttcaaaaagaaaaagtatgtcatcaggaacaaagcccatcaacttcacaaccatgcagcacaaatctatttgtgcctgcgcccgcagaagcacctcccctcctgtgcaagggcatgtgcactcacctgggccctggatcccactgttcctcttcatctaggacaggagctctccagcttgagtgtgcgtgagaatcacccagaaggctcattgaaacacaggctgctgagctccaaacccagagtttctaattgagtaatctgaagtaaggactggtaatttactttgctaacaatttccaggtgatgttttatgatcccagagcagactctgagaacaactaatctaagacctgctacactgattatcctctcatcctacatttttgagtctctcctttcatattgcttctttccctaagcatataaacatgttcaaatttgtcatcttaaaacataaacaaaagtctccctgacctccctgggaatgtagtgtatttctctttccttctgtacacatgtaggttcttaagagaatgttctccatacaccacttccatccgacttctccttgctctgtaatctatttgccctctcaactctgctgaatgtgcacatctcacgaccccacatgaacttaacagtttccaggccaatggatacttcttaagtccctgtttgactctctgccttacctaccatcgctcacctgaccacacagcattccctcctcccttggattttataacctctccctatcctggatctcctaccacctccttcactgcctcccttttggtctcccgtcctggaatatctgcttttcaccatccctataagtgctggggatcccttgggacctgtccttggctctcgtcttctgatgccatacattttgcctgagagttctcatccatgcctgtctttcacctataatctatatcctaatggctctcaaatctagacttctcttctaaacttcaactacatagaatgatcatcaattagacaattatatttgtccaataggcatctcaaagttatcaatacttaaaagtgaacccattaatttctaccttgttcctgttccccttcctttattttttacctaacaaaatggctcctccaactgctcactcatgcaaaccacctttatgtccttaaggaaaaacatgtccttacgtctcaagcacaatcacagttcagaggtgggtccaatccacctcttaactgtctcaaatctgctcccttattcccgtctccaagactgttgctccaacttcggtcaacatcataatacttggttcttccctttcttaactgcatttctagtcacctccttctcatattttaagctccaataacaccaaaaactagttaatgatatctttgaatgtggcatgctctcttacaatggaaaacttctatatattttattccctctgcttggaaaattattaaaatccctgcaccaacatgttctttccaaaaccttcccaaatgttcttgactttggactcctttctggctctcattccacttgaaacctgcctccattacagcaattacctgtttccaagcctaacactgcgccattcaaaggtaaatccttgaattcctagtgctgataatacctggctcaaaataggagccctactaaaaagtacttttatacaacatacatcagtgattctgaacaaggaaacacactcccctggcagtagagtaagcgagtctaccaaacattttaggatcgtttttagcgtttaattctcctcctacagaattttagataactaacatcacatttatttcatctcaactttaacatgtttcatctcttgtttacttcatttcttcaaggaactgagagaggacccactgaaattcagtttggggatgttaggaacctgttggaagattttctggagaagttttctcattacaacagtgtttcctttctagtcattagaagaatgaagggagctgagggaagcagatacttgagagttttacattttctgtacctcagtttgttctctaccatttcagtaaaagacagctactcccaaatacatttttgctgtatgcaactgtgctgttattcctgtagctggtccaagttttatagattactcacacagccccctagtgagcccagctgcttttatactattatgatgccataaacaaaattacataacattttaaggccagtaataaatgcctgaactagctgactggaacatgtagcatttgggcattttcatggtcttcagtgacggttttactgccctgaaaagccctccctgtacgttatcaaagaacaggaagtctccatgtctccactctcggttgttccagcctaaaggtgacccacccacgcccacatgcaaggctggcaagaacgggtcatcgtcaaagagaatatgctaagtgcattgaaacaggctgtgtacaaccttcatcaagcttcaagtagttaaaatcgtgccttacaagtatttttaaagaaaactggtataggtggatacagcaaataaacatgtatttgaaaatccagagacaaatataagtaaaacttgatgaacatatttgcattttatgtaaatgtcaatgtacatgttgtggaacaacttggctctctgctggagagcatacctccttttaaatgagtcaccacttgcggatgaataggaaaacgctgacagatccatgcgagataaaacggatcacagcagtcttggaatcaacacacttttatgatgaaaccaactcatattcatgcctccaaacacagcttaggcttgaaaccaagttgcagaacgtccaaaaattcttgaagaatccagatgttcccataatcagccactgatcaatttcccaggagaaaaggacttaaacaaggatgggaaattccaagacgtttaatacccagaggatatctgcacccagagaaatgtcacactcagaccacaggaagctatagctctgctgttgactgatgtagtcaggtgtctagaattttatgccagcctctacccactacacaccattactgttttgagataaattagcaaacaccaaaaattagaggtaaaaaagatctagaaaaaaaacaattgaaacgaactaaagaagccagagccagggaggtttaacaatcattagtaacaggtgatatccactgaaacttttccatgttcttccagcttcacgctaagaacttcacgttttcttaacttattcctcacaacgatttttaatttaaattgattattcccactttataaatatgaaaactaagacttagcaatattaagagatttacccaaggcacacgacttatcaacagtggagacggaatctgaactcagtctttctgattccaaagtcccggcacttaagcaccacactggagcctgaagcaaaggctcatgggtgaccccagtcttaaacatctgagggtttgtaacatggaagacagaacagcttcgttgtattctaaagcaggagtcctccaaacctgtttgtactggagaatcatctctgaaacttaaaaagaaaaaagaaaatccagtttctacggtcccactcacagactctgcttcagctgatctggcatggaggccagaaaactgtatttttataatgctctgctgggtttgagaatcaccgctccatacctcagaactagaataaacgcagaggaatcactaggaggcaggtttggctttacgttattaaacagacaaaccaaaccaaacacacacacacacacacacacacacacacacaccgccacccacaaaccagtcctaaccacagggctacacaagcctcccctgcccagtcctaaccaacagagcttcccaaatggagctgtagctgcctgctcaagcgccacgatataatggagacaacccagtctctggaaacagaggctgccatttccagttctgattcagccattctcaggtgtgtagctctggtcaagttattttctctgagtctcagtttgctcaactggaaattattggagaacacttacctcaaagaattgttaagaattagagacaattaggtaaaattcaaagaaccgtggctgatgtggctgatggtgctcataagcaaacggcacctgcccacttgaaatgtaaccatcttcttctgtagcttctgtagcgagcctctgcatgtggacagcgtgggccgcctctgcagcacccttccccttattcccaccattgtcccacccactgacatggccacgtcctattggcttcaagcccagattttagcaatgggctctgactggcctaatccaatcagcccacacctggcccccttgccacagccataggcagggaccagagcccaggccaatcagcagatggtgttcctctggcagagaacggtttgggaggaggctgagcatgtgtccaaaattgggccaatcagagtgaactcaaaggctttttttgtcagtaggaggaaagggagtatctcctcttccagaatgtatgacacatcagcctgagagctgacgctcagcagccattctgctaccaagagcctttatcaaactatgtctgaagcctgggctatctccatatttttgagatctgtgaaccaataaattccccgtatcatattatttaagccttgaggttgtttttctatggccaaggctgaacacattgtaacttatccagaatcccctggctgggagtggtgagatgtaaccacttagatcatttctaacttcatgattccatgacttcttagactttatccaattaatacctgtcttcacatttataacacttctgacgactggtttctgcagcctggaacatcctgtccccctttctcttcttaagaaatcctgctcaccttttaggacccaactgaaatgggtccactgctgcaagatctttgaagaggagtcagttaatccatcttcctgtgcactcccccagtacttgaccatttcctctcttatccttaatttcattgtgtacttttctcactcctatcttcacctatgtttaggctgtgtgcactttgaagacaacacccccttccctaggcattacttgttaacaggccaactgtgcagcaaagtagcacaaatccagcttgctgcacatgtccaatgcctaagatgaggctgggcctgcagcaggcttgcaagaaacaaccactcattcattcaatgccacatgagtggttaactggatacaaaggagaagcaaacacaacgaaggcttctgccttaaccttctaggtgtcctaccttgtaccttgaagggattagagagaaaaacattctccatcttgcactgctgatttccaatgacaagtggggcttcccccctcccacagaggattacaggccaacttgggtatggtagggttttggggactggaggtggtttagagttttttccaatcttattaaacttactcagagcttaacatctattaatgaaattatgttttctataataaaagtagagactcaaatcctatagatgccctgaccttaagatataaaaattcaattttaaaaaatattacacataccaaatacaaaagatctattctgtgacctcttctctaacaccaacaactgtaaatttaatatcatcctgtgttacctgaggtagttggaaggtgtttcttctacgtttgttgtatctagctttttcttttcagattttattatttatttatttttgagacagggcctcagtctgtggctcccaagctggagtgcagtggtgtgatcatggctcactgcaaccttgacttcctgggctaaagtgatcctcccgcctcatcgtcctgagtagctgggaccacagggatgtagctgggactacaggcctgcaccaccacacctggacaattttttattttttgtaaagacagggtctcactatgttgcccaggttagtctcaaactcctgggctcaagcaatcctcccgcctgggcatcccaaagtgctgggattataggcatgagccaccatgcctggccagctttttctttaagtgagaaaaatggtgagagagaactgtctcctactcctacttccttttggtcacacagctatctcgaccttgaataaaatttctggatctgacatggtttcagtggctgcaatgagaaaggaagtatacagcacaaactaggagtagatttgttattcatactccaacacctgattaccttctcaaaaaccagggtatttcctgcaacccagattcctcattgacaggaatcatcttggtctgaaggaagggatcaggagccaagaaataagagtggcctctagaagctggaaaaggcaaggaagcagattctccctagagtgtccagaaggagccggccctgccaacaatcttgaattttagtccagtgggactcatgtcggactttggacctacagagctgtaagataacacgtgtgtggtttttaaagccattgatttgtggtaatttgttatgacagaaacagaaagtgagtgcactgacttccctgtaccagtgaccactaactggcatctacactagtccctttccaaacagtagtgctgtttaaaaaaattgttatgtttatcaacatgaagcatcataagaagtcacaatcgtaagttgaagtcaattagaaaaaagaaaattctaacaattaccaaagatccaaacaagaaaaattcagtatcaaacattcctcttatattcacaaaagagacctgaatacacacatgctttaactaaaatgatttctttcctatatgtggaaaaaatgcacttattcattaattcaacacataatttacagagcctctcccacctgccaggcactgtgaagaatcctgagggtttcctgccatctatctgagccagggcaggtgtggaaaaaaattttcacattagttcattaatggtaaaataggaaaaaggaatagagccacagcttaaaagttatgtcgttatagacagagataccagcagagaactaagccacgtgcatttgttatctgtttctgagcagcttaaagcaaccagctaagtgacttcacacagttctgagggtcaggaatccaggagtgtcttagctgccatggttccgcctcagggtgtttcaggaggttgcagtcaaactgtcagccagagccacagtcaactcaaagatggacaaaggctggggcatctaagctcactcctgtggttgctggggaacctcagtcactccccggctgtttgccaggggcttgggttacttgccaggagggcttccccttagagctgctacaagaaggcaggtggcttcttcccaagtgacccgagagagagattctgaccaaaacagaagccaatgtgttttacaactgaaccccagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggtcacacacaccaactgtgatgcagtgtgggaggggagtgcccaagggtgtgaacctcgggatgcaggaatcattgggatcaggttgaagcctgactaccacaccatgttcttccaaaacatttcaacaaaggagccatgtagtaaaatcagcatggttctagaatggcagtcatggggcctggagtagccatggatcggccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcagctactctacaatctatcaaggcctcggtttccaaagccgcaaaatgacaatggagtcccatctattaataaaactttgggaggtagaagggctgctgcttctgcactcaacgtttactgggtgttcatcatgttccagatactgtttgaagcgttacacccttattaactcactttcttctcatcataaccctctgaggtggttacaatgttcactgctgtgtaagagctgagaagactgaagcaaagagagttcatccatttgccaaagcctcaccattagtaagaggtagtcaggattcgaacctaagtggtttggcatctaagtccacattataacccactgtactctctaacagagggtatggaaatgatgcaagtcagtacactataaaatcatcagcaatactaaactttaaaagaagaaaccacgtttaaaaaattggttaaaaaataggagccaagcatggtggtgctcacctataatcgcagctactagagaggctgaggtgggaggatcacttgagcccacgagttcaagaccaggctaggcaacatagcaagacgttgtctcaaaaaaaaaaaagatagatagatagatagatagatagatagatagatagatagatagatagatagacagacagacagacagacagacagacagacagatatagattccatttacatgagggacctagagtggtcaaacttataaagacagagggatggatgccagggctgggggaatagggaatggggagttaaaatttaatgggcattgaattttagtttgagatattgaaaaagttcgggggatggatggtggtgatggtttcacaacagtgggaatgtatttaatgtcactgaactatacacttaaatgatttaaatggtcatttttatgttatgtatatcttaccaccataaaaagaagacattaaactacaatatccaatattccatccaggggcttcctcaaaatggaaaatccccatggttaatcgctttagatgcatagaaaatcgttccgttctaaggtgtaggaagaaatccaaaaggacttgtcttttctggttggtccatcatcgctctctcaacttcttttcattgcacttttcattacagaaataaaataaaatgtcggaagagtttctgttactcttatctttcccaagtcacattaagtaggaatttttaatttaagtgcattccatttctaaagccaggaaaatctgcccacacgaggtgcttcatagcatacacattaggaactcctctatggttctcattatttacacccttcctcggatgtgccctgtgtgttttgagagtcagagattggcccgacaaaatgaaagcgaaggcgtcagctgagagggacgcggggctttaggtaaaggacacacgatgagaggccctggccatcgggttactgttgtccacgtgtcggatggctagagacgctgtgagagttactctctctagaggtcagcactttggatgccctcaccctctgaaataagcattttctcccgggacatcaaggagctggggactccaagcattttcctcaccactctggtcatctcccacatttaggaggaaagttctacttccatgaggcctttgcttgcctcatttcagaaataggggagggccttctcataaaatgactttttatgccttagttaagagcatatgtttaatttaccactcacttccctctcattatccatctatgtgcggatcacagtactaggtggtatgaagtgagactgagaaagtaagagatgaagaaacttaaaaaaaaaaagctgtaaaaaggacacaggtaaaatctaaccttcggctgggcgcagtggctcacgcctgtaattccagcactttgggaggccgaggtgggtggatcacaaggtcaagagattgagaccatcctggccaacatggtgaaaccctgtctctactaaaaatataaaaattagctgagggtggtggcatgcgcctgtagtccaagctacccgggaggtggagcttgcagtgagccgagattgcgccactgcactccagcctggtgacagagcaagactccgtctcaaaaaaaagaaaaagaaaatctaaccttcgaagaaatggaatgattaagacacatgaataaataaaacaccacttacctagaagtttctaatgtccagtaaacaaattgtcatgcttgttaaagttacatatcacaggtggcttcataagcctcaggacaacctgagaagcagccctgtgctacacggaagtcatgggactagagtagaaacaactaggtccaaaccctgaattccgcattaattcatttgttgattacgacgtccacccatatgacaagtatttagcctaagtctgtttatacacctgagaaatggagaacagtaacaaatgcctgagggtgctataaggattaaacaggtaatttatgccaacgtgtttggtaaatatttacagatgatacaattatgaactgtagggctggatgatatttcaagatatcaatttgtgctcttctctttgcattgcctttctttttctcccacagatcagactctgctcagtgcctcaggggaggcatgtggcagtagagaaagcagaaaccatctgcaaaatctgggatgcagtagggggtgggggagagactaatgcagcctgcagggctgacggagcaggggcctaggccccagttctaagcagggctgccacccagaagcacaacttccccaggagggggatttggatagacagagacacatgcaactcctgagtcctatgtgtggcaaggatgcatcagagagccaatagacatgcacagggggcaggccaagagagccatgcccctaacagcttggtcctggggatgagcccagaaccctgagaagggagatgaagttttccaccacaccagtggaaagacaatcagccagaaattgggcagatgtatagaaaaaaaaatgaaatgttatttttggcacattagagtttggggactgagttttatacccattataatatttaacttcccaacacctaaaatcctcctggcagttaacaacgaatgcccaatggaagaaatgtttcttgtttaatttcataaatacatatagagaagccatcttctctgactaaaaagaccacagattgtgctgctctaatgaaaagagcattggcagggcataaattctgaaacgattttctatatgttgctagccacatagaggatgctaaataaaaagctgttggctgatgggtgacaaattgtccagggcagctcataacttccctagactcttgagatcaatggcacacacctgccaaccagtgggctgggattaggggtataatgtgttgtgatgaatggaccttttctccatgcaatgctaatgggtttatatagaatagaattcatgatacaggtgttattttaaacactgtgctctaaccccttgaaaactgaacaaatagacacatactcattaggccaggaccacatctatcaagttacctaatgcattcccagagcctagaagactactaggcacagagtaaaaattcagtaactatctggtgaatgttaactcacagaagacacaatactgcctctaacttcacctatgaaatgcaaagtagaggcgtaactccaacaaataaagccaagcccagtatttaaaagcccaaaacaaatgaagtgcaacaacagaacaagagctggctagctttccagtgtccccatccaaactagggacacctacagaaacacagaaagttcaaagcctatgggaggggaacgtgggggagggagagggacttatttaccagccccagctttacacttcctccatctcctcctcttctttagcaagatgcctctgtgctttccatgaagaagtcggccccagaacatgacctgcatctcagagaagttctgatttatgaattggcactgaggcgacgtcgctggtgcggaacaccatgacgtctgtgtctagggtatgcgcatatgctgcgtttttccgcaggtgcctcgcagtctgctctggctcttagggcttccgaactcagttcagggcatggattttaattaacgaaatgaaacactggccctacacgacgggacacttaatgaatttatttaatgatgccaaatatggggaacccctttagggagagaagcaaaaggaacaggagaaaaagatcaatttgttaaaagacagtcaaagcaactgagtgttactctcagacaggggggatgtcaactggggagtgatccccagaaaatcaacttcattgtgaaatcagaagtacgagcatctttctttcaactggaattcattgagcatctactgagctgctatttcagcacgcttgctgctgggagacacagaagacatccttcctcctcaacatgcttctgatagacattattaagaaaaactatttttttggctagcaatgcagtttcacctcacatgatttcacttccttggagccgtgaatcagcagtggcagggattatctcccctgaggaaaaccaagatgtgggctggctggctggggtagggtggtgagaggcagtgctgtgcaggaaaggactttctccaggccagcaggctatgcagttacacagaggagcaagccctgcacccaccatcgtgattcccaacccttccccagacctcagcacctccaccaccaccagggaaacaagacacagtcacggcagcggacagcactttaggacaaagggggaaggacaaaggcaggatgtgaggatggtcagggagtgatcagaactgctgggagaaagatcagccattgctaagtgtgtcttcaagccctacacttccctggagagatcacagctttctctggcagatgctcagacaagaggtcacggataggcactgttctggcaattgccagacaaaccaacctctttctgatcccactgagaggctggacaataacacagtctgtagacaaggaaattcaaagcatggcattcctccagggaaaacgctgtgctggaccaggaccagggcctgccaacacctgtgagcagacagattccaaaatgtacagtcacaggctggctcctctgaggcttggctcacagtgcttcatcaaaagaaataaagataaggaagtatcttcctgctatcagcccctgcttcggtggcaccccactcatctcttacccacccttggggagggaatggagatctttaaccctgggtaaagagtacaatgaaacttcattttctgagctcccagaggttttggaacgtgatagctcctacagagacatgattcttgctgaataaataattctaagtcagtgacctgactagggactcatgtctgaagcaccgtttgattcttcaattttcaatttttcctccttttatttactagccaatatttccatgtgacaaccacatgcccatcccattaggagggctattacaaaagaaatgaaaagtaaatattggtgaggatgtagagaaactggaatcctcgtgcattgctggtggggatgcaaactcctgcagctgctgtggaaagcagtctggatgctcctgaaaaagttaaactaccaaacgatctagcaattctgcttctcggtatatgcccaaagcaaacgaaagcagcgactcaacagatacttgcccaccaatgttcatcgaacattattcaatttccaaaaagtggaaacatcccaagggtccgtcatcagatgaacagaaaaaatgtggtgtagacagaaaataatattttgccgtaaaaaggaaaggaattctaataatgctacggcacagacaaaccttgaagagattatgttaagtggaagaagccagacacaaaaggacaaatactgtgtgattccacttacgagaggttctgagagtagtcaaactcacagagacgcaaaacagattggtggtgtccagggttgaggtgaaaggggagtggatgattgtcgcttcacggggtaggaatttctctgaggtaaggaaaaacttagaaatagatatggtgcacaagactgtggatgtaattaatatcactgaattatacactcagagatcattcaaatcacaaactttatgttagatatattttaccaccaaaaaaaacccacaaaaacaaccaaacatgaaaccaaactataaagaagaaaacaaggtggaaataaaaaaaaaataagagcttaagaaataaaaggggaagattgcaaaaagcacacagaataataacattagcaatgctgccatattaactgcatgtagatagtatttactctgtgccaggaattgttctgggtgctatccatataacaacttgtataaccttcatgggaaccccttgatgtaggtttttattattatcctcattttaaagttaataattctgaaaaccagcaaggttaagtatcttgcccaagatcacagagcaagacatggcaaaacctagatttaaacccagaaactcttgacctggaatctatgtttttaaacaactaagctggttgccagtataaaagacctaagagtgagtcaaaaaaagaaaaaaagaaagaaagaaaaaggatttaaggatagggatgtataaacaattatatactacctaaagcaagagagagagaaagagagataaagactaatgaaaccaacatactgcattcttatttcaaaagtcaaatattaattgttccataaatagtacaggatactactgatcttttaggctcacccaagtctctcccagaaaacaaacaataaagcagaaagagcacggaactcgaggttataaaatctgctttaaaatcctggctcaatgacttactttgcttacttcttcatttagcgagtatgtaatgagtacctgctaggcaccagggaacatgctggctagttcactcaacgttttgaatcctagttcctcttttataaaattggaataatatacctacttcacagggttaagaaagctaaatgagataggctatgactgttcttgactcctagtttacactcagtaatggttgactgaagatgttttctcttgcctagtttctcagaataaaaattcgtgatgatgataagatatataaatcatgcggcttgggttttcaatggaggcattgtgactgccaggctgtagacaaatctacacagctactcggctccttgtgccccaccctctttcttacccttaagctggcaagatgatgacacatggcagggcaccgataagtgtcggtttttttctgttcttcccagaaggggtgggaagagacaacagaaaggagaaaggaaaaggagacaggagaaaaaaggaacatggaagaaaaaaaaacagaatgtgaagatggagataggatattacttccttcccttctctcccactggggtagaaagggctgtggtctgcagggggcgtccaccttccatttctctctagaatgtcccatagcatcaaccatgcccctaaaccaaaaatgacacaaaccttctccagactctaaaaagcccctttggaccacacaggacttctctctgtttccccctcccctggacaccaccatacacacagttcaatgatgaccttttattttgcatcatggccaaaacagttattaaggagtttcatttccagggcgctcactaatcaagataacagagactaaaatacaaggcctacaagccttacactcatcactggtgattcgctgagttcaccttgtcaagtaaactgtaagatgctggaagacagagaacgtatctaacagaacatatctatcagtgagtatttgctaaagccacatcttgacttatgacatatggagtgtttggaaacagaagatcacatttctacattccacatagatcgaaagtctagctaacttagagactgctttattttgtccgagtaaggttttccttaatttctaaagttctgtgatggtaagaagaagcccaccaattatcagcccatttacaccacttcactcaagtcttacgaaatgaggccgctgtcctgcgcccccgacgaggagggaaacgagactgatgcaaatgatactctaaggccaacagacagaaccatatttaggatcctatcgggctagctccaaacgctgccttcccacctattcacctgaagttccttgtaatttgttagtgtgaattaaatgacatctcggaaagtgttgcttctgactagtgagaaagttttatgtcaagagaagatgaattgctccaaggagaaaaatatgccaggcaagtccaaacacgtctgcctacctacaagtatgattcccacaagcacgtcctcctcttgccaacccatcttcaaccttatagggtgcagatgtttttgaaagtttctccttgctccaggtactatggaagagacagtgtctggcttcatcctggaaaccatggggtatgtggcatccatcatgttttggagatgggccgtttttacattagccacccttgccaaaatctaagaagcatggctgtttctcatcatgtggtcgctggctctgcgagctgtggtttgaagacggaaacaataataatcctatacataaatgactaacattttatggggaagacagaaaatagtttaaatgttttccatgatcctctttttgaactacaaatgatagtcaaacaggggtcattgccctggctgataattttcagaattgcagaccctacagtaaataacattcacagatggttcctttctttgaatatcaatgctctgccttttgggagctggcagctactcagagaagagcattaaactggccagaaagagacctgggatcctctggatctctttcctttgttcagaacaagagattttgacagattctccggccgccagtcttccagctctggtttccagctctggttctgggcgatccccaagagatcacagatactttgtatactttccacatccaccactgtaattgcagagtccctatcttccttacgattctgtttactagaaccaaacccatcatttttgagacattgccaaattcactgcaggaacaagtcataagtccactgagaagcgcatgccagttgtgaggagactccggtctgacgggcaagatgaccacctcctttttattttattatttttttaaatggagtctcgctccgtcacccaggctggagtgctgtggcgcgatctcggctcactgcaagctccgcctcccgggttcacgccattctcctgcctcagcctcccgagtagctgggactgcaggctcccgccaccacgcccggctaattttttgtatttttagtagagacggggtttcaccgtgttagccaggatggtctcgatctcctgacctcgtgatccacccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcagcctcccaaagtgctgggatgacaggcgcccgccaccacgcccggcccattattatttctttagagacggggtcctgctctgtcacccagcctagagtgcagtggtgcaatcatcgctcaccgcagcctcgacctcctgggctccagtgatccttccacctccctctcccaaagtgctgggatcacaggcctgagcctccgcgcccggccacctcctcttacagtagttcccaacccattcttcggcctcactgcatggctcacacggaaacatctcagtttaccaccgcacgatgtaagtgcgttctacactcaccaaagagaaaagaagtctgaaggataaggcagagaagagaaaggttgtaggtaggaggattggtgagcagggaagagatatgatggaagaggcggagggaaagacggtaaaggggcgaagaaatgccaagtgaagatgtgtaggcacacagaagaaccgaacccagaaccagaaaggggaaaaactctattgttctgtggggctccaattcacaggtcattaggctttggaggatccccacagaaggttgtcatctgcttctcaaacctctggcaggggcatcaggtgtagctatgctaccacagcgccatctggtggagcggtgggacttatcatgacctaatcaaactcttttaggactaattccgtcttgcaacaattccaggcaataaatacaggtgacaggatatattattgaggaatatggacagctgaagttcacacattgttacgtcctatggattatctcctctcagaacaattgtagagtaactttacaatccacatactgaaagattccctccccattcctttttatctcttcccaccccattttgaacggctcagctatcaacaaaattttcaataagaaatacattgcctttagatgtacctttttcagcaatgtaaaactaccttgcttattattccaatgatctgaattttgagcatctctttaaattacatacagatcaatgtcatgaagcattaaatttattataatatgtaatataaatatctcacacatctagtcattaaacactaatatttactttgttgcctttctttctccacagttttcccatgtgattctcttaagaacaaaatataatacagtcgtgtaaatctaagtgatttattacacaagtgattatcctagagatactgggacccacgacttggggctccaccaatgttcctctgttatataagctcaggtatgagttctgggaagccacagggcatgggagcaaaaccacatgctttggctcagacctcgattggaattcgggcaccgccacttactaaggggccttctcaagcctgtctcctatctgtaaaatgggaatgagcctaccgacttcataggattgctgtgaggattaaatggaaatcggtacgcaaaatggccagcacagtgctaacatctagaaggtgctgcccagccccaaagagatctaccagagaaataataattctcatttttagtcaagctacaaaataagactcctcatttctgatttgttttataaaaatgcaaaaaagagagagaagaaaagccttccaagattctgataccgctcaccccagttttcacttgaaagtcaaccaatgaatgagcaccagggtgaagatggaattctgccagccacagtacctgcaagagtccacaacacacttgactttcattcatgtgtactacaatcctgtgggttaaagggccataaaagttgtcctggtttttcttatacttcaaaggaagcaatttaatggccatgaatgacagcctcccgattacactgtaactatgaaacacgactgttctggaatgatttccaggctggctccctcaccaaaggaacttcaaggtaagaatttaaacaaaataacctttccaggctttcatccagcttcctcatgcaagaggctctatccttgggagcccagggaatgtatgtgcacacaaagggttacgtagggttgaggccagacagagggtggtctggagagttgtgttgaggcagggcaacccagaaaatggacagcactgttccctggggaggcctatatgctacagacactataagaaataaaagaataagggataataattttttttttgagacagcgtctcactctgtcacccaggttggagagcagtggtgcaatcatgactcgctgcagcctcaacctccttggactcagctgatcctcccacctcggcctcccgagtagctgggactacaggcgtgcaccaccatgcctggctaatttttttgtatttttttctagagatggagtttctccatgttgcccatgctggtctcaaactcctgcgctcaggccatctgcccatcttggcctcccaaagtgctggtattatatgcatgagccactgggactggcctaattttaacattttaagggggaaacattacatgaagaatgttggttacaaagaaaaacctcaaaaatgtgggctctgcctatcttactgccattgcttaattagccagatagagcaagccaaaaatattcccattgccctatgactcagcagacaagtataaatgtttctcacagtagcaaagcaaacgcttacagctggaagaccatcacatatggtggagccaacgctgtacttggaactggatttgattttcaatcctggtttctcaattaactagctctctgaccttgggcaacttccctgaacattggtttgctcatctaaaatgcggatagtcacctgtctctataaagggctacccattaaattagaggatgtgaggataagcaaatcaaaactcccttggtatgtcctatgcctcctctcagctggaatacagcagggcctaggaaacaggtccagttttctgcagagagtcatatgggcatagtttaagcatgtaaaggggcacgcttacagtgatgttataaaagcaaaacacaagtacctgcttactgcagaatcctctcacaaacagagaatcctatgaaaactgcaaaagggataaagaaagaaaaagtgggggaagccaggtccttcaaacctccagtcagcagtcactctcaatcattaccagacgtcgtcactgaatttagggcccctgtcagaaccagcacacatatggagccgtggttacaggccagaacacacacctcttgacatttaaagatgttcatcttcaattggcctccatatgagatgtggagtttgagaacctaattgttcccaagctctgtgaatgggttttatatactccgaagacagctagatattgaaaggggagaaaaggcgggatcttgacatttgggaagcaattctactacactgttttaggattggttttaaaaattaaagacggtgatttgatgtttgtgttgaaagcacaaccacgtcctgactgctaaaagaaatctaacctatatgtcatggtcccccaaagccccaaagtggattttaaagttgttaaagtaaaaatctactttgtaggaagagcccgccttgctattctaccttaaaactgatgagcgagttggagggactgggatgttggaggggctggggtgctggaggggcggcggggggcgggacaggggagacacgggtggtgaggaacagtccagggatatccaggctggacccacgtaggttcctcttcctaccaaaggggaactgggacgtgctccctgtttcccagacggaactcctgggtgataatgtgagaagcccttactgcacatctgtctttccccacatacttacaaagttagggggaaagctggaaagtgatatgcagcccctgtataattctgacttattctcagaagattttttaaaaaactaaaaaataaatggaaatcagctgcagccttcctgatgtgtgaatagagacaatttaaaagacatcaagtgccaaatactgacctgtctcgcctaacaaaactgccctgtctttcagcccactgagaacagagggacacacaccacagggaggtgagctgtctcggaaggagccctccacgcagaccccacagctatattaactgtgcttaacgtaatcatgaacacataatcgcggggctattgaagactccataacaaacaagatcaaggagcctggagcctctaaaacatgaaaaccaattagcactatgaaatctaagagcagacacagccagagctcgagaaaaggcatgggcaggagctggactgctcaatcctgctcactcctcccttccttcctgttacacggttctgttctgaggtgctgctgagaggggcttcctctcctgggccagaactgaggctaaggcccgaagctgaggacagaaagtgatcaactccccacattctaaagaggctgctggagaagcggccacgactggggcctgacatccttctctagggattatcaggcagcactctgctacccatcccacaggaccgtaacttatccttcccaatccgtagaaagcaagactctgaagcatgtgcgtttgtctttggccttgtgggaggtttctattcaagaggaaaactgatgccatgaaggatgggatgaggtgctttctcttcccagaagggaaagatttgggtgcctcgtgaaagggagtctggagtcagctccctggtcaatgatctacttgcagagacaactctctgatctcaccttaataaatgagattcattcacctggcactttgggtttcatgtagggggagagatggaagagttaggggaataaaaggagatgaaaggactaaagaaaaggcagaaggaggccgggcatggtggctcacatctgtaatcccagtatttcgggaggtctatgtgggtggatcacttgggtccaggagtttgagaccagcctgggcaacacggcgaaaccccattctaccaaaaatagaaaaaaaaaaaaatttgccaggcatggtgccatatgcctgtagtcccaactactcaggaggctgaggtgggaggatcacatgagcctgggaggttgaggctgcagtaagccgtgatcacaccactgcactccagcctgggaaacagagccagaccctgaccaaaaaaaaaaaggcagtagggcatgacaaaaaatatactgtggggcaatttgtactcagacgtgggaaacaggattaaatgcattagaaaagaactaaactgaaatatttaaaaatgacagtaatcagttaacaatccattccccatggataagaaggctgtgatttttacaccaaaggaaaagtgtttaagtcatagtccctaccataggggcttcaacaaagtgatgccaaagaaagactactgtcctacgaagacagccatctggaggaggtcctaatggtatcacaagcgatgtgacaaaaatgaagtcccttcatttctctcagcctttccttacctgtaaacagggcaagaatggaaggctgaaatagccagaggttccaaacctcaatggtaatgaagaaacacaacctgtgcattgtattctgaaaggcctcggagaaactgtgtccttatccacagacgcacagagcggtgttggagaaacatcagttaccacttgcctaggatgtctaagggctcttgacacatcctgtaatgcgacgtaaataagaaataaaggtgggcctcactgaaagcagaactcctctcagccgaggactggcttagcctgagtttctgggaggtgatctgccctctgggcttcccctccctcggcccattaacatttctgtacttagaagtcggctgggatcctggagggcataagagctgtaagaatgccatgactatttttaaaattttgaaaaataaatactagaggctctggcagcaacagcgcttggggagtagccgtacctctgaagttttcctttcctttctcgagcaacgcagggagggagctgtttaatgaggagtctcaacaccggggaacaaagcagtagtgtttgcacacaaagcttggtgctggcaattttctcggtttcgttttttcatgctgccaaagtcatttgttttgaaaataagagcctctcctttgccctcagcatccctattaagacactaaaccacaggattaattctgtttaggcctgcagagtgaggtaaatcctctgagacacctcagcaccttccccaggtgagacaggagagtccggggatgaagaattcggctctggagtcacagactcaagttcaagtgccagccgtaccgcttgctagcagcgtggccttgggcaagtcacttggcttcggtttcctcctcttagctgcaaaatatgaaaaacgggcctgctatgaaacgactggcccatagtcaacactcagtaaatgataactatataaaataatggtggtaaaaccagcaaaaatcgacaggtgtgtatcgttgggccataatgtgaaaccacgctcaaagtactttaatatagcatccttcaaggcgctcacaatgctgcagactgtaggagcgaagtcagcaatacaggttggaattcatgtattgggggctatactaacatatacaaagtatacgtgatttgtctaggttgtttttgatgcaaaatagcctgaagctagaggacaccacctactcttatctacagtgtcccttctgtttctaggaagagtctacaatcctaactttaatgcatttttgtctaaactaagagtcttcacattttttgaagtcacagaaatatttgtgaatatatatttttaactgggacttgattactttgtaacatgtatgtgtgtatacacatacacacacgtacataaaagggtaacaacgcaaaaggcaatactggtttgtgtatatatcatatagtggaaagaatattagattcaagttagatcatctacttccaacactgcagatggccagagccgtaaggcaagtctctccaatcaggtcttagtattctccttatttaaaaaaggagaaagacattaaaataccttcaaaattattgttgtgaccccaggcagagtaactagaatgaagtagaagaagctattggaatatgacgttgtctcatgtaagatcttttttttttttttttttttttgagatggagtcttgctctgttgcccaggctgaagtgcagtggcgtgatctcggctcactgcaacctccgcttcgtgtcgtgagatcaagcaattctcctgcctcagccttctgagtagctaggatcacaggtgagtgctaccatgcccagctaatagggaggctgaggcaggagaatcgcttgaacccagggggcagaggtcacagtgagctgggaatgcgccactgcactccagcctgtgcaacagagcaagactccatctcaaaaaacaaacaaacaaaacaaaaacaaaaaaacaacaaaaaccccaatattttaaaacataacagtagaaattgtgtttgtgaatgtcataagaagtttctttacttcttctagttctctgttgagaaacaatacagaatcgtatgctctgtctattggggcaacaattcaatcacagcaggataaaaattgacttttaaaaagtgaccccctgctcttgttttctcctctccttcatcagttcactaccagacctcacaccagagatgaagcttctccatgcagagaaagacctaaaactctagcgtgatgtactcatggataagaattgatcaacatgtatccagagcccaatgatgccaggaagaaagcctaaacataatttaataaactccctctctgttttcttcatttcctactactttggtttacttaaaaatgagtgtttgcaggagaaatctgagtgcatttttggcaagcagctgagttatctttgcttattcattaaacgaacagtgtgacggagaaagtccaaataggaaagacaaggaaaaatggggaaaagttgacttctcatcccaaaatatttcttggattaaaaggcaaactcatccaatcttaaggtttagagggctaaaataattgttccatatgtagctgttagaaggcattagatattaactatggcatggtgtctatggatatctgcgtcatctatttagatagtatgtgctgaatatcaaaaacattaagctaaagaaggttaaggaaagatggtgtttccccaaggaaaggtgtgcttatcctagtttgacagtctcctaggaaaacttggatactttcttacataggaaggacatataacatgcttccagagtcacagggtttgaagacggctgaagacgtcatcttgtccccatatgcggcccaggaagagcgaagtctagcaccacattgggactagaaatctacattttaaatcgtattacaaatttagagatctaatggtgtattagcaagataagtttcaaatacatcaacaaaatgataggcagaaggaacctcaaaacttttgtgatctgaattccccatttcatagatggggaaatcaaggccctaagagctgaagaaattgccaaaggttgaaaaacactcctcaaacaccaccttcctcctctctgggacttcatattatttcattttcttttactattctgcctgagctttgactttctggaattttaaataccaatataggaatcatcagctggtgtcaatcctcaataagatgacttaaagtttactcataatggtttagcatggtcagaaagtgaacattattcataacggtttttcatggtcagaaagtgaacactacaggtttggcctatgtgcctgtaaaatttagaaaaaggacataaaaaggaggagaatttaaaaatcacctagaccactgtcgatgctgtgagtgggaattcctacttacaaaggccccagtgcaagctccctcttagttagctgccttctgacccagctatctcaacagagttcattaactctgttaaaaccactaacttatgccatggtaattcacataggagaatggcataactaattaatatgggtggaggggcactggctctagcattaaagtggattgataactcactgaaatctgcatgatcacacacaaactccttatcttgctaagtttacgcttgctccactacacaaactgaacaccagctcttagtaccctcaatagctaccctttcctcactgcagaagaactaagtttttcatcagacacccaaatgaaactgatactggccgtcagtatcattatccactgataccagctaccaattgcttgctggtactggctgtcaatatcattgtccactgataccagctaccaattgcttgctggtactggctgtcaatatcattatccactgatactggctaccaactgcttgctcgatgactgaacataagccaacgacactagccccaagtactttcctaccttttcatccaccattagcataaggaagagaaattcctttgttgtcttcttgagggaaaaactacacaaaatagaaagccttaggctccattacataaagcgttgaaaaccacacaccatgacaataaagacccaagcatgttttcaataaattattttcctcttatttcacactgtgaaaacccacatttgatagactattttatagcaaatgtaccggttatcaataaataagtagagtttccacgtgaggagagaggagaaatctactcccagcatttgcccccttcatgggtgcaacagaacttgtagcaattctctggtttaaacaacaggtggcagtgtcatttctacattttccctggcaagaaacctttgcagtttgtgatttcaccttccaggaggcattaacagttttgtaaccgcctctatcgacagcgtgtgcatatgttcctatgtagtaaatgcaaatgcatgcaggaaaacattgagatttgtgtaaatgcagtttcaccaagtgctactctccccatacccacgcccctccccacacaatagtctatgcacaggcatcatttcccttgaggaaacagcaaagcagggaaaaggcagaaggaaaatcgactccatcacatatgttctgatcctcaattatcatatacatgtctgtcacccacccattcctgccacacatacaagagaaaggatacactacaaggtcctggggcacactttgggcaaatgactgagaaagcgaagttctgagaaatcttaattcacatcaagaaaagcactctactgtactgacatttctggtaggcgctgttttcactcttctgctacaaaagagcatgctccatatttgaaaggaatcaacagaaacaggtcttacattcccacaaggaaaacacagaagtcaggaccattctcacatgtgccgagaagacaagaccacgtttcctagggtttttgtgtgagctttaaataggagaaaagtgccatgtcaagaattcctcattcaatatctatagctcagttttttgttcacatgcattattttattttattattatttttgagatggagtctcactctttcacaccagctagagtaaagtactgcgatcttggctcactgcaacctccacctcctgggttcaagagattctagtgccccagcctcccgagtagctgggattacaggcacgtgccaccatgtccagctaatttttgtatttttagtagggatggggcttcaccatgttgtccaggctggtctcgaactcccaacctcaagtgatccacctgccttggcctcccaaagtgctggggctacaggcatgagccactgcacctggccacataattttataatgtagcagcaggtactctgtggtttctagcctataatgtaacagttattggtttgatatgttacatttatttaattttgaatctgtggtgtttttttaaagcaatttaacaatgaaaatctcgtcaatgcagcagggatgagatcaaactgactgatgggtaaatcaccagcctaaagggacacgccaggtattagacagtctggcatgtgtagctggagaagtactcaaaaatgtataaaagtcaatgagcacatatacggagaattacacagaaaataataagcagcactagaaagagatgatgtgtgttttttgtactgtccctgtcacatagcatcaaacatccacattcctgctttctgagatgagagggttggacaagtaccctcaagaagctttctggtatacggtacacagtatcttattgttttataaatagaaaaaagagaatacagaggaaaaaattaaaatacatcacctagagttcagaggcattggaggaatttggctttcatcagcaattttgcattaaaagcaagtatctgtcggccaggcgtggtggctcacgcctgtaatcccaacactttgagaggccatggtgggcggatcatgaggtcgggtgttcgagaccagcctggccaacatggcgaaaccccgtctctactaaaaatacaaaagttagccgggcatggtggtgcagcctgtaatcccaactactcagaaggctaaggcaggagaattgcttgagcccaggaggtggagattgcagtgagccgagattgcggcattgcactccaggctgggtgaagaacaagactgtctcaaacaaacaaacaaataaaaaagtgagtatctgtcctaagcaacacattgtcaagtgcggcctatatgatttcctggtggtcagataatgttgcattcatgctttctgtaggaagtggggtttcatgaaacagcatgaactatgaactttgaacgaagagtcacgggcttatccctgactctaggacttagtagcgtggttaatcacagccgcattattaatgtctccagttctccaaaatacggtaaatgacaccataacagatcttttgtaaagctatggtggatatttttaaaggattatttattcatagtaggtgtctgataagagctacttttagacttttggacttgtagataacttcttttaatttcctattaaaatacccaggaaggtacagaatccagtgttggggctcataaaccaataccctaaaatacagcgctttgacatcctgaactgaagaagcctccaggtctctctggccttccactttacccactgtctctcaatcttctctctctcccaagcagacgatgaacttgttcattggagttcccttatctgcccaaactcccagacctgccaaagaagaaaacaatcacctctggctctttccctgcgtcttcagtaactgaactcctatcccaggaacaaagactgaaatctgtcaacacacctgaacagactcctatctgctttgcgggcccaacagatggtcccaggccatggtatgttcttcaagcccactgaattccctaaaaatcagttcctaccccgttaaaatcatccacacttccccatctccctttcccctaagaagaagggtgtatacatctgtcccccagggcgtggtaggtcatcactgtgactctccctcatgcacattaacaaacgtgtatgcttttttatgcctttagcagctgattttcagcaaaacttcagaggaaaaaggggacattttcccttggccactccactagccacagtcctataagctaaagataacagaagttcccctatccaacaatctcaggaaagtttcctttaagttcagcattaatcactgaatgttctaccatctaacaactgtatggcattttaaaaaatgtttaactgaggttaaatatatataatgtaaaatttaacattttaagtattcacttcaggggctacaaagtacatttatattgttgcacaaccatcacgaccatccatctccagaactttcttcatcttctaaacctgaaactctgtgcccattaacaataacgctccattcccgaccctctcccctcagatcctggtacccgccattccgtctctatgaatttcaaacatgaggtgcctcacagaggtgaaatcatgcaatatttgcccttttgtaactaccttatttcacttagcatgtcttcaaggttcacccatgttatagcatgtgtcaaagtttcctttctaaggctgaattccattttatatgtggcacacattttgtagatccatacatctgttgatagacacgtgggttgctctcaccaaatgtgtacaaatatctgttcgagtacctgctggattccaattttggggggtgtatacctagaaagagaactgctggatcatataataattttatttctaatgttctaaggaagtagagagcattttgaaatgtgagatcgaggcctaagcagtcattcttgctaactggaatgctggagtgctgagctggtcatggctaggctgatcccgtcagtggcggacagaaaagcattgacatgaggtctataaaaaaataagtatcagccaggcactctggctcacgcctgtagtcccagctacttgggaggcggaggtgggaggattgcttgagcccaggagttcaaggccagcctgggccacacagtgaaaccccatcacttaaaaaaaaaaaaaaaatagaatagtaaaagggaaaggaaacatcatgctaaagaaacagaactggctgggcgcggtggctcatgcctgtaatcccaacattttgggaggccgaggcaggtggatcacctgaggtcaggagttcaggaccagcttggtcaacgtggtgaaacccagtctctactaaaaatacaaaaattagccaggcgtggtggcatgtgcctgtaatcccagctactcgggaggctgaggcaggagaattgcttgaacccaggaggtggaggttgcagtgagccgagatcatgccactgctctccagcctgggtgacaatagcaaaattcagtctcaaaaaagaagaaaaaaaaagaaaaagaaacagaacaacagcattacctgtgaaaaatctttcaacacagcaaacacaagaaatcttgctctcagtaggacaaaggcaggcagaagcactgtggaagaggggccaggaggggctgagatgagggcagaatgagggagcacagcgagctaactaaggtcaaagaaaaagaaaacaaggaagctggaattatgttaccgagaataaaatagacattggaaagaaataatggaaaaacagttcagccaatgtgtggccattcagaagcatcctgccttgtcggtctaatgctaagaatgatgggagaaggggcttccaatctttttctatgattttttttttgtacctagttaaaaacccactgcatttacagttatcaatgaaactgttctgcttaataccataatacaagtgtctttccaaagttttttgttccctgaggacagaataacaaatgtcagaacatgaacatttttagggcttctgatacatactgttgccaaaagtatcagcaaggtatgaggccatcagcactgccaccattaatttttattctttttttttattttgaaagaatcttaaacttagagaacagtgcaagaatagaatagtataacttattttttcttagctatttgaaagttagttgccaacacaatggcccatcacctccaaattgtgtatttcttatgcacaatgacattgtcctacacctatgaaaaccaggaagttaacattgatacattactaccatccaatcctaggttcaccaatcattccaccatgatccttttcacagcaaaaggttccagttcagaatcaaggcttctgtttgcttgactttcatgagcttgacacttttgaagactagaggccagttattttgttgtataatgcgtctcagtttggggttgcttgatgtttcttcacgaatagattgaggttctgcatctttggcaggagcatcacagtcatgatgctgagttctcatatcctatcacgtggtacataacttcaatcagtcttattactgatgttattaattttgatcactaggttaaagtgttatctgtcagacttctccactgtgaagtttctcattttctctttgaattcctaagaatttgggagtggggagagttactctgagagaatgcatatatgacattcctcagcaaacttaggactttaagcactgaactcacaaattcctattttattcagtgagttataacctattactaccgttattttgatgctgaaattgccacagatttggctagcaggagcctcttcaagctgactcctatgtccttctgctatatcctcatctttggacatttccttactttatgaaacaagaagacatcccaggctcatcttctacttctctgtcccagccctggaatcagccattcttccaaagagcacctttaagtagcgaacagtatttagaagccaaagtcccagactaggtgtgcactaggtgttacagttcccaggtcctctcagtggacacagccgggaaatatacgtatgtggaacacacagacacaaagatctgcatctatgtttatttctacacagctctttctctctgtggaataccaagagttcacaccagtctctctaatgaacagagttttattccagttccttccctttccaaaacaaccagccgtgtctctgttgccctctcctgcccggctgccaggtttccacgtgaatgctctcactcccctgagttcagacactcagctttgagccaaagtggcttccctctctcccaggaccccacgctccacagtcaaggcactcaacttgctctgcctcatctcatgacttttgaactgagctttagagaaacagtaagaacaagacattatcaatttcatagatgagtctgaatattttaaatgtttgccatcatatttctgtaaaaattgtgcttcacgtgctttgtctatttacctatacacacctcattgattttaaactttttttctttgtttacagatggggtcttgctctgtcatttaggctggagtacagtggcaaaaatcacagctcactgcagcttcaaattccggggctcatgcaatcttcctgccacagcctcccaagtagctaggaccacaggtgtgcaccaccatgctggcttttttttttttttcctgtagagatggattttgctatttttcccagactggtctcaaactcctgtgctcaagcaatcctcctgccttggcctcccaaagcactgagattacaggcatgagccaccatgcccagcagatttcttcttgattagtttacgctgtatgtgtgttaaaggtatcaatgctttggcttaaatgttgcagataatttcttgatatcttatttggttcttgacttattttttttaatagaaaattgtattttgttgatttagaaagcctgaaccccttgctacttttctatttcctctgagccccatttttctctgagctttttgcatttctgaacttctccattactctccactccagtgattctcaatcagggctgattttgctcctccccctggaagtctggcaatgtttggagacatttctgagtctgaagactgggtaggaaagtatgattagcatctagtggcaaaggcctaggatactgctacacaccctacaatgcacaagacagcccccacgaccaaaggttatccagcccaaaatgtcactagtgtcaaacgctgctctggagtctctcaaacgctttacagctattcttttgatttcttccaaaacaagacattagaaaagaaaggctaaaagaggaatatttttcatgtaggcaatgactttttctaaatcctaggtctgagttacaaatactggtcatagaaccttatagaatccaaaagcattgtcaaaaagaccaaccaaaaaaaccctatctttgttatttccacaaaagatgatcgtagctgtgttcttgacataaagggactcacctaattcataaagttttaaatctgtgtttgtcatgtggtcaagaattcatatctagattacctaggtccatctgtgctatcttaaatgccaatgaaagaaaaatgtaattattaatttaattttttcaaatcctataaggccagtaccaaggtactaaatgtaaatatatacatacatatatataaatgtacatatataaaatacatagttttaaaaataaagaacagtattacaaataaaattgttgctttcttggaactcaggcctttgaaagaaaatacatatatagcagcatggcatgaagcaatttaacaagatatgtaagatatattagaaagaaaggagatttttctcttcacaaacacaatatatatcttcttggttatagacttgttacttgcctgccagaagagtttactatcatcttcacaagtattcaattctcagaaccaagggatttcacagcctcctctacccaatcaaagcagtgtcttatggggtccgtctgaacgtaatcctgtcctactgacggatttgacatctatttctgccaccattgcacaagaacacagcagactgctgactgcaataagacttatctagaggctaacaggcaagcaaaatctatactgatttccttttcttcagcacaataccttttaaaaagtaccataaataaaacagtgttctcaagacctgtgattttcaacgagaaattactaaacacattggggaggcttcttgtggtcttgatttcctaatgagctatgggaaattacataatgaagagaattcttcttggcttcttaggtttcaaaagcctacaaagtctgtaaattctgtttcctttccaacaaacactaaacctaacttggtattcgaaactttaacctctccatttcaaatgctttagttttggtcctgactcattacaagaaaggaggctgttagaatagcaaaataataattatgatgaaatcataacaataataacagtagctaacacttattgaactgagcgctatatgtcagatagtattctaaatgctctatcggtgtaaactcacatcattctatgataagctacaaagtagatactcatcataataatcagtcgcattttatagataagaaaactgaagcccaggagtgtgaataggtttttctaggttagaagcagaattgaagtcagaaagcctgactgtaaactcatggtcttaaccacttttctggctctctgattcccaccctctcaacttttaacgtgactgaatctgaaactcatcattcattatagcatcaaacctacatctccctcttcttaaggcctacctgcatgagcatgtacctgttcatacagctcccagaacaaacgtgtataggtttgtctaagtaaacagcaaatttgattgtaaacataaaaactaaagagaatatcattgctttgtaaaggtaacggtgaatgattctcaacgccaataccagaaacatgtgacaatcacaaggcagtcaccaatttaacagagagaaggaaagtatgaagtgtatctctcagtctctgatagaagttcctttcttcacctcgggtgaaggtcaggagttccacttctactgcccttgctgtcaccaaacagcaaagttcaaggaagacagaggagctttgaagccttctgacatgggtacagaattctactatgtctttttgtttgagtacaaaatatagctctagcctgaagaaagacttagagttaatcttcctgtggtacagatggtatattctgattcctgatcacccacactgcgccacagagcccctgacacagaattgtctgtagttaagtaatgggaggtgaggaagtggcctcagagaaggactaacgtccacagacttgagttcgtacaaccacaaaaatacctgcctggccaactagccacccagtctagcataaagattggtcatgcagatttgtggaaagaaagaggtccaggaaatgcttcttggaaggcagaacatttacttattcatcattatattattgatcagcctccctacaccctgattaattatcactccattgatgaaaagctatctcaattcaattctattgctttctcagcaatacaggcaaaaattttacatagcaagttttttgtttgtatatttttattcatttttcagcaaatcaaaacccattcaaatggaaaatggaaagatggaaaaatgaaactgtgcatttcaatgtgatattgagcataggatatcagcagctcacttcgtgggttctgtgttgcttcgacattctgtctgtgacctcttggaaggtttgactggtaggggcacagcacttcaaactgtgacataatcagcgtttcctctcctaggttaagagggacactgatcgctggaaacatgaacatccacagcaactaagagtgagcactgctgaacacagccacagactgtggtccttcgttaaacaaatgaaagtctaaatcaaatgacgagagaacgcaaattcatgatcattatgaagcaaatgcattgctgtacttaagacatcagtccctctacagagaggccatcacctctttgcacaagtcaatatgggcaaaaattgttttcaaaaaccaggttggttctcaaacattaaaatgcacatatcagagaaaaatgctctctcaagcatctctatacgaagatgttcattacagaaatgtttgttatggtggaaaatgagggccaatgtctatcaataggagattgagtatgagaactacagtgcacagcgagggggtaagaacgtgggttctggagccacgcagccttgctttaaatcctgactttgacacacactaacagtgcgacctgaggcaacttacataacctctgtaaatcttggtttcctcgtctgtatataaagagtttagtaaaacacttgacatatacgagctcaataaatgttagcaattattattatgctacattatgtatatggacattttaaaaagatagggctgtatctatcagcgtagaaagatggcctgtgtcattgttaagaaaatgtttccagcaaattgtagatgggtataactaatataactctgcatgtgcaaatattgtgtggatacacatggaaagtattctgggacacataccaaattgttacaataaatccctttcaaaaattaggagtggctgggaggagaaggctttcacttcgcactttccatggtgccagggtaataccacctcacaacagtaaatagcaaaaatagcaaccttaactctagattttcttatctaaattttaattctgtgaagaattttccatttccctttttcaaatcaggatataggatgcaatttagaaagagtgagatcacttgttagactgtacgatttttaagcatcaataaagtataccaccgaacttctctaccaatccattctctaaacttcccaatcaggtgtgcctctccatttaggacacaggcaggtttttgttccaactcacagtgtaactgccctggtttcagtatccacggtgaatgagaacagctaagagacacaagtgctgggaattaaagaagcatctacttaaaaaccaagctcttgctaatcagtgagaagagtctcaagagatgatatgctgaaggcaccgagggagagctgtgttggaatgtctgtctgtgcataactgtggtccttcaaaacgagcaattagaaaacagagatgagataatatagctagctctcgcagattaatcaaatgtgtcttgttactagattagagaattcaaagatatgacagagaatattaaatgtctgaaaatgaccaagtgtagctgcttgaatcatttcccccacagttttcagtagaaaagagttgttctttcccattttccaaaatcattactattttagcattgtcaaggaaaaaaaaaggacttatgttttgtacttttcacagtgtagaggatgatgctcagaataaattgtttcactttgggagttatatttactagaagaatgaagctcttgctttccactttaagacaaagagagggacatacaacaaaaaagacggcacgttcaggggctacaggggcgtgagttcaaatcctggatttccaatttccagctatgtatctttggtgagtcatttaacctcagaacccacttcacaggactattacaaaactgtgtgtgtgtgtgtgtgtgtgtgtgtgtgtgtgtgttactgaaaaatatcacccagtacttagtacacacctagtagttgttagctactatttcagagagacttctgtggatggcatatactgatgatttggttaaaaaaataaagaataaagacagttaattctttcaaaattattatatgactatcactgttaggtgggaggggataaaatgaggaactacagagatcactgaatttacagcaaatgtcctggccaggtaacctagaggtcaaattgagatgaaaatcaggttgcttctatcatagtccaatattttttcatactccatcagattctgctttctgcaatataatatggaagcgagaaaacaagaaatattccaggatacagtcacagatgtactatatagcttacattttatctttttcccaaaaaagaggaacctcattctgcctgaacaacaaaaggttaaagatgtattggtggacagcatctaggaagagagatacaggaagtggacagcatctaggaaggagatacaggaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagggagatccaggaagtggacagcatctaggaaggagatacaggaagtgggcagcatctaggaagagagatacagcaagtggacagcatctaggaagggagatacagcaagtggacagcatctaggaaggcagatacagcaagtggacagcatctaggaagggagatacagcaagtggacagcatctaggaagggagatacaggaagtggacagcatctaggaaggagatacaggaagtggacagcatctaggaagacagatacagcaagtggacagcatctaggaagggagatacagcaagtggacagcatctaggaagggagatacagcaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagagagatacagcaagtggacagcatctaggaagggagatacaggaagtggacagcatctaggaaggagatacaggaagtggacagcatctaggaagggagatacagcaagtggacagcatctaggaaggagatacaggaagtagacagcatctaggaagacagatacagcaagtgaacagcatctaggaagggagatacagcaagtggacagcatctaggaagggagatacagcaagtggacagcatctaggaagggagatacagcaagtggacagcatctaggaaggaagatacagcaaatctaattcagaagaaaagaaacagattgccctgaatatgacagtggccatcagaaagggagctgtaccctccacccaaatgtgtcccaaacacaaagacgtctcacatccctctaaaaaccgaaaagaggtaccagtactgtgacggtcattttctggaattcattaattgaatcatgaagagaattatgtaaggtcaaaacactcatacctcagaaaaagctgcgtcctatacactaggctagcccacaccaaccacaaagaaagcacagacagaaatttccaggacttggtgtctttgcaaagacagagactccagccataagcttagcaatgtaccctcttgatgaaggaagtgagcatgatctctccctttgtcatctgagtgatgtatgattaagctcaatagaggtatagattcagtgatgttactgagaggaagcaacagaattttcagtgacctaaggtgctatatgtgagagtcccaagtgttctaaagaaaaacctggcccagcacagtggctcatgcctgtaatcccagcaatttgggaggccgaggcaggtggattacctgaggccaggagtttaagaccagcctggccaatatggtaaaacactgtctctactaaaaatacaaaaattagacacacgtgctggtgggaagtcccagctacttgggaggctgaggcaagagaatcgcttgaacccaggaggtaggttgcagtgaaggcagagattgcagtgagccaagatcgtgccactgcactccagcccatgtgacagagtgagtgagacttcatcccccacccgccaaaaaaaagaaaagaaaatgaaaacccataccagaaaaaaagtttctctttcttcaaaaacagtccttcttttgaccttccctaggtcttgcagaagagagcataaagaagtcttagatcaaatactcatttatatcagtgacttctaagtaattacctgcatctataggatatacagagtttaatcacatacccttgaaagacgcactccactaaacaaaattataagtacacctcattgcgtgtactgagcttcactctgctgtgcttcatggatcttgtgtttactagatagaaggtttgtgaatcctttgttgaacaagtctattagcaccatttgtccaatagcatgtgtgcacttcatgtgtctgttgtcacattttggtaattctcacaataattcaaactttttcactgttctatctgtgatgcttatcagtgttctttgacattactactgtaattgttttggggcaccatgaacagtgcccatatgagacagttaacttaatccatgaatgtgtgcattctgacagcttcaccaacttcattcctgtctctctccctctcctcaggcctccatatccctgagacacaataatactgaaattagcccagttagtaaccttacaatggcctctaagtgttcacgtgaaaggaggagttgcacatctctcgctgtgattcaagagctagaaatgatgaagctcagtgaggaagacatgtcgagaactaagataaactgaaagacacatgtgttgcacaaaacagttagccaacttgtaaatgcaaaagaaacactcttgagggaaattaaaagtgctactccagtgaacacacaaataatcagaaagtgagacagccttattgctgatagggagaaagtctgagtgatctggacagaagatcaaataagccacaatattcccttaagccaaagcctaatccagaggaaagccctaacttgcttaaattctataaaggctgagagaggtgagaaacgacagaagaaacggtggaaagtagcagaggttggttcatgaggtttaaggaaagaagccatctccgtaacttaaaactgcaaggtgacgttgcagcaagttatcaagaagatctagctgagatgactgatgagggtggcaacaaggaaaagcagactttcagtgtagatgaaaccgccttatattgggatgagataccatctaagacttccataactagaggagaggtcaatgctttgcttcaaaacttcaaaagacagaatgactctcttgttagggtctaatgccagctggtgactttaagttgaagcaaatgttcatttaccatttaaaaaatcctacagcccttaagaactgtggtaaatctgtactgcccatgttctaccaatgtaataacaaagcctgggtgacagcatatctgtttttaagcatagtttactgaatatctgaagtccattcttgtgacctactgctcaggaataagattgctttgaaaacattactgttgattgacaacgcacctagtcatccaagagctccgatggagatgtacaagaagacgaatgctgttttcttgcctactaacacaaaatctagtcttcagcccatggatcaaggagtaattcaactttcaagtcttattatttaagaaatacattttgtaaggctatagctgccatcaatattgattcttctgatggatctggggacagtaaattgaaaaccttctggaaaggattcactattccagacaccattaggaacactcatacttcatagaaggagatcaaaatatcaacattaacaagagtttggaaggttgattccaatcctcatggatgactttgagggggtcaaatcttcagtgaagaaagtaatcagaaatgaaaaacaaggcattacaactgataccacagaaatacaaaggatcattagagactgttacgaacaacaatcttgacaatgctgacaaactgaaaaacctaaaggaaataaatcctagacatacacaacctaccaaaattgaattaggaagaaggagaaaacctgaaaaaatcaataatgagtagtggaagtcctagtcagagcaaccaggcaagagaaagaaacaaagggcatccaaattggaaaaaaggaagtcaaattgtccctctttgtgaatgacataatcctatatacagaaaaatctaaagactccaccaaaaaactctttgaactgataaatgaattcagtaaagttgcaagatacaaaatcaatatacaaaactatacatcaataacgaagtagtgaaaaaagaaattagaaaagcaattccacttacaacagctacaaaaacataaataaagtatctaacaataaatttattgaaggaggagagagaactctagaaggacaactatgaaacactgatggtagaaactgaagagaatacaaacaaatggagatgtcccatgcttataaattggaagaattaatattgttaagatgaccatgctacccaaagcaatctacagatgtaatgtaatacctgtcaaaataccaaaccacatgtttcacagaaatatttttttaaatcctaaaatttgtatggaaacacaaaagaccatgaatagccaaagcaataatgagcaaaaataacaaaacaggaagtatcacactacctgacttcaaaatatgctacaaagctataggaaccaaaaccatatggtactggtataaaaacaaacacacaaaccattagcatagaatagagaacctagagataaattcacatatttacagccaaccaattgtaaaatgtgtcaagaaaacagactgaggaaaagacaccctgttcaataaatggtgttgggaagattccatatccaaagcagaagagtgaaaggagaccattatcactgtatacaaaagtaaactcaaaatgaattaaagatttgaacataggacccaaaactataaaactactagaagaaaacacttcaggacattggtctaggcaaatattttatggctaagacctcaaaagtacagccaacaaaaatagacaaatggcactatattaaactaaaaggtttctgtacagcaaagaaaacaatcaagagactgaagagacaatctgtagcaataaatatttgcaaattacatgttcagcaaggaattaatatccaaaatataatccagttaaaaagtgggcaaatgatatgaatagaaatgtctcaaaagaaaatatgcaggccaggcacggtggctcatgcctgtaatcccagcaccttgggagacagaggcgggcagatcacctgaggtcaggagttcagaccagcctggccaaaatggtgaaaccccatctctactaaaaatacaaaaaattagccaggcgtggtgacacacgcctgtaatcccagctacccaggaggctgaagcaggagaattgcttgagcccgggagacagaggttgcagtgagccaagatcctaccactgcactccagcctggctgacagagtgagactctgtctcagaaaaaaaaaaaaaaaaagaaagaaaaagaaaaagaaaatatgcaaatggccagcaaatatatgaaaaaatgttcaacatcactaatcaccagggaaatacgaatcaaaaccacaatgaaatatcatcttaccacagttaggatggctgttatcaaaaaaagaaaagataacatgctggtgaaaatgcagagaaaagggaactcacacactgttggtgggaatgcaaataggtacagccactgtagaaaagagcacagcatttccacaaaaaaactaaaagagaactaccataggatccagcaatcccagcactgggtttcctttctttctttcttttttttttttttttttacaaaagaaaggaaatcaaagggatacgcacacccccaatgcgtattgcagcactattcacaatagctaagatactgaatcaacctaaatatccatcagtggatatttaactccataaaagacatacaagtaacaccactctactttcacgcatgaagcattaatggataaagaaaacatagatacagacatgatggagtactattcagccatagaaaagaatggaatcctgtcatttgcagcaacaggaatgagcccgaaggacattatgttaagtgaaatatgtcaagcacagaaaaacagatatcacatattctggctcttatgtgggagcaaaaaagatgttgttttgtgctcatcaaagtagaacttgtgggtattggaggctgggaaatggaagaatgggagggaggttgtttgatggatacaaaattacagttacatagagaggatggagtttgcgtgttctgcagcattgtacgctgaatatgctcaactgtattatatttttcaaaaagttagaggagagtattttttaatgttcacaacacaaataaatatttgaggtgatggtatagtgatcactctgatttgatcattacatattatatacacatatgaaaatatcactctgtatcccataaatgtgtacaattattatgtgtcaactaaaaaggaaaaaaggagttgcaccatcgccacacctgtcacatagatcataaatacaaacccgcacacaaattacgttatttactatgtatcattgatgtcagagccctaaaaagccttattaagcctcttgactacagttttcaaacttttttttgcagtggaacgcttacatcaaacaatgttacgtaaatcccaaaatagaatcccccagtaacagtgatctcatgaaatcaaggcaaggcatgtggacgtgtttagtgggggtgcacaagcatgcctgtgcttgtagggagaggacagggctgcttccccaaaacactgtttgaaaaaatcactgatgtattacaagcttcttattcccagacaaacttagtatggaatcacctgccaggtaaggaacttgcttatacataaagtgagggctatagactagaccttttatctgtatgtttctagcaatgttttatgacactattatacagggttttcataggaaatcacataaagaaaggaccattgatacgataatcattataataaatcatactaaatgatcttggtagcaaactagttgtcaagcaaagaaggattatgggtttattcagaccaacttctggaatcttatttaggtattaaatatatattaaatatcaaggtcagaaaccaaatgaagtattaactggcaaaatccattattacaatagaaataacattgatccctggaaataaaaattatttcagattaaaaagaagttatggggccaggcgcagtggctcacggctataatcccagcactctgggaggccgaggcaggcagatcacgaagtcaggagatcaaaaccatcctggctaacgtggtgaaaccccatctctactaaaaatataaaaaattagccaggcgtggtggcgggcgcctgtagtcccagctactcgggaggctgaggcaggagaatcgcttgaaccagggaggcggaggatgcagtgagcagagatcgcgccactgcactccagcctgggcgacagagcgagactttgtctcgaaaaaaaaaaaaaaagttagtgaagaagctgatttcaaagggttttactgctatgaagataaaattaggttggtttcattctagctttattgtagtctgcagagactaaattgaaatcagccattttaattcagaaacaatatttaggctgtagaaagcagagtgataaccaccctgcctttgtttaaaatctctgagacagaagggatatttcctgtagcagcataaattacagagactctaaagttacgttgaaacgacccttacaccctcgaagcaacgtgcaattttgtggctgtaattttctcaaactgcttaataaaaccttctcctttttatcagaaaaaaagaataaacaaaataccaagaactccataaaaggcatacaaggaacattactccactttcagccatgaagtattaataattaactgttgggcaggcaaactgagttagcagtcttttcccacaggacatcttcctgtcaaaatgtcacccagaaataaccctgtagattacaggaaggggctgcaattccccacagtgcatctcataaccataaatggcctcagagtttcagtacctgtcatgatcaggtcacctaacacctgggaatctctcactctccccctcctctacccacatatttgccgctaacacaccaataattgatagtatctgcatttctgagcattaccagccatgagctgcctgccctagcactgaaggagagacagatggcagccagacagaacgggatggagagctcatatccgagtcctggctctgcccttgattcactgagcaacaacctctcaccaaagatgggatcataaagctccattccctcgcattcaaatgctaggaatcctaatttgataatttctaccatgaactttggtgtcttctgtactcatatttgctttctgctcttttgaggaaaaaaatcagatacaatattgtgactatgaaatcatcttctcatttttagtgattcaaggtcaggtgaaaacagaaccgttagtttccattccaaacactgatacatgtaaaaggttatatactttagcagagtcctcactggaaaagatgtagatttggagagttcaggcagacatgggttcaagtactggctccactacttaactagttatgtaattttgggtatgtgaactaactactctaggctttaatttcctcaaatgtatataataagaatgataatcatgaatgctttagggatcgctgcaagttgcaagctaaacctgctaaatatgcaactagcatacaaccgagcaatttgcattcctgagcatttatcccaaagacatgaaaaaccatgttcccataaaaccagtgcatgaatgtttacagcaactttatttatagtaataaaaaactggaagcaacacagatgtccttcaaagggtgaaaggttaaactgtggtccatccacaccatggaatactaattggtaataaaaaaaaaactagggataagggcaacaacctggataaatctctggagagttattatcctaagtgaaaaaaaaacccagaaggttacacactgcattttctatttatacaactttcttgaaatggcaacattagagaaatggagtacagattagtagctctacaggttaaagagcggttgggatgtaaggaaagtgaatgtatctataaaagggcaacgtgaggaattcttgtggtgatagaaatgccctgtttcttgaccatatcaaatgtcaaaacatcaatgttctggccgggtgctggctcacacctgtaatcccagcactttgggaggccgaggcaggcggatcacgtgaggtcaggagttcaagaccagcctggccaaccatggtgaaaccccatctccattaaaaatacaaaaattagccaggcgtggtggcgcgtgcctgtaatctcacctactcgtgaggctgaggcacgagaatcgcttgaacccaggaggtggaagttgcagtgagccaagatcacgctaccgcactccagcctgggcaacagagtgagactctgcctcaaaaaaattaattaattaattaaaaaataaattaaaaatttttttaaatgtcagtgttctggttgtgatagttttacagttttgcaagatgttgccatctgaggaaactagataaaggttacaaagtcctctctgtgttctatcttacaactgtatatgaatctataattatctcaaaaataaaaggtttacttcaaagaaattaaaataatcatatttcagaatatcactgcaaagattaaatatatagaattgagcaataatttaaaaattattacgtatatgaaaaattgcctagcacagacagttcttggcaataacagaagctcattaaatgttaatttctttcctctaagaagttgtacatagacagaatgcatcctagtagatttttatttgtggatcaaatgaagacgtaactccatgaaagggtctgatcataacatacacactttttggaacatttagcctttttttccctatgaatctgaactttgaggaagtattatttcacgctaaataacattcatccacattcctacagcaaaactgtacaactcaggtgccaactaatttcttccatcaaaaaatatgaccagtggagcaggttgtaggggattatgatccagttggttaagagtcacagtcaaaaaagatgaatcaaggccaaaaattaattggcatgctcttttacagacaatgaagaaagaacatgaaaagaataaagcttggtttcatgtgctcaagagttcacagctagttaagacaggaaaagtctcatatatgaagactcagagaacaagtggagaacagaccatcagtgcaaaaaatctgcagaagaggtggaggtgagcatggctgggggcaaatgagtgcagaagagggaggtgagaggtgagcaaggctggggcaaataagggaattgggggctgctggctccacacagcactgtcggactgcgtgaagaactgatggcagacgcacgaccttggccttctggaggaccgcggcaatccttagtactttgccgacgctgcaatgtaatcccacctttcccagagttctccatcccctgctgccagatccctgccgcacaaattcgcttgtatgaagctcctggctactttataagtatactttataagagaaaatacagacacacagacaccttcctcccccaatatatgcagacagtatgaagcgtcatagtgttccggcctcaaaaataaaattaggaggaaagcctgtggcacagcaaacgtctccccagcctcccacctgaccctacccttccaggtcactgcctcaggagataaaatcacccaggaggccctgtttaaactcaattctaagttaaggcctgaaaggatccatacactgtccaactctttttcatgccaaaattaatatagtaaacatatctttgtttcagcaatcaaaacctggcaatttgccatgtcaacccccattccacagccacgtgtctgaagaacatatgctttcagaatggcgtttatgatctcaatgccatcttgctgcaagccttccagctaggatgttccctgtagttgaaataaacggaaaggaagtttctgagttgaagtaaaccgaaaggaaggagggtcacagccccgcggcacagttcccaggatgactgctgtgccactcacaaaatgagccttttgactgactccagcagcaggacgggactgtcgtttcacgaggtgagctacgggcagacagatgtatccgaatcgcattaattggaacatcttgtcacaggataagagaatttccatttctctgcggatgcctgtatgctacacatggtatctggcaggtgtgagaacctcgtctttgattgcctatattcccaatctcctttctttgcctattttcctgctgcaaagcaattacggctgaaaatcagtctgcaacatgcgctcatccatattcaactctttccacttcaggcaaatcttgcccagaaaaaaaataataaaagagagagacttataaatccagatttgtcttttattttgatcctctgattgtccaggtgtttacttgttgataatccaccattttctccacatcaaaataaatattctaaagatgcagctctaaacaactaaagcatgtacctgtcttaagtgacaaggagggatgacacacctacaaaactttcaataaatcgaaccaacagatgggagcagccagaaccagttgaaagtgcaaatgacggagcatttaaaaaatatacagtgtcattgattttaagtatgttgaagaaaaaaatttaagaaacagtacctgggacttataccaacaggccaaggttaaaattgggttgaagaggagacagggcttcctcctggaagtccttcaagttatcatttcacattggatttgccaatcagcttttcagatcttatctgataattattgaaagccacaggcagggactagaattttgagatgtttctcaaattttcagatgaaagctgtttacctggcccttaaggagattttaaacttattttaatcagtattcaaaagacacaacaggatgaccatccccccatccacccccgcagtctccttctccagaggcatccaatttcatcatttcttgggatgttattttatacatacacaagaacatgctttatatcttccttttcttcattttttacacaaataaccataaactacacatcctattttattttctctgtactcttctttctctcttttttttttttttgttttgttttgtttttttgagacggagtctcgctttgttgcccaggctggagtgcagtggtgcgatctcggctcactgcaagctccacctcccgggtttacgccattctcctgcctcagcctcctgagtagctgggactacaggcgcctgccactaagcccggctaatttttttttttttttttgtacttttagtagagatggggtttcaccatcttagccaggatggtctcaatctcctgacctcgtgatccgcccgcctcggcctcccaaagtgctgggattataggcatgagccaccacgcctcgccttttattttattatcatcatttagttatgaaagccaaagctgagacaaattctctgtactcttaatggcataactgagcgttgatttcatatgaggacacaaagagcttcctcatcgttttttatggcttcagagaattcccttgaatggatgtagcataatttatataaccagttccctacagatagacatttaggttatctccattgtattcctattacaaacaaggttgcaataaataaccttacacataggtcatttcatgtattagctaaagtatcatgtattagctaaattcctataaatgtaattgctgagtcaaaggatatatgaatttataattttgaaagatattaccttcatatatacatatctgtatctatatagtacctgtttccctatacccttgccaatacaaggtgttaacattctgctgtttgccaatctgataggttaaaagtgacatttcagtatcatattcatttgcactgctcttattatgaatgagctgaggagcttttcatctgtgtcataggaagctcacccctgaggacagcatcacctggactccctcctctgataacttctgggaggcactagcaggaggttagcaggtggaaggagagatatctttcccatttccatcctgcttcaaggacatatttctcacagtggctacatcctccatgatcacagccttcttcggatgacccatctttcctgctccggcaatgccgttctctctctttgtccctgccttcaatcccagggatagtaatagcttcccacatttgcaggtctccgagcgtcacaatgtcattccctttttgtccccaaaatcctgccctcacctctgtaagttgccccatttggggagaagaagcatttgtggagaaacctgtttgctattgctttgttttcctgagacactaacaaacatatctcctgcctatttttctactggtttgttggtcttttcatattgatttgtagttgtagcaactccttattcatcagagcaagagttggcaaacttttctgtgaagtgccagataataaatactgttggttttgtggaccataaggtccctgttgcagctattcaattctgccaccatagggtgaaagcagccacaaacaatatgcaaacaaatgagtgtggctgtgttctaataaaacttgattgataaaaacaggcagcaggccagatatgggccttgggctgtagttcccaaccccagcattagggaaattatcttttctctgagatataagctgcaactatttttctcccagtttagttttttacttgtcttatagtggctttgccatgcagagttttaaagatctcttattttacgtagtggaatttatccgtaatttatggcttctagtttttatgtcagagggaaagcaaagagttagtaaaaccacaggaaactcaaagaggaaagactgtaccttaagctagtcagaccatgctaccaccaagagtcttcttaatgagacaactactcatccttctaagacagaattatcaaaaactctttcttaaaaagcaaacgaacaaatgaaaactttcgacggaaggctgagacacaaaatggagcgagcatcctggtgggagccaggacgtacctatccacatgtgcctcgggtaactctcaggccactgtattctagacgttaaaaaacacttctcgacacaaatacgaatcctatcaaaagaaaattagaaaagtgttttctaggtgatcgctgtataaaaatttcacaaatcacccattctatcaggctttgcctagctccaacatctttccgacatcagtgacatgggggcatctgttagagttcttacaactaggggatctctcgggatttccacttcatactcattcttctgttcctgcatgactgtgctccagggtctaaaggctcctagccttagtttgtaatgaatttagtttttgcattctataaatttaaaacaaatatctttgtggaaattttgtaagtagaaacagggaaagtaaaatgttgccaattaaaatacatgttatttgcataaaataggcaagactttcaggaaaaaaacactggggaaaggatgggaaaaagaacaaacaaataaacaaaaattggccgttcaagtctctaccagagtttaatattttaaagtcacaatttcctttccttgttttctcctaccatggagaagcagacacagttataagtgaaggaacaaaacatagaccgtggaaatttggaggtttcagcatggatttgcatcctaaaaaatacaaatagcaatgtgtaataacaatttaaaatctctcttgttgaattacaaaaattatcctggcaattgtagtcggttgctctgtcctgaccaaaacaaagttattcatatttatatgccctcatccccatatacatgcatattgagatgtatattttatttatatgttcatctagatgtaaacataggtatatgcagatatgcacccaccacacttcactatactgtctacaacatgcatattagaaaatgtgtatttaccgaaaccaacatataaaaccaaagtggcaaaggctttggggaataagaaagacacagctctgtaataagtctaacacctgtgaatgatctgtagcagccttcgaaatgtgggattgctgtatccctcaaactgatactacaaactgagatttcatgtctccatttacacaaattgattccataaattctactaagcgccaatgggtaagactcacagcatgtgagatcaaaagagtaggagtaactggcgacagtttagttgagccacaagatgacaaacatcagtcacagggtagtaaggaggggagaatcatccagagaaaagccgtggagaggcgttttctcaattgattaggtcatgctgtaatggagccaagggcgcaggttcagtactctctgccaatgacctatattgtatttcaaagacacagaccaggcccaatagttctcaacatcttgccactagatcaaaagggatatgagaagaagagtggctaagcccaagcttatttcaagtactagaaaagtaacaacattaacgcagcattgattagtaccattgtcttagcgtaagttacagttaacgtccgacatgatctgtgatgtaatagaattaagtaagacatttctcccggctagtattaaactgtatttattcagtcaaccttacaagatcctatcatgaaacagaaatagcattcacttttcaaatagctgtattctaacacgtggtttgcaattaatattgggctgttttggatatttcctgtattacatatacaaccgggatattaataacaacaaagatgaaaacagaagaggatttatgtagctccggaggggttcaataagtaggaacatgacccggattcaagcttcctggcacagacaccccaccatcacagcttattcagaaattaaatacttgtgcttcgccaccacaaacgcaagtgctgccgcttatcttttttctcacgaaaatgtgaccttgggctcagaatggtgctgacccaacgtctcacttctcttagaagaagtatctcaatgaagctgatgctgccgtctgagcactgctttctcgtaggaatttgccaaattaacccaaaatgcagccagccaccaaacagagaaacaatttaagtttagccacgtggggataaatccttctggatgtcaaggtcctcagctggggcttatattaaaccagtagttaccgactccattccccagaacaaaatgactcatggggctcccgtatctcctttcatttgaaaaggtgctgaggtggtaaaatattctgaaaactcctgtagtcattgattcctcagttcttatagagcgctagaattttgtggtctacatgtcactgattgtaacacatcttaatatttgctgcttagaaatatgtttgaaaatcatgtaaaatatcgcacaaatagcaaataactagaagatagatggttgtgtctttttccctctctgatatatataaattctccaagaaccacatggtagaaaaaagacagatatatagtcacgcactgcataatgacatttcagtcaaggacagaacacacatacaatggtggtcccataagattataatactgtatttttactattccttttctatgtttagatacacaaatacttaaccttgtgttaaaattgcctcagcattcagtacagtaacatgctgttcgggtttatagcccaggagcaagagacgatacttcacagcccaggtgtatagtgggctataccatccaggtctgtgtaggtacctctatgatgtttgctcagctatgaagttgcctgaagatgcacttcccagaaaatattcccacccttaagcaacacacgctggacccaccatcctgagggtggaaagaagctctttagagtccccacagagtgaaatgacttcatgtttctcactctctctcctcagtgcggacttcaaaataaaaatactaatcatcaaaagacaaaattctgcatatgctgaaacctacataacagcattctgaagtttctaatagtaagtttcttattagcttgtcccaagttaaacttcttttgtgaaaggaaagtctctgtgtgtgtgtgcctgggcatgtatcccagtgttgccagggccctacgtcgtatgcacacgataagtccaagacctgtagtgggtaaactcagcaatgttcatactctctaagtaggtaacgctaaaggaagagagagaaaaacattcatagcctgagtgatcacataaactgggtatatcagaaaaatcatgacttctggttctggaagagaattggagggggtataacctctcttccaatggacggactcagagttatacctagctcaatctagatggtatgtaatctttattgggaaaaaaaaaaagggtgactaaatacatacgctttaatcataatttgtattcctagatgaaactaccaataaaaattgctacctgcgtatttcctgggcccttatgaggtacactctgaaacactttttctaacactctccaccacaaaattggttttattgctttcatttcatagttgagaaaatgatggattcaaaaagattaagcaatttgttcaaggtcttatgactgataagtcacattttgaggatgggaccccaagtccatttgatttgaatgcccataatcctctaactgcagaaagcttcaagttttctgtgtgttctggaaggcacagctacaaagaaaagctaatatttccctctaaattctacctttatatagctcatcatttgaatttataacactctccagcagtaacaaatacttacgtttctctggattcacagatatatactaaatattttaagaatggagagaaactaagattggaaacaaattaatatgacaggaaaaaaactgtggaggaaaatccatgggaacgtataagaatataactgtaattcaagagccacatactcagggtttgtaaaaattcctaactgcagattaagcagtgaggagctcagcaccttccacaggttcacactccaagccacggagcactcagtggcaccggtctgctctttgggaacaccgttcaattacctctctccatgtaaggacttcgcattattagtgaaccgattctaacacaggaacctcctatgatgtcttaagttcagaatatttctccctgatcaccccagaagaaatcagagctgcgttaatcaatcattctcttacacggtttcctttgtatagaaccactttgcaccctttttggtaagttacctccttcttaatcttcaggactaagctcaacacacacttcaaagcctttctgaacccattctagtatggctgccctgttttgtcttcccccaaccccagaaaccctgtatttaccttcaacaaagctttgaccacacattctctgctatgttttttactggagattaattttttactcattttgttgaggctatttccaggggctctgaatagtggctactcttaataaatacgtaaatatactcttagggataaatgaaaaatcaaatggtccgagtggcctaacacaatttccagaacacactgggaaatgtttgtctcttttttcagccattgtcactacttctttatccccacctctatctacacataaataaacacatgccaacacctgcacttaagtatgcacatgtacacatatacacagcatcgattactccatggattaactctgcttcatctactacctttcatgtaaaaacaagacaaaggaagaaatttaagaatttatgatattcacacaaaatcacataatctaccaaagtctcctcatgcattgcctttattcagactaatatttactgagcacacagtactatgtaaagcagtagaagccaatcaattaaaatgctcatatgttctgaacataaaatgcttcaacacccactacagacattcagaaagatccaaaaaagcaaaattaagtcctgcccatattgaaactatatcttgagatagaaccaacacaaccaaaacaaggtgactattttaagatgaggaatggctgggaacacaggaaataacccaatgggacatgagtgtggctctcagcctttggacagatcatgtgacaacaaataaacacacacgttctcctgcagggcataggtttctggtgaagaatcagtggtgacttggagcaagacaccagatgataatttgataaatgctgtttacctttaaaatgtgattaaacagcatttatgatgaacatgctcagccaatgatgaataatatgtgcagtcaagcacaacagaaagtaattgtctgaggaggtagttcttccctggcagcttcccaaagctctcacagcgtgccttccccttcctcccaaacactggagttggagttagagccctgccagaggagaaaacctggctacagagagtggactggataatgactcgcaccaacagtttcggggatctccaggtacagggaagcctgttcgcacattcacctttaggaatattcaggactcgctctacctgctgcagtgtccgcacgtggttcctggtgtggtttatttttctctcacacctcagtgaggttctttcacagcctctttagtctaagatttcaatttttaaaacggagagagatcattccacaaaatattatatattccagttttcttctaattcaacagttctacgaataaagaccaacttgaactgattcacagtgcatttttataaattaagaggagtttctgtgcaaaaaaaaattcattacctcaatttagttctcagtgcaaattataatgattcctggttcaatttatagaaaatagtttaaacaactccatgtccatacacaccaaaataacatgttctgggtaagatacacaggtgttcatacagtaaacatgagaactccatgtcaaatggagatatcgcatgatgtctattttaccttcagagaaatgtgcacaaactgggtaatgatgatgccagtacaagaacttgcaaataaatgggttgtttgggcaagaaattttgtaggtacgtaaaaccagaactaatttatagatcagtcaggctccgtctcatgcttggcagagaggctagaggtcactggtcactgaggaaaaaaatgcttacaaactgatttccagcccagttagcaattttaccagaactctttattctatcaaggctgcagaagagaggtaatgaggtcccatatgtacaggtgtgcaacaaattaggtcaataaatatgtctgttaaaaatacttaaataggaaaggtaaaaattacttaaacatgataagaaccattcagcaaaattcaatagcagacttaatgctcagtggtgaagtgttaaagccatttttattaaaatgacaaactggactaggataaccattattgactctttataaaatattgctttgagagtataaaatacctaggaatccaacttacaagggatgtgaaggacctcttcaaggagaactacaaaccactgctcaacgaaataaaagaggacacaaacaaatggaagagcattccatgctcatggataggaagactcaatattgtgaaaacggacatactgcccaaggtaatttatacattcaatgccatccccatcaagctaccaatgactttcttcacagaattggaaaaaactactttgaagttcatatggaaccaaaaaagagcccgcatcaccaagtcaatcctaagccaaaagaacaaagctggaggcatcatgctacctgacttcaaactatattataaggctatagtaaacaaaacagcatggtactggtaccaaaacagagagatagaccaatggaacagaacagagccctcagaaataatgctgcatatctacaactatctcatctttgacaaacctcacaaaaagaagaaatggggaaaggattccctatttaataaatggtgctgggaaaactggctagccatatgtagaaagctgaaactggatcccttccttacactttatacaaaaattaattcaagatggattaaagacttacatgtcagacctaaaaccataaaaaccctagaagaaaacccaggcaataccattcaggacataggcatgggcaagacttcatgtctaaaacaccaaaagcaatggcaacaaaagccaaaattgacaaatgggatctaattaaactaaagagcttctgcacagcaaaagaaaccaccatcagaatgaacaggcaacctacagaatgggagaaaatttttataatctacccatttgacaaagggctaatatccagaaactatgaagaacttaaatttacaagaaaaaaatcaaccccatcaaaaagtgggcaaaggatatgaacagacacttctcaaaagaagacatttatgcagccaacagacacatgaaaaaatgctcatcaccactggccatcagagaactgcaaatcaaaaccacaatgagataccatctcacaccagttagaatggcgatcattaaaaagtcaggaaacaacaggtgctggagaggatgtggagaaataggaacacttttacattgttggtgggactgtaaactagttcaaccattgcggaagacagtgtggcaattcctcagggatctagaactagaaataccatatgacccagcaatcccattactgggtatatacccaaaggattataaatcatgctgctataaagacacatgcatacgtatgtttattgcggcactattcacaatagcaaagacttggaaccaacccaaatgtccatcaatgatagactagattaagaaaatgtggcacatatacaccatggaatactatgcagccataaaaaaggatgagttcatgtcctttgtagggacatggatgaagctggaaaccatcattctcagcaaactatcgcaaggacagaaaatcaaacacagcatgttctcactcataggtgggaattgaacaatgagaacacttggacacaggaaggggaacatcacacaccggggcctgtcatggggcggtgggagtggggagggatagcattaggagatatatctaatgtgaatgatgagttaatgggtgcagcacaccaacatggcacatgtatacatatgtaacaaacctgcacgttgtgtgcaggtaccttagaacttaaaatgcaataaaatatatatatataaaatatatatattttatatatttttttaatatatatattttgctgatgtaagaagaaattttatatacatatatgtagcaggtgatctttatttacagataagattacataatttgaaaatccaactttaataaaaaatccaactctaataagagaatgtacttagatacaaagatgtaagacaaatatacaaagaaatcattagttttctctgtaccagagataaacagctagaaaatcaaatgaaaaatattttataaaaagtagcaacttatatcaaatgccacacagtataaatttaacaacaaaatatatataaactctatataacaaacagaaaatattattgaaagatataaaataccatatgaacaaaaagataaacatatgttcctgaagaggaggttactttcttaaaatgtcatgctttctaaacttaatacatacatttaattccatatattccaattagaatccagtggtattttttcttctccaacttggtaaagtaagtttaaagctcatttgcaataatgtccatacagaacagtaaagaaaagtgtgcaaaagaatagtgggagtggaattgtcttgccagataccaaacttactacaaaccatggggaaaaagaaaagaaaagagaatgattctagaacagggacagaaaagttgaacaattaaccagatagcacagaaaaaagccaagtgttatgataactttaagccaagtgttaaatcactcaattgtgacttttcaattgagtggggaaaagaaccatttgtataataaaaaggcattagcatatgtgcatctccacctgtggaaaaaagaaagctggattgtattacctcaaagcatacacaaaagaatttctagatagactaaatatctcaatcttaaaaattattcaccagcctgggcacagtggctcatgcctgtaatcccagcattttgggaggctgagggagtagatcatttgagcctatgagttcaagaccatcctgggcaacatgatgaaactacatctctacaaaaaacacaaaaaaatcagccaggcatggtggtgtgtgcctataatcctaactactcagaaggctgagacaggaggatcgcctgagtcaagggaggtcaaggctacagtgagccatgatcctaccactgtactccagcctggcaacagagtgagaccctgtagcagaaggaaaaaaaaaaaaatgtgaaaataattatatagctttgatataagcaaagatacccacgacaggaaacccacagggcattttttaaaaaaacctacatagtcatattccagtgtaaaaaatgtaaaatttgttagtaactgaagtcaagagacaagtgacatcctagcgaaaatatccgtaaaatgttgaacaaagtgttgatgtcacaaagaacacctataaatcgataaggaaaagaccaaaaattcaccatgaaaatgaaaaaatgaatagtacacgtgaatcacaaaaaaggaattgcaaataaccagtatataaaatggtcttcaacctcaagaacatgcaaactcacgttagttaacactatttacccagtagattggaaaaatatttcatttcaagcatttcactggtaaaatacattgtgggtgaaattataatccattacaaacaatatttcttggggaaatttggcaacaccttctagaatataaaattcacgtggccttgaagaaaagaaaattctactttgaagagccttttcagtcaaaataaaagggccagtgtgcaaagctgtatgcactagaatgtctatcgcatattttagtgacaaaaaagtaaaaatactgggtccattaatggggcatgactgaatatatcacattacagccatttctacggaacataatgcacacattatgcaaaaaaactgtattttgctgcagtgagatgtaatatagtatacagtagtaagggctctagaggatggaagcccgacagcccattccaagtctgggcttcaccacttcctaaccttgtgaacttcagcagcctccttaagttctctggacccgtttcctcatcagcaaacagggagaatgatagcaacttcacaaggttattgtaaggctcaaatgagataaagtatttaaagcaaaaaaaaaaaagtgttcttaaaatcaatttcaagaaaattaagtcacaaagtaatgtctgttgtgggattccttttttgtcaagataacagatcttatctcacttaccattgcctgaacaaaccaggacattgtccatctgggatggtttttgtccaaacaggaggcgatagttattaattaaggaagcgagactgggtttggactgtggcatacgacgagaggatttggctagttcttagtaaaaggagaccatagcaggcatgcagcattatgtacagatgccctaagagactgagaaacaaggaaaatggggttggaggcattttgaggggaggagcaagtgtgagcatgagcccaaccctgagatccttcaagagcccagttctagttgcaggccacaagtatcctgacaataaacgactctgtgcttcttagactctgcaaggggaagacttatcaaagccacctcacaaaaaacagagtcgttaaatatatactatgtgttttttttgtttgtttgtttgtttgttttgagatggagtctcgctctgtcgcccaggctggagtgcaggggtgcaacctcagctcactgcaagctctgcctcccgggttcacgccattctcctgcctcagcctccccagtagctaggactacaggcgcccgccaccacgcctggctaatttttttttttttttgtatttttagtagagacggggtttcaccgtgttagccaggatgatctcgatctcctgacctcgtgatccgcccatctcggcctcccaaagtgctgggattacaggcgtgagccaccgcgtccggcccatactatgtgttttaaacacaaaaaacacagtatgtatttaacagacgtcaactgcgctgtgccagttcagctaggctaggcttctgcctgtaactgaaaaacaaactagcatttcaagtaaaatgagtaaaaaatataaaaacacattgtaaattatcattttctaatacttaagtcagcttatgagattcctcccacacctactcagtggctcacaaaccctcggaaggaagaagcactgcataacccatctcaatgtttcagtcattacttaccacttcaatagcccactaataaacagtggtttccaccaagataaaatatacaaatttttcaatagacgtagtaaatactgaacaaaagtaaacagaagttgactataatatcaaaaagcagtaccatttagtattagtctgaaagcaactagtgaacgcattaatataaccaacaaacaacctttcacgaaatacttagagattagggccataaactacaagctagtgttcttttcactttgaaatgaaagatcagaggttccatataggccttaattagactcatagtctagaatttttctttctttctctaattaagaggatcacgcaaaaacactgaagtagtagtgccaagatgattccagccaggtagcccagtgcaacacacacaaaaatagttcacagagataatgttacccaattatgaattcagagagactcaatgtacaacatatttcttaagacacagctacaagacagagagtagggcatcatccataaaaggttgggcaaaagatgagggcctcaaagccaggccaaactgggtggtttttcacctagaataatataaggtagtctgcctagaggaacaatctctatcactgttgaggaagaaagccaaggtatataaatgaagaagaggttctaagtgtcaggtccaacgtaaatggtgaggtcataaaaagcaaaaggaatttctaggccagacatgatgaagatgagaaattaaggggtatgaagataacaaattgggtctttgtaagcaggttagaactaaaatggtgaacgctgagactgccggaagatttttgttgtgttgtaccagttggatagtgtgtttgtttgattatgcaggtgcacacatgtatataaacaagctgggaggtagcgagctcctcccaagaggaggtgtaagtttcatggcttaaaggagtcaggcaaaaccaatgttccacctaatattaactatcaaattatattttaatattgtcccttactgaataacaattcaggattgcttgggaccaatagtaaactgattgaaaaaattatccaaatggggataagctatgaatgttactaggatcatatgatgagaggtaaaaggatgggcaaattcaaggctacagacacaacttgattcagaaaatatgaaattacgaagaggaagacataccaagtactattctttggaaagatgagatgtttgttaagcagagcttaatattaacttctttttttttcttactcctttttttttttttttgagacaaggtcccactctgccacccaggctggagtataatggcgcagtcacagttcactgcagcctccacctcccaggctcatcacctcaacctcctgagtagctgggaccacaggtgtctcccactatacccagctaatttttatatgttttgcagagacagggtttcaccacattgcacaggatggtctcgaactcctgagctcaagcaatccacaagcctctgcttctgaaagtgctgggattatagacatgagccacctcacccagccaatattaacttattttttaatataacagactagggagtaacacagaagttggtcctcatatctaaaacagagtaaaaatactcttgactatttacattcaaataatgtaactaagactaacatgagtcactttccgttttccaatcaatttatagattaaatgcttatacctgacaccagaaaaaaatagcaattaaactgtaggccataaaattaatttcttctgcagtacaaaaaaaaaaaagaaaaatgtaatttcatttctttttgacctagattatgccaattgcattagatgttttatttcccatatgtatcagaatgttcaaatagtatataggctactaaaaagaatcattcccaaatggtactctccccaaacaacaaacttctcttattaatcatgctgaaactgtatgcttacaaaaaaagtgagcaaaattggaagcaagagccttccaaaattaaatgaccaactaaatcagataggcagatttgaatgttttttaatcaggcactgctggcatgatcacaacatttaaaatacccaaatgattctacataaatctaactcatcatctttcttacaaaaagtccagagctctaatgaagtccataatgatctggataaaatacacttaattagattataaactgcaacataaaacggctgcatcatgccttttaacatttttctctctgaagatcagaggattgaaagggggttataaaacagcccattcatttttcttgtcttttaaaggaaggaaaaaaccattaggcagaactaaagttccagacaacttttaacaagtgacatccaagtaggtcacattcttagacctcctcagagatgcagggaacgatgatggggtcaggtgaccaacacatcaatgggacggcatgtgatcagacaactctggggaatgctaatgatttcctatgtgatgctgatagtacaagatgtactttatgcttgatgatatctagatgagatagataacaggaaaaaaaaaccaaggctaattaaaatgcatttcaaagataatcctaacatgattttctaatagtacgcaagtccactgtgagtttgagatggtgaattaaagacgaatctattcatccacagatacatctatccactcatacaatttatgtgtttatttttggttgagggagacaggaggtgagaaacaagcatgcaacaattgctaaaaatgtctttaaatatttatctacagaattctcaaatgtgttatcttgactactagagactaagagcatggcctttggagtgaccagatctcctttgaatcccagttccaacatttgttggctctgtaacgctcaggtgcagttatgacatctgaacacagtgagaacaatccatgttcaggaagtaattatgggagattaagtgtaaggcactttgtactttgcctgtcctagaataggtgttgcatacattaaatcacaatcaaaacagacaagcacatttgggataaactaaataagatctctaaataaatgaaagggccagcctcagtggctcacgcctataatcccagtactttgtgaggctgaggcaggaagatcgcttgataccaggagttgaagaccagtctgggcaacatggcaagactccatctctaaaaaataaaaataataataataattagccaggcacggtggtatgcacctatagtcccagctactggggaggctgagatgggaggatcgcttgagccctggaggtcaaagtgagaccctgtcttaaaaaaaatttttttaaaaaaagggacataccatgttcacgattcaatattaagatgtcaaatctcccctaagtgatctacatttcacaccatttcaatcaaaatagcaggctttttaaaaagctaacaagctgattaaaaaatgtttatgaaaaggcaagtgaaaatagccaaatcaattttaaagagagaaaaaaaaaagttagagggcatacactacctgatttcaagatttactaaaaagctatactaatcagaatggtgtggtactgaagaaaggatagaatagtgagtccagaaacaggcctacacaaacatgggcaattgatctccaacaaagatgaaaaggcaatttaatggagaaaggaaagtctcttcaaaaaaatgatgcaggaacaactgtatatttgtgtggagaatcaagaaaacccttatgccataacatattcaaaagttaattaaaaatggattatagttgggcatggtggcaaatgcctgtattcctgctactcgagaggctgagacaagaggatcgctttagcctgggagttggaatccagcctgcataatgtagtgagacccgatctctatggaaaaaaaaaaaagattataaattgaaatgtaaatgctaaaacagaaaactcctagaaaatatttgtgactttccctaagaaaatatttcttaaataaaagaagaaaacacaaactataaaagtaaaaattgatcaaatgaactttattaaaattaaaaacttcggctcttcaaaagatgccattaagaaaacaaaaagacaagtcacaagtaaggagataatatttgcaatgcatatctgacccaggacttgtatccatgtcatataaagaactcttacaactcaacaacatgaaaacaacccaaaataatataggcaaaagattgaacaaatacttctcaaaagaaaagatacaaatggcaaaaaagcacttaaaaagataagcagtagcattaactaattagaaatgggaattaaaaccacactggactgccaccgagcacgtattagaatggctgaaattaaaaagactgacactaccaggtcttggtgatgatgcagagcaactggaactctcatatactactggggggaacacgaaaagtcacgactacttcagaaagcagtcttgtagttttttataaagttagatataatactaaccatataacgtagccactgtgaccacagatattttcctaagagaaaacgtatgtcatacaaagatttgtacatgaatgttcacagtgaatgtccatcaggaggttaatggataaataaaatgtggtatgtctacacaacacaacactattcataaacagaaaggaatgaattactgataggtccaataatatgaatacatctcaacaccattatgctaagcgaaaacagttggatgtaagggtacatactgatttcactttatgtaaaatgcaagttgatgtacagtgacaaaaaggagatcactaatcagctggggctgggggtgggtgagggatagactgaaaaagggtacaggtacaaagaagatatatagatggccatttttatgcacataaaaagatacttaacattagtaatcattaggaaaatgcaaattcaaaaccatgataaaataccaccttaacactcattaggatgactataaaaaaaaaaaaaaaaaaaaggccaggtgcggcggctcacgcctgtaatcccagcactttgggaggccgaggcgggcggatcacgaggtcaggagatcgtgaccatcctggctaacatggtgaaatcccgtctctactaaaaatacaaaaaaattagccgggcgtggtggtgggcacctgtagtcccagctactcagtaggctgaggcaggagaatggagtgaacccgggtggcagagcttgcagtgagccgagatggtgccactgcactccagcctgggtgacagagcaagactctgtctcagaaaaaaacaaaaaaaaaaacaaatgttggcaaggatgtagagaaactggaagccttgtgcgttactggtaggaatgcaaaacggtgcagctattgtggaaaacagtctggcagttccttaaaagactaaacacgagctgggtgcagtgatacatctgcagccccaggtactcctactctgcaggctgaggcaggagactcatttgagaccaggagttcaaagccagcctaggcaacatagcaagacctagtctttaaaaataaaagaagacaagaaaaaattttaaaaaataattactatatgatccagcaattccacttctgggtatataacctgaagagctgaaagcacagattcaaataggtattggcacacctttgctcgctgcagtactattcacaatagccagaaggtggacataacccaaatatgcatcaacagatgaatggagaaatcaaatgtggtatatacatacaatgcaatattattcagccttaaaaaggaagggaattctgatcaatactatcatattggtgaactttgaagacattatgctaaattaaagaagttagacacagaaggacaaatattgtacgattcaacctatagaagtacctagaattgtcaaaatcagagagacaggaagtagaatggtggttgccagaggctggggcaaaaggggaatggggagttatcatttaatgggttcaaagtttcagttctggatgatgaaaaagagttctggagctggacagtggtaacgggtgcagaacaacatgaatgcacttaatgctactggattgtatacctaaaagtggtcataatggaaaatttcattatatatacattttactacaataaggaaatagtaaagaaaaaagtggcacagaaatattttggaagtaatggaaatgttctctatcttgattgtgactgtggcttcatgggtatataaaactgtcaaaattcatccaattaaatagattcatttaactgcataaaattattgctcaataaagttgatgaggggaaaaaaagacactagcaaattagcaagaatatattttatgcctctcctccctgcctttcctcatttcatcctgcaatgcctaccagttttctatttcataggaagcaggagaaaaagaaaaaaacggagggagtgcgggcagggggacattcattcaacaaatacttagataacctccatttcatatgttactccaataagcctgagtgttacaggtttatggatgaggaaactatatgaagtttggtatgaagtcgtttatccaggtcacacgagattaagtggcaaagctcagtttgtaaccaccgtgtttctaagccttcacaaatgtgcattgtaaaaatgttctccctacgtgtgatttcaccagacctacatacatgaggggaaataacaagaggcaaagccatgaaaattgtgcactatcaacaagataaaaagtgtggcaaaaatgataaatgttcaagctgatggatatgctaattaccctgatttgatcattatgcattatatacatgtatcgaaatatcactctgtagcccataaatacatgtaaactaaaaagaaaaaaaaaggacataaaatgtgtggaaaataggtacttctgttcacatttaaggacttcttgcaaagagttattgaaacctttgtcttttgtaatttctccttacttaacaattgggcacacagattaagaacacacactccacagtcacacttcccaggtcccgtcctactgctgtgacctgacgtgatctccctttgcctcagttttctcaactgcaaaatgcggattataattgtaactatctgggcacagtagcacctgcctgtggtcccagctactccggaagctgtggtagaaagatctgactccaagttcaagtccatcctcggcaacacagtaagacattgtctataaaaataacaataataataattgcatctacctcaaagggcttttgtgatgattaaataatggatgtgaagtgcttaacatagcgttagaggcatacgaaattctcaataaatattagccttcctcttccatatagtctacctataacagctatggtctatctgtaatagctaggtacaggtagagttacatgcagaactgaaaaagaaaaagctacttttacaggtagtggtttgaattcactaatgttgtccttccttccttctttcctccctcccactctctctcccttaaaatgcattgctgttcctcaaatatagtttttgcattaaaaatgtatgatggatacagatggcaaatacgcatatgaaaagatgctccacatcacatgtcatcagggaaatgcaaattaaaataacaagaagataccactacgcacatattagaatggccaaatccggaacactgataacaccaaatgctggcaaggatgtggaataacaggaactctcgttcactgctgatgggaacgcaaaatggtacagccacttgggaagacagtttggcaatttcttacagaactaaacatactcatcacacaatccagaaatcttactccttgttatttacccaaaggagttaaaaacttatgtccacacaaaaatctgcatgtggatactgacagcagctttattcataactccccaaacttggaagtaacccagatggccttcagaaggtgaatggataatcaaattgttgcacatccagacaatggacaattatttagcactaaaagtaagtgatgttatcaagccatgaaaaggcacggagcaatcttaaatgcatactactaagcgaaagaaggcagtgtgaaaaggctgtatgatcccgattatatagcattctggaaaagataaagctatggaaacggtaaaaagatcagcggttgccagggatgagagttgagagagagatgaacaggtgaggcacagagcacctctgtataatgccataaaggtaaatacatatcagtattcatctgtccaaacacggaatgtacaacaccaagagtgaacgctaacagaagctgaactttggtgataatgaagagtccatggaggttcatcagctgtcacaaatgtcccactctggtagaggatgctgagaatgagggaggctgtgtgttttgtgttggaggtgggggaggagggcaggagggatatgagaaaactctgtaccttcctctcaattatgctgtgaacctaaatttgctcttcaaaaatcatctttttaaaaaacatgtatggtggaaactatgaatgatgaaagaaaaccccattcagtaacctgaagcagcacgttatcttacgaaataataaatgattcatttatctttggcagaatcgggtcattttcctgcctttctctttctagggaaataaaaattttacactttctcaaacatttggaagattgtctttcaaaagccagtacaaggaagcttgaggaaagctttttatagccaagtataacagctggcagtctagaagccatatacaacattttgctgttctacagaacttatagcagctcacaaaagcaaaaccatttttattgaggaaacaataaaaattgttggaaattttcaaaattaaatagtatagaaggacttttattgtaataaaagtaatctatagataatgtttctcatagttaacaaaggtgcccatttacctactcaaatccacatttcttttttttttttttgagacggagtctctgtcgcccaggctggagtgcagtggcatgatctccgctcactgccagctccgcctcccgggttcacaccattctcctgcctcagcctcccgagtagctggaactgcaggcgtccgccaccatgcccggctaaatttttttgtatttttagtagagacagggtttcaccgtgttagccaggatggtctcaatctcctgaccttgtgatccgcctgcctcggcctcccaaagtgctgggattaaaggcgtgagccaccgcacccggcccacaactccacatttctaatggactgcaaattcaccagcggtaaaagtaaacgagggaggcaatagatcctttgggtctgatgttacagccaactcaagtggcaggcttttgctagattttctaagccagcagaggcagggataataaaacacatttacctagagaaaaaaaaaaatcaaattaagatgactttaagtattctatactaacagaagaactattaaaagtagttaaatccattgttctgaaaaactgaacagagatatgaccaactggaggtgttttgtctctctcgactccactggcactaggacctttttctcctattttattatcaagcatggtgagccagccattgccatgcccaagtgctgcatatcttgtgagtctaaactgaaaacaacatatctcagacgttatcttagacttgaggctgaggaacagatggatttaagaaaaaaaaccattcctttccttttaaaaggtcttaaaaacttttgagaagcttcaggaaaaaggcaagtaagatacgattattttgtggcataataagatttcattttctgaaactcaatcaggagaactaatgaagaagaaatgtgccccttgcttgtggaagccagcttaaactggtaagagcccaatcactcacagtatttgttaagcaaaatccatttatgttggaacagtaggcatttaagcattaatatgaaagttaaaatagagaagacagtacagaatacttaagttacaatttcaaattcgacagtgttgacagagctactccagagaccactaaatatattgctttaaaaaaaaaagttggcggggcataatggctcacacctgtaataatcccagcatattaggaggccgaagtggaaggatcacttgagctcagactcaggatagaccagcctgggcaacattacaagaccttgtctctactaaaagaaaaaaacttagccaggcatggtggcacacatctgtagtcccagctacttaggaggctgagatgggaggatggcttgagctcaagaagttgaggctacagtgagccacgattatgccactgcactccagcctgggcaacagagcgagactgtctcaaaaaataaaaataaaggttgcgtttttttttttaaacattatatatctgagaagatctccatatataaatatttcattttaaacagctaattgaaaagttccatacatttatatgtgagaacatttcataaggttttaccttatcctaatcatatcttaactctaaatattccgtttaacgacaaaaatggcataacattcccaaagcagcaaaatgtctttcttgatttctgaagataaaaaaggaaaaaaatagaaaaagcagaaaagcaataaactgttattcattttaataaatttttatgatccctcagtcattactaaattggatcatatgataatttctcctttggttatcatttttattgacaagttttcagctgttttttcttcatttgcaaaatgagtcctagatctcatgtctggcataatcactcagctcccataaagaaagacatccaggacccactttatcttcatgttacttttctaagccagcccatcaaaagtctgaggagacagtcactcttactgctactgacaataccaactggtttagtgtacactaactggctgactacacacatctattccttttcattcctaacagaatgctgattttattcacatattcattctcattagaaataaatgttttaggccaggcatggtggctcacgcctctaatctcagcactttgggaggccgaggcgggcggatcatgaggtcaggggtttgagaccagcctggccaacctggtgaaaccccagctctacaagtacaaaaattagccaggcgtgctggcaggcacccataatcccagctactcgggaggctgaggcaggagaacggcatgaacccaggaggcggagcttgcagtgagtcgagatggcaccactgcactccagcctgggtgacagagcaagactccgtcacacgcacacacacaaaaaagaaatgtctcaagtgcttaaattcttgtaaaaataactgcaaaaagatatatgagtaaggactggtaggtaccatatgactatttcagcaaacacatatcacctggaaaaaatgtgctgatagagtttctttaggatcaaatgcgtggtagggaaatccacatcaagtccaataaaatggtaaaagaaaaaaagaaaaagccaggcacagagactcgtgcctataatctcagcactttgggaggctgaggtgggaggatcacttgaacacaattcaagaccagcctgggcaacacagcaagacgccatctctacttaaaaaaaaaaaaagaaaagaaaaattagctagtcatggtagtgcatgcctgtagttccagctactcaggaggctgaactgggaggatcgcttgagcgaggctgaggctgctgtgagccacgatcacatgactgcacccagcctgggcgacagagtgagaccctgtctcaaaaataaaataattttaaaagttaaagctaacaaaatatacacaaaaacccagaaacagtgatgtgaaagaagcttttgattcgttagtgatgaaatgagagctgccttgatagaccggcactattacaaagacgtgcattgcctgatcaagaggtggtgcttctcagagtttctaaaccaaagattgaattcttatttttcttcatggagggaaaaaaggccacaacgttacaatataaaaatctgaaaaagggaagtgaattgatttttcatctaacttaataaaatgacttatttggctgatatttccttaggatctcaacaacctcaagccaaaacttcatagtttttcagggcagcacaaacgaatcccacaggttaaatgaagagctgctcattaggactgagaatcaggaaagagccttagttcatccacatgtgattcattcacatcattgacttaaagatcgtcaccattcattgttcctgagtggggagaaaaaaatccacagaatatttccccgagatcataaagaggttagtcactgatttggggatctttatagtctaccatttgacaatgacttggcctttctgcgagaaaaaacatccatcaggagtaccactgaaaatgtgctgaatttagagcacctctccacagtgactgcaattacagaactcctaaatcactgaaaacactctgaatcttggttttaaacatcttgtgacaccagaagaggacaaaaattgtcctagtgatgatgaacctaatatgtggtgtgtctgttttggattacaattttcccaattacaaatgctagtcatttggaccactaacccaagaatgccttggttaatttctcaaggacaaaatgtttacatattgatatattttaacatttcatttttgaaatgaatgctattttatttttcaaaggcagatgatgtcttacctacccagtgtatttataacccctttgaacacttgacccatattcctaagcatccttatggcacttaaaatgcctaaccagttccaaatgttcaataacgtttcagcaaatgcttgctgaatgaattaattaatgagcgaaggtatgttgaaaaaaattagattttcctggtaacttaattttgaaatagaaaacatataataataaatgctagctcaaaataaccctagtaaagcaatataagtgactaccttggaaaacttacagcagaatgcatcactgctcccactcccaaacctgctaccacttttgcgttctttatgctatgagaggtaccactacatccacagctgactgcatcaggaagagcccaagaccaccttcagtttcagttatctactaggcagactctcagggctcggcacacagtcgtactcacagctgcagtttattacagggaaacaacaccaagcgaagtcagcaaggggaaaggcacatggggagaagtctgtggaaacagagtgggagcctccaagggccttcccccagggagtcacaagggaggcacttcactcctcctacaaaaagctgtgataacgtgagaaatgtcccagtcagggaaacccattagagactcagtacccagggtctttattggagttcaatcgcctgtaggcagcctctaattttggactcctggaaggacagcaggggatcagcataaaccataatgttgacacaaacagtttaggcactgtcagccactcttaccagataagggggaaacacttgctgaaatctcagttgctaaatgtcagccaagggccaaacttgtgggcctgcccttccttcctttcctccttccttcccttccttcccttccttccttccctccctcactcccattccctcccctcccctcctctcccctccctctccttcccttcctccctctctccctccctttctctctctctctcttaacagtcttcctctgctgcccagactagagtgcagtggtatggtatcagctcactgcaagttccacctcccaggttcaagcaattctcctgcctcagcctcccgagtagctgggattacaggcgcatgccaccatgcctggctaatttttgcatttttagtagagacagggttttgctatgttccctacgccagtctcgaactcctgacttcaagtgatccacccgcttcaacctcccaaagtgctgggattagaggcgtaagccaccacgcccagcccaggtcttttcaaggataagcagtttaggcctgctaggttaactcttttctgcacagcgactaggccagaaaccaagaaataatcccaattcctacttcttcactgtccctcatctcttctaggccaaatcctgtcaattttgctcctgagtaacttccctgtactcccttcttcctgtcctcactatcgggctttaatggaggcctctgttctctcttgctcgcatcactgccggaactcctaccttgtctcctgcctatccttccatccattctccacaggctctttgccgggaaggctgcccactgccctcaacctcccgagcatagtggaaaacagggcctttttctgatgtgcccaagttttctctctaatttctcaacactttctcccttttgtactctctgttctagtcaaactgaactattaaatgcagttctcagaaagcatggcactttcttacctttgtcactttgttctggctacttgtcctctacctagaatgcatttccacttttgcctgggttaagaagtatgtaggctttagaagtcagctgaggcaccaacacaaatcttccccagatatccccgtctcccagtctaatacctcatgcctactcccctccacggcatttatcccactgcactgcaatttcagtctattttattgatctatcccctatactgtgtgtccttaaaggtgggactgcgtatccccagtgtctagcatggtcactgacaaattgttcatgtccaataaatacttcttgactgaataaatgtcacaacttcagcagggttcccctgaggtcagctccatcccccggccttctagaccggactgaacttagacgattttggcacagacactgggaaccgtgcatcgttcatgttatcctctttgcattggctttgttcaaaagctaacagccaaatatgtggtggtcttcctgtgaccgtgtaggtctgcagagcctataatctgtatactaattacacttttggtttcgacttaccttccccaacctcttactctgattacttcacttacactttatttgtatctttgtgtgtgtgcatggttttttccaaagctgaaattccttctggactaaagcaggatataaatagatatgtatatagtcccaaagagatgagaacactgtcccattgtttagaggaggtgaaacctcagtttttctcagtatcccattcctagctaaatccaaagtctcctaaagcacaacttacaaaaagagctattttcctcctagttcttcagctcaacttcatgcaatgaagttactctaaataaaggaatgcatacgtgcacccatattttcttcacaagacttaggagcaagactcaaaaaagtgaggacagatgcgcgccttactttatccagtcaatgtgctgctgaaaaactgggtaaaatgagttgtttaaatagaatcaaaatgtcagtttactagagatgctcactacttacagaaacaccacggcaaatccatgaagtaattatggggtgaaagaagtaatcaccctaaaacttatctgccttgtaatcccagatttacaggctgaggcaatgttaaagtatgcttattagaaaaccctcaagttctactgtgtataaacatgcaatcctcttcgtttgtttcatcacctataaacgtaactcaagttaataaccagccagaaaattcaaattaatattaaatactgaaacactgttatcaccaaattcacaccagaaattattagcacttcaaatgtgagaatgttctcaaagccctgttaattccttccttctacccctacttgacagacattccttgacaacctcctaagtaaaacattccttctctacatgtcaatagattccacctaagaaaggcaaagtccttgctgtcaaggaacttatagccacgtagagttcactctttttgttatatctgttactaacatgagacttttttcttctttaatccaaattttcatttcatttttttctcctttacatctgtttttgttgtaaactgccactcaggagataactttcattaatttgccttataaaatttctaccaaaaccaactaaaaggacaagagaacatagaagaaggacagtacatgcagagttttaaaaaccttaaggaagattaaaagctcgtcaccacataaatgtctaaagttattactaggccctaccaatttgaactttgggatgaaaactccttatgaattcattacagatttgaatttttaaggcaattcagttcaactcatctcaagtacgaacacagtcattcaaaccgggctaataaaaggcagcttagtggacatcctaaaaggttgaattttcatgaattaacagattggcaacgagcttctcaacaatttggatgtaaacaagacatttagaaagctgctgaaaactgtttcttcatgtaggttaagaattagtcttccaatattttttacattacaattcttatttttcaaatttttttttacaaacagtgaaaaggtagtgtgtctaaaattctctgcactgctaaataagtacagattgaaactatcttataaatgaatttgacaatgacctgtgacctagaggcaaaagcagacagtgctgtttaagctgctcagtaaaatttgagctaaactcgaaatgtagaagcaaatactttctagaacacctgatagatcaatgttttaaaatccttgctaattgcttaagttttcattcttttgtaatctgctccttgtgtgtacttaacctactcacaggtatttatgttaattcattagatccctcagggtgggccgggcagactattatctgaaagcactggtgcatagcttcctgggtcagggacaaataaatcttttcatataattgcatgtcgttttatgtgttgctgtcttcccactgggaaaaatgttaaaatatttaaggcttactatctggtgtgattgtgattttataattaaagtctgggacaggaggagagagtggcagaattcagtactttatctcagtaggaacagtctttctttgaagcggtaaacttttagatagtcaataaaagtaaaaattccggtgaataagagctggtagagtccttttgaagtcacgtaccaccatttgatgacaatctagtttaataaagatagagctaaaagaataagaaggactgtatatgtcacaaagatcgtgattctcttcagtgataaaatcaagtaaatattgtcatcaagctaaaatatacccaattctaatacagcaactgtttacctatttccaaatttgtctacataccagacagccagtgggggagaatggttttattttgttcttaattagaacagtatttggagctggaactatctaatgggcaagtaagccaagcattctctcatccactcactcccttcagcattcttctcttacccctatcttctggaccaaaaaataaaaagtctagtcaggaagtggggagtgggagttgcgggacaaggtatgagttggggagagcatctgggttttatcaccaggtgtgtcaggatttgcagtttcttgaaaatctaaatcttcaggttgctgtgcagacttgtgcctcctggtacaaataatagctgcgcccacacacactaatgcccccccacagcccacagccttggggcgctccaaggagagtgagttcaataccagcagtaagggcgactcgctcctggacgtgaatctagcatgcaagatcattttcattaaacacgtaactgcacagcgacgatttacatctcctcttatttcctttgaatgagaagcagacgcataacagcaatctggaatagaaagtggagcttttacaggctgttgtatgtgcaccaaggccgggagaggctgaggtccgtcagcatcatgtggcaggaaaaccgcaaatagttcgaaaggccacactctccggcaccgactgagtagctgctgcaggaagggggacaaatggtcctcagcaagaccctcttcagaaggaacaagagaccgtgtggagggcccatgagaatgaatttgtggtttgcaactggtttgtcatgtctcaaaataagtaaatccagtatgtgtgactgtttagaaaagcagttaagggcggttgagtctttcttggttaattaagtgattttcatctggaggtatgtttggaggaaggagcctcctggaaagtaggatcagaaagaagtgtttagtgtgaaaaaatcagttccagatgattttgtgtatatgcctcgtgtttaaattcagactgttaagtctagacactggaaatcaaactacaggtcagcaaaaaaaaaaaaaaaagaacacccacgcagcaaaaagctgtcatttcactgccacctctgttaaaagggtacaaatatgctatgcttgcttcaaatctatgttttataattctcttctttataacaaaaagtcttctgacaacacaatcaaaaacgaatagtcagaagtaatgatgatctaaacctaaatggttaaagtctttgctgatggatgcagagctcaggagggaggctatgactgggagggggcagaaaggctgagggaagaacaagaacatagagacggagcgcagggtgcctgcaacctgctaccagtcaaacccctaccacagtttcctcatctcgacaaaaagcataatcaggtacatgagtttactgttcataataatgaactacagaagcatttgttattgttacactaataaaaaccacaataaaaaatactactcttattagtaacaaatcaaagaacctccttaatatgaagtcagtgtgaatggttcttggaggggagccagttccgcaggcataacagccatccttttgcaaagccatcaatccagaattaccagtcatacctccaacttatgccttaccttaccccttatgtcttaccttatgcttctgctgaaaaagcgaatgaaaagctggtctcccttttcaaaaatgaaaccatcaaaaaccaacatgggaaggagaagaatcactgactaggatatgtctgtgcagaaaacaaggtggctctcatctgaaaatataacatgacaaaggcgaccaactacatagaacatcatttagattctctccaattttgagatgctgtagctggagcacagagataaccgcccccagtcacacagcctgtctgcttctggactctgtattcttagtcatgaccttgtagctgccttatcatgttctaccataaaaatgaaaattgtgaaacagaaaatctaaatcaaaatgttttaatttgtaataaaagaaaacaaactgagaatctgcaaaagttgtgaaaattttcttctgtgtgaggaaagcttcgtgccagatatcttaaactcaacataaatatccaacacatttcacataaaacagaacaatactgccatggtaatgacgctcctcagttagacaaaaatctcaagagcaggcctgtctgctgatgttcatcactaacctacagtgtatgtgcatttgtttttgccaataaactatgctgttgccagagattaaacataagttcctaaatgcatgtatgattgtttgtaattacttaatattaataagccgaactgataaacacaatcccaaatcaagaaagaaagccaacataaaacagaaagatggcattgctaaatcccggaagacatcacctcgagcttttcatcatgccactttgaagttcacccccatccaaaccctttgtggcttcctctgaagaatcctgaggcagaggcagcagcaggctcactcctccagctgcctgcgaaggctgaattccatttattccatttggggttggtggtgggcaggacgaatgagactgttgtcattcttcccaggaatgcttagatggacagtgagctattggactgccccagataccatcatctcccccacatccctcctacgtggagccttagtttggggggaagtgaatctcaattgcccccttccctctccccgtcaatgaggcaggcttgtggaggtgctggccacttcttaggcctaaatctgtgttcagagagtggatccatgctttgagagatggttgccctgcccgtcctagactatcttgaagggtgagaggcacaggaacttagagagtcaaagactaccaagagacacaccgaaaactagtgaggtgggaactggcaatttctaaacctacggcaacagcagtctctggtccttcttttcatttcccgggacctccatcctgagggctgaactgataacattcatcttacttttatggatgatgaggaaaatgccacaagtgagtttaattctcaaaggagaaagagaaagtggtatctaatatcgattaggtccaaatatactctcttggtgttttagccagaaatacatctgggcatttctgcagcaatctgtaagagactttatacacgtatccatctcaaaataatgcgcttttagttattagcttttattcatttccattttgtctttttaaagtgacatccaaaatgatgaaaagcttcagggtactacaacaccataagataatcttcctgtattcacttccccaaagtacccagagatgggccccaagaggagtcctcctcacgaagaggtgaagcaccgacctgaggatctgtcagaaccctgatcaaaaagcaacagaacaaagtgaatggcgagataaagtggagagggagccattgtgtttacgttcacctaagcaaagtcctaattagtgcccagtcctactggaggatggttttaatggcatgcaccttttatcgcctgcaaatgcttaagggtcagcagaacaagccactgccttgttagataatgaaacacagataaaaatttatgtgtaattggtatgttttaaactggtatttaaaagctatttatctcttagtggggacaaatattcttttaagtcattaattggcaaccataaattttaattctattctaggcataattattacagatttcaagtaagtaggctccaaaacaatgaggctttactggttcgatcagaaatacttgttgaagggtttcctaagaagattacaataggataaattaattctatcagcagaagcactggagtatagaatgtcaaatacagtaaatccatatgtaataaacatagatatctaagatgtgtaagtaagtaaaaataaggatgttgcagatatatatacaatatggtgctgcttatcaaaacaacacaaaacaattttttgtgtgtgtctgtaaaaaaaaattgtgggagtggggatgtgtaatgctgaaggtgaggtgccaaaatgccagcagtggctacttctaggaaggagggtaggacggtgggagaaaacagggattaaggacaatgatgaaggggaattttgcctttgttataaaatgttttaaattatttaaaataaagttattgcatttatacattatttgtgcaattaaaatatttcaaaatttcagacttatttatccccactataatcacaagtagtgattactgagtatgggaagagcctagtacctaggggtggtgccattataatcccaaaggacacaatcctgaatgccatcatccctgaaaatattggtatacaggcctttaaaaacaaaaaaggcctgagagtaaaaattagcctgaagtcgaaatctctgaaatcgaaaatcctgaaaatcataatccccaaacactgaaaccccaaatgctgcaatcctgaaagccaagttctggggagggattcgagtgctttccgctgtgctcactgtcgctgcatcctgtagttctggggagggattcgtgtgctttccactgtgctcactgtggatgcttcctgttagttctggggagggattcgtgtgctttccgctgtgctcactgtcgctgcatcgtgttagttctggggagggattcgtgtgctttccactgtgctcactgtggatgcttcctgttagttctggggagggattcgtgtgctttccactgtgctcactgtggatgcatcgtgtagttctggggagggattcgtgtgctttccgctgtgctcactgtggatgcatcgtgtagttctggggagggattcgtgtgctttccgctgtgctcactgtggatgcatcgtgttagttctggggagggattcgtgtgctttccactgtgctcactgtctttgcatcctgttagttcgggggagggattcatgtgctttccactgtgctcactgtggatgcttcctgttagttctggggagggattcgtgtgctttccactgtgctcactgtggatgcatcgtgttagttctggggagggattcgtgtgctttccactgtgctcactgtcgctgcatcgtgttagttctggggagggattcgtgtgccttccactgtgctcactgtggctgcatcctgttagttctggggagggattcgtgtgctttccgctgtgctcagtgtggatgaatcgtgttagttctatcatgttagacaggactcttatcttgtggttgtcttcatctggaaattagctatggtttaagatgtgtacaggtgccagattcacaaggggtagacttgtagacttaattttcggtgtcagcttgactggattaaagagttatctagtaacttggtaaagcattatttcagatatgtctgtaagggtgtttccagaggagattagtacatgactctgaatggagtaggtggagatctgcctaaaatgttggcgggcaccatccaatcagccttgggtccagagggaacaaacacagatggtaaactgctttctctctgagagatgagacagacttttcttctgccttggacgtaagaaacattattccaagtacacgcattatcacaatgctgctttgtgtataagcatggtgcatgtacataaaaacactgaaacttcttccataaatgaagaactgccttttttctgtgtctccatttgtgaaagataaaatttcttgagaccttggctctttgagtgactgtatttgtggcagtgaccagaggtttttgatccatctcatcaaaacatgtctgtcagggtatttttgatgactgcagttacaacgatggatgcatacaatttccaaccatagtaataagcgttcacacatttcactttctgacctatttctttataaatacagtttgtctgttcatagctataatagctgagtgactcccattagtatatctgtgtgttgatgcttgcaaagagaacatgtatggtattgttgcctattttactgtgtaaagtggcctataatgtgttcagtcatgtatttatatgtctctaaagtcttcttttaaaattgtaacaaatgtattttaaatatttttaaaactttattccacaattatatttttgaaattttggtctctcagaattgtgatttggggattttagaatttagggattttaggctggagctagtgaatcacacctataatctcagcactttgggaggccaaggcgggcagatcgcttgagcccaggagttcaagaccagcctgggcaacatggcaaaacccgatctctacaaaaaatacaaaaattagccgggcatgatggctcctacctgcagccccagctactcgggaggctgaggtggaaagattgctggagacccggaggcagaggttgcagcaagccaagatcacgccacggtactccagcctaggtgacagggcaagactctgtctcaaaataaataaataaataaaactagactttagggattttaatctttcaaaatttcaacatttggaattatggcattcaagatagtgtctctcaagattatggtccaaacctccatagaggtactggaaagcacaacgccagatactacagaagttccgtatgactccattctggcgcaaccatatgcccatgtgtcaggcacaatttcctaagaagaaatcaagtgtaatagatggcaaattggtctcggcctaggtcaagcttgtccaacctgtggcccagcatggctttgaatgtggccaaacgcaaacttgcaaactttcttaaaacataagtttttttgtgtgatttttgttcttttagctcatcagctatcattcatgttagtgtattttatgtatggctcaagacaatttgtctccttccagtgtggcccagggaagccaaaagattagacacccctggcccaggtcagtagcaccagaaggatatctagataagatcaaactaaattaataagcagtctgcagctccaaagcattgactttgaccagtacttttgagaatccttaggctaattcctagtaaagcatgttttgcaaataaaaaaaaattatcttccttttttattggtttgccaaaaaaaattaaaaaaaaaaaacaaactgtgaacatacactagaagcaacaaccataataaaacttctggtaataataaggcagctcctcccatatataacataccaaatataacaactataagctctggattcgacatttaaaaaaactaactgaaggtactagagagtggccaaaagcagacagaaactggaagggagttaacacttgaaaataaatgaaaaacactagatgagtttcttgtttataaagctttttaaattgaagccagaaattttctggctgtgccagctggggcaactgcaagttggatagaaatctgcagcttcttaaagaaacaaaaggaaagtgacaggaaaaaaatcccagtgagggccagagtctagtgcataaaatgcctgaatctctgggtgacccctactatccacatgcattgaggagaggcccagcagtccggaaaagtctaaaagaactgaaaagtgatttcagttgctgcccttcacaggggtaacaaagttggagcacacatctgccaatataatagcatgctaaagcaatacacacacacacacacacacacacacacacacacacacttcagaggaatataagagaatccagaaacctataacatattaaaaatgttctgaataaaacccaaaattactagacatatgagggaagaggacagggtgacccattctcaagaaaaaaaaattcaatcaatgaaaaccaacccaaaatggcccaactgcctcaaaaactaggtaagaatgtttatagtcagctttcattactatgcccaagaaaagacaggaaaatatgcttgtaatgaacaaataggaaatatcaacaaagaatcttaaaaatgtgatatgaataaaatgtgaaatgaatgaaaaataatccaataaaaatggaagaggaagagaaagacacaaataaaagaaccagagagacggcagtgataagaactcagtcttacatggtaagaactcagcatgatattgttgcctgtgaagacaaaaggaattttccattttcttatgccactaagtttgtggtactttcttacaacagcaataagaaacagaaatgtgctgaaagagaaggagaagagaagctgccaatctagaatcctctatccagcaaaaaattgtctgcaagaataaaggcaaaataaagacattttcatataaaagaaaactaaaataatttattaccagcagacctgtactaccggaggtgctaaaggaagtccttcaggctgcaggacaatgagactagatggaaggctgaaatttcatgaaagaatgaagggtgctggaaatggtaaatacgtagggaagtataaaagactctttctctgaatttcttcaaaatatatatggctacttaaagaagtaaaatgttgtattgagggagctttaaaatatgcaaatataatatatatgacatctgtaagactgaggagttcatattttacatgaaatgggacaatgttaactttagactgtgaaaatttaattatctgttttataatcctagagaaaccattgaaaaagaacacagagacatatagcaagaaaaaaaaaaaaaaaagctcagccaaaagaactttggcaaaagaaccgaaagataatatacaataaaaatttttttcatggaaaatagttttggaaatgctactatgaaatctcagcaaattctatttcttgccaatgtattcatctgcataagaaatggtaagggatacatctgtagatttaaacacgcacataaacacataagtccactaaaatggtcagattttctactcctcattcaattaaaaaagaaactatataaagaaagcaccaaaagacaaaataccaaacccgtctctacttcagttctctgttccattcacaattctcacccaggaaagagaaattcaaagaaaagacagagctggaacttcatttcctatatatagttagccagcattcttcagtgttgtctacacattcacccacatccaaatgtactgccaacagaccaacacagagaagtgctgagttaggtttcagtgtgtttctaatatatcccattttattcaagacagaataaaattttgtttcaatgtgactcctctgggtttaaaaaaaaatccaaaatcttagacttaactatatagtcaatcaactagtacataaacaaatgacttcagtacactaatgctgatagccaaaatagtaaaaaataagtctaaggcatgtcacttacttgctctttctggctcatttattttaactgctcccactagcattctgtctggttttgttttttttttctagattaattcaattctcttccctttggatgagatagaaaacagaacaaaaaaaatgaaaaaaaatgctttgcttcacaatcagtcagtatttattgaatgtctttattgtcacacagtatttattgaaatactatcatttgccaggcatagaagaagacgagataaataagatggccccttatcgtctaagacttaagtaaaatacataggatatatatacataatagatataaaacaaagctgactgtttcatgaaagcagaaaggagagagacaatcttttcagttggagaatcaggaaaagtttgtccttgcaggatgaggttttcagaggtaagctgggggtggggaaccagaagcagaaataggagaccagggaagtgtaggacaattcagggaaaggtgactggctcagtatggctggagcatacaggctacactggtggaagctgtgagagaaaacatggcatgtctaattatggtggctcttgaagccaagctaaaggtcttgagcctcatttgataggcagtgaggttcacagaagatttttttaaattgtggagtgacatttttcatcatttaacaataaacagcctttggaagtattatgtgccaaaaacatgcaaacaagtaatagtacatcaaggaatcccacaaaatccaacctcaggcagactgcagttgagtagggagctaactatgtaaagagaacaacaagttagaaagccttagtgaggattatgctattgttctgtctaagccaagatggcaagcctgggattgccttaccaaattcaagctcccagactacatatgacacatacatgaaagaataatttaaaatttaaaaaaaagagagaagaggaatcttttttttttctgtaatcagaatacctatcatccaggaaaaggtcataaaacagtgcaaaataacaccacaggactaaaaaaagatttttttttaatgtggcaaaaattaatacaggatttcctttgcaaattatccaggctttttcccattctggcgtagatgccactactctatgtgcccataatgtcctgattcttcctctctgtaatgacagttctcatcccacaggattcaagttgcctgtttatgtatctgacacctctgctattttatcaactctttaagggaaggaattgtgttttatgaatgacattctcatttttaaaaagaaaacaatcgtttgtcaaataaaaacaaaatctgtcttcctttctttagactttcaaaattagctcaaataaaaatatattattgttgacattcagtaaagtacatgttggcagcctcttttaaagtgcctttcataaaacaagcagaagatatacacacagatacacacatacactttttaaaatttgaaataatataagtgctcttactgtaaaatgtcagacaacttttatctgaagcattcaaaaatttctcccctgccccaaacactccttattgggctattgttatcccagtttcactcttagaagacttaaggagaaaaagcattaaatagaatttatgggaggtcattgatttggactaagctcctacactaggccccgagacacgaagccaacatggagttattgagactaaagttccaaactgaaaccaacttgtttaacctgagaaagtaggagagagataatagtctaatccccaaccaggccacttttaggcaccgtgataaggaaggcttcttctgttttaatcttctatgaaaaagtaactttgaaatgaccggccttcttgttccacttctgcttcttcagccgtcttctgcctatctagaccatctcctcctgcgaggatgtgaagtccatccatctttcaaggtcaagaagtttagactttattaggaggcaatggagagtcgaagaagaatagttcaattcactttctgtagaagtgactgaaggaagggtacttccacaactgcaagcacagaagccattaagaggttgattcagcgacccatataatggtggcctcaattaagggactggcagtgtggctgaagaaaaacacctagctaaaagagaacaggaagcagaactaaccagatgtattgactgactgaatgtaaagataagggagagggaaaagtcaacgatgatctataggtttcctctaaacagtcattaaacaattatttactgagcaccaagtatctaccatggttccaggtaccagagatacatcatcagacagaagaatgtctcatttttatggaggttatagtttagcagaagatagacagtaaacaaataagatgtctacaaaaccttctctcatcattctttttttttttttagagtaaagtgaaagcaactttattaagaaagtaaaggaataaatggcttctccataggcagagcagccaatgtgatcattctggccaataggcttcttttgtcttaggtgtgccagagtacaccacgcattttggaactagatggcacagagcagattcacatcatatgtacagcttcactgggaatccttcatcccaatgaagctgataaagtctgaaataggacatacacgttaaaagaatgtctgaatgattgtaaggatttttctggcttctagcaaaaaagtaaaatattgtttgtacttctgaacaatttaaggaattttgaaaagaactctgactctacttttttcccatcacataatgaagattgatgtatttattacttggtggtgtgaattagaaatatgataaatttaaagtctaacttgtttcccatccaaacttcccaactagactgcactgtattttttatttttctctaattgttgtacatgggtaagtaaaactcgtgtaagtttccgcatagttcacactcatgggaaacaaaaactgcgccttgtatatcatcatcccccgactgtctgtcactcacagaattcaaggcacatatgaagtgctcaataaacaagagcttagaggaaatcaatgaggcttagtgcatagccttattgcaaactgtggtctccaatgcaaaaacaaaataaaacaaaaaccccacaactaaaaacaaagtaggggatgttaacaagagaacaaggatatgaaacctatctcatgaaagaataaacatttcacacagaaatcataaatgttggtattaattttaaatgacatttgtcagccatagaaagtgatctctaataactcacgatagagcagtttaatgcccaaataattgaaaaaagaattggagaggtaacctaacggcagataagattaagtaaggaaaatttcaatctgtgtgaagaagagaaggctttaatttttcaaccctttgggacaatttggaacatcagggctctacaccaaaactcgactttatttatcctatatatatcctttatttaggatccctaaatttattttttactttcttcatgaactcgtaagtcagtctcctagggcaggggtccccagggctgcggactggtactggtccatggcctgttaggaactgggtcacacggcaggaggcgagtggcgggtgagcaggcatgaccaccggagctcagagcagtggcagcactggattctcatggagggtgagcaggcatgaccactggagctcagaaaagtggcagcattcgattctcatgagggcgtgaaccctattgtgaactgggcatgtgagggatctaggttgtgtgctccttatgagactctaactaatgcctgatgatctgaggtggaacagtttcatcctaaaaccatccatcccctcctcaccgccccatccatgaaaaactgtcttccacgaaactggttcctggtgccagaaaggttgggaaccactgtcctagggcaaccttgcttgtgtgggtaaagttctttaagaaaacgggagactctaggagaaaaaagaactattattattgtaaaaagaaagattaccaaggactcttcttttaccatacaaaggaggaaatccttactacaccttagtgtccaagttcagtatacctttttgatataaaatacacagaaaagcttaatatttgatttatcttagtgtattatctatctcccccctctagaatgcgaactctataaaggcagaaattttttatctgtgttgttaactgctgtctccccaatatctacaacaatggttaacaacactaggtagtcaacagtagctaagaatggacgaaagaatcaaggcttggataacaaaacagctcgtttatggaatgcatgtatattttcataaggataattagtgtgtgtaatcaaaagcaaagcccttctgaaagaagtccatcaccaatacagataagttaccactttgtttgattatcataaactatcaaacaatgcaacccactgaaaggaaaatgtgagacaaatttaactcctatgaccttagcgttgaggaaggaaagatttacatagcgtccattgattcgctctgggaagagtgtggttaccttcaaaatctaaagtcaaaatctaaatccctaagtcaaaacctaaaacctaagagctgaaagacttctctgtgtttaagcaggcatcctgttttcactctgtggtatctaaatagaagcttcaaaaggagactctgtgcttgtgtttacaaactgtgagactgctcaaatatagaaacggaagactttttgttgttgtttgtttctagtttttctttttttcttttttttgagacagagtctcactctgtcacccatactggagtgcagtggtgtgatctttgctcaccacaacccctgcctcccaagctcaagcaattctcatgcctcagcctcctgagcagctgacactacaggcctgcaccatgtcacctggctaatttgttgcatttttagtagagacaaagtttcgccatgttggccaggctggtctcaaactcctgccctcaagtgacctgcctgccttggcctctgaaagtgctgggattacaggcatgagccactgcacccagcccctagcttctattttttttaattactagtgtaccagctcaggattgaatacatctctcctcctgctagaaaaaatttaaaataacctgagcaatgtagctcatacctgtaatcctggcactttgggatgccaagggagaatgattgcttgaggcctggattaacactccaagacctcatctctacaaaaaaacttttttaaagaaagaatttaaaatagaagtatttatttctttcaagttagcctaaaggccaaatcgagctcctggatatttgaggagttctgaaaccacgtttgccaagatcatgacggtgagaggaatctggcgtgactaactttatcttgcttctagtctcacaggctggctgcccttgctcattcctaggcacaggccaagctaaccatgggagacaggaaggatggtcatagtccctccctaaaactaaacccctctttgctcagggaccagagccgcttttgtaaaactaatgaaaggccataagattagggttatgggaggggcctgcaatttgttaaaatgtaggcgtagtttctataatcccttactgctcaggagtcatgtggccagaggtcacaagatttgtgacttcctcaattgctcctacagataacattactattgtagtacctaagattggtctttcgaaacgtttttcagacgttagcatgctggcaaccaactcacccccctggacctgtgacttatgactcagttggtcccatggcccccgcccagaggcatactcagcatagcaggaccgtttcctaccctcctatgattttatccacaaccaatcagcagcacacattccctagccccttgcccgccaaactgtccataaaaaccccagcttctgagttcttggtgagactggtttgagtaataactccagtctttccacttggctagctctgcattaattaaactctttctttactgcaatatcgtgggcttggcgaaatggttttgtgtggggaaaagaaagagagatcagactgttactgtgtctatgtagagagaagtagacataagagactccattttgttctgtactaagaaaaattcttctgccttgggatgctgttaatctgtgaccttacccccaaccctgtgctccctgaaacatgtgctgtgtcaactcagggttaaatggattaagggcggtgcaagatgtgctttgttaaacagatgcttgaaggcagcatgctccttaagagtcatcaccactccctaatctcaagtacccaggggcacaaacactgcggaaggctgcagggacctctgcctacgaaagccaggtattgtccaaggtttctccccatgtgacagtctgaaatatggcctcctgggaagggaaagacctgaccgtcccccagcccgacacccgtaaagggtctgtgctgaggaggattagtaaaagaggaaggaatgcctctttgcagttgagataagaggaaggcatctgtctcctgctcgtccctgggcaatggaatgtctccgtgtaaaacccgattgtatattccatctactgagacaggggaaaaccgccttagggctggaggtgggacatgcgggcagcaatactgctctttaaggcattgagatgtttatgtatatgcacatcaaaagcacagcacttttttctctaacttgtttatgatgcagagacatttgttcacatgttttcctgcagaccctctccccactattaccctattgtcctgccacatcccgctctcccagaaatgcccgataatgatcgataaatactgagggaactcagaggctggtgccggcgcgggtcccctgcgcccacttttccttctctatactttgtctctgtgtatctttcttttctcaagtctctcgttccacccaacaagaaacgcccacaagtgtggaggggcaggccaccccttcagttttgtctgtgcagcagacaggaagagccagttgggtgactacagttcccttcacacagaataaaagttcctaaacaataacacagctaatctcacctacaattcaggtaagtcaaaactatgagccctttcccttactgagtcccaagtaagggggattctggtccaaacaaacaaaaaacccacacaatacacacataaaggtcacaatttgtatttgctcaagaatcatataactcattataaaccgaaaccaaacgaaatgaaagactttattagtaaaaattatgaaaaatttgaaaatatgtcaaaaggttacctttatattcttttaaatattggaccacagtctaaacaggcccacccaaggatttttttttaatactgtagtattgtttggcttactacttattatctatcagcataaggactgctaagtaacatattaacttgcagatttttgtccaaaaggatgtaaatgatttttgtgtgatagaaagatagccccaaagacaacagttttattgccctgtaagacattaaccaactgacaattcctttttttttttttttttcttttttcttttctggagacaagagctcactctgtcacccaggctgaggctacagtgcagtggcatgatcacagcccactgcagtctcaacattctgggctcaaacgatccttccacctcagcctcccaagtagctgggactacaggcatgcaccatcatgcccagctattttttgtattttttgtagagatggagttttgacatgttgcccaggctggtcttcaactcctgggttcaagtgatcctcttgtctcagcctctcaaactgctagggttacaggccactgcacccagcccaatttactgatcttacaatcttattctagcattctatcagtgcctatatataatttatctgtggaattttctgggaatcagcatcaccattatgttgattccctcattcatcaggcaaataaatttatgacacgcacttactatgtatttacgagggtcattgttttacctctgaaaaatatattttgatatcttaaagttttggtatattttcttcttagatgcctacagaatataggaaaggtaagctgttactggtctatcaatggcaacaaaagaatgtaaattgattgcattattcattcttcagcaggctgattactgatactatagtcataccattgaattatttagtaacaaaaaatctagtaaataattacaaattatcagtgactaccatattctttagagcacattattttacccctaaagatgcgcattaacattttgtgattagagtacctagaagactacagaaaagagcagaaatgatcactaaatgctgcatgtacctcctgtgttttactcctaatgcagctttaaagctgtacatcctaaagaatattgcattttctcttttaacaacataaattttatctccagcaaagaaagtgttacactatctatagtaaattttaaacacttcaatatagaagtatttccagtgtgatttatgtgtatctgggttagtttccactcacaccctaatggtattagttaacatctgaagtaccctaatgaggaattaatccagaggtggatgtttatcatctgacacatggtgaccatctgccacaatgccagaggtagctactgatggggtccaagacatcctaccccaaaatatggtactttggcatattagatattttaagctgaaggatttgagaaaacagaccttccccctccccttctcccctgaaaaaggttataaaatctttcctacgttttatgaccttccccgaagcaggtcaaaggaccctaatgtgtgaggtgccctccctatacccagaagaaaggggcatccttatctccaaacatgcagtgacatagagacctgaacaaataggtcttactaagcatcctccagtttataacattcagctcatcccccgctttgtcctatcacatttctctaagactctccactcttcatcaaacctactatgaaacaagctcacgtttaactgcttcttcgggtcttcatttccttatgaagtctcccatgtcacataaaacttgaataaatttctaataaaataaattttattagagggggtcccagctacccaaaataagtagcaggaaagatacttttcctcccctttgctacaaaacattttcaaatatctttgtttctgatcaaccttaaaggatttgataatttgcattatagataaaaatatttttccttggtgaaacaaggggtgtttaagatatgtggatggctaaaaacagtagaaaaagaataattagtttatttccttttgcctttgcttgaacaatgtacaagaatctagcatgccgaatgactagaattaccataggttgcaatttgcctgttacagtcccagtttacatttcttatcccaacataattattaagaatgccctctttggttctcaaagcattctgctttggaccacaaattatatggacaccccaccacagcatacctttcttaaaggccccctaggcttaatactaggatggaccctgtatggatttttgtcagcgaactgctactaggttagctgaattccgaagctaacgcactgtttcacctgcttcaagtgaatctttctgtgataaatttatagaacaactggtgtgacagtttttgcgcctgcctaataaatgtttgtatctgtgcatgagtcagtctgagacttgcttttattacaacacactgcctgggactgtgcttgcaggtgagaagaccttcagttttcatttgctcctatctactagaggctacggatatattttctttttttttttttctacacttcacttattagatttattactaagtacttgatgctttttatttttatttttagatttcagtaaaatagtttaatcaagtcactaaacaagcaaatgacaacaacaacaaaaaagcctcagagagagagaagggaaatcaatatctagttgctaccatatgacacctaaaatgccaaattttctttttttttaatttttttaatttttatttttattttaagttctgggatacatgtgcgggacctgcaggtttgttatgtaggtaaatgtgtgccatggtggtttgctgtacctatcaatccatcacctaggtattaagcccaacacacattagcaatttttcctgatgctctccctcccctcgcccttccgacaggcccagtgtgtgttgttcccctccctgtgtccatgtgttttcaccgttcagctcccacttatgagtgagaacatgcggtgtttggttttctgtctctgcgttagtttgctgaggataatggcttccagctccatccatgtccatgcaaagggcatgatctcattcatttttatggctgcatagtattccatggtgtgtatgtgccaccaaagctcctctatctggcagttccttgcagatgaaagctccccccatgattcagaataagtagagcttttggccagaagagttttcaaattcttgcccttatagctacaaacccatgagcctatttctagatccttcctgttattcttattatagagggaataagcatctcttgctactttttatcactagaccaacatctttcttccctactagacataagttccatgaagccaagaccgttgacttccttaatcatctctagaaccctgggttctagcacatttggtactcatcagttagtcaatatctgctgaatgagtaaattttaaaaagtgtccttgatttctcctccagaccattagttgttcttttcctgttcaaatagtcggaaagcaaaggcaaggaaaaaaaatctcagaggctcacacaaaaaaagctacaaggaaaaacaagttcagttagttgttttccgtggtatctatgaaacttttttctaaacaaataatgtgttctgtccaaaacactttagcctaccaacatagcaactctacgtgcaataacggcatgactgcactgattctgtgtcttgattttaactttcaacaagtaaaacaaacacaatttgcaaagcagaattccaacactgctgtcattacggctttagataaagcaccactgacaaggccccctctagattctacatgaagacttacgcggactgaaacccgtcctcagtactccaactgttaaccaaaccgcctcccaactctaaccaactacatcatagcaagcaaatctttatatgtaaacatagaaaattattatttttatctagttgcacaatgactttctaactaagcttttattgaaaaaacatacatctcactaataaggaaaaaaaagagcaatcacttgtttagaataaatgagatgctcttcgtcctctgtgagcccctttgactcatgaattggtttaacttctgaaacctccagtgtagactgtccctatctacagcgagcgccatgcacttatgagcaggaaacacccatgtgacaaagctcagaactgtcacggaaaggtaacccaggtaaaagcgcatcaaaacaaggacacacacacactctctctctctttctctctctctctccctctctccttctttctctttctttctctctctctctattcaggagttctcaatttcccatttctcccggcttaaaagttaagagtaatcacgcctgtaatcccagcactttgggaggctgaggcgggcggatcatgaggtcaggagatcgagaccatcctggctaacacggtgaaaccccgtctctactaaaaatacaaaaaaattagccgggcgtggtgacaggcgcctgtagtcccagctactcgggaggctgaggcaggagaatggcgtgaacccaggaggcggagcttgcagtgagccgagatcatgccactgcactccagcctgggcgacagggcgagactccgtctcaaagaaaaaaaaaagttaagagtaatgagggaaattccatgaagtagtccaactaaaattttattttatcctagaggtaagtctgaggacattgattagtgcttatttttgttttcagtacaatatccccaaaagtttgaaaaattagctttgtcacaatacacttcctatattacatccccttctaataatttcagacagcttataatttgtataggaagatggcaaatgtttttatctttatgaaatttatgtgtacatacacacacatatatattttatatccagaaaagttttagctacatttttagtttcagaggctttgaattcattgattattgtgtaggtaattacttgaccttatatttatttgagatgatcttttattttttgagacagggtactgcactgtcactcaggctggagtgcagtggcgtaaacacggctcactgtggcctcctgggttcaagagatcctcctacctcaacctcccaagtacctgggaccacaggcatgcaccaccatgcccagctaatttttgtacttttttgtagagatggggtctcaccatgttgcccaggctggtctcaaactcctgggctcaagtaatcctcccgcctcagcctcccaaagcgctgggattacatgtgtgagccactaagcccagccactcgaccctacttttagaaaattcaatacataaagatgacatttccctggaacattctttctcctataaccaaaacattaggcatgagttacattttccatgtccatgagtagcacttcatgttattatatttcctaagaactattttaattataaattttagatgcagtgaattattttgggaaaggtgcatatccaacccatccctatttcgagccagaatagcttagattcctgaaatcacttcagttgctcctttaagaccgtgagaaaggaacatatgaatcttcacaaaccttcacagaagcttgttgaagattttggtttctaaaaatatttctatttcacttgatccagattttcatgttatatttcttttgcacaccatgaaaacaagttttcaactactcaaccaaaagtctcgggtagaaaactgcccctttatctcatgatggtatgaacaggagatgagtagacaaaacttttagacctttaccggctgttcctaccccaaatgccagccactcacatgttttctcgccctccaaattgctcagttttcatgatgctgcatttaaaacctatgtctgaaattggtagtttgctttttttttttttttctgggggaggggtgtttttacaagggagatttgggggaaatgtgggtatggagaaattttctttccattttccactggctggcactagaagaatccagtcagtttttctctgttctttttctccctctgtcctcttggtaccaaagcagtcaccatcacaaattccctttctttctattagtggatatggaattatctagcattattaagaataaggtgaaactgtctcagacccaggcttaaattgcaaaatgacaaaatatattaaaatactagagtacaaaagaaaagatacagaaaaattctacaaaggtatatatgaatggccaaactgtccaacatacataatccttgcataagcacccagtatgtcctaacagagaaagaaaccagttccagaaaaattaagtcaaaataatcacatataagagcttctctcttttagcccttcagtgacagctgaacgttggtcattaaatgggcatggaagaaacagagagaacaccatcttctgtttgaacaaaatcctgatctccaccaagaactgaaattgggtcttctccacttggaagactcctctctctatagagaaagagagagagctgtttttctttctctctctcttttttttttttttagatggagtctagctctatcacccaggatggaatgcagtggctggatctctgtctgctgcaacccccatctcccaggttcaagtggttctcctgcctcagcctcctgagtagctgggatcatgggcgtgccccaccacatctggctaatttttgtatttttagtagagatggggttttgctatgttggtcaggctggtctcgaactcctgacctcaggatacacccgccctccgcctcccaaagcgctgggattacaggcatgagctaccacacccggctctttctcttttcttttgcctcttaactccgcttctaaactcctcttgtgtgttcatgtcctaaattttgctgacgcgaaatgacgaagcccaggtacgtaccccagacaacgtagccacttcatactgggaacctcgtcggggaaaccaaggtacagcagtcaccgaaatggtgagcagaggaacggactccaactctgccctttcatttcaaggctctcggcctaaatgttagaaccatatcaaatcagtaacaggcatccgtcagccagttagaaacgcggttagcacggctgctgttcaaagactgggatgccaggcgtactggggaaaacatggagaatctcccagcacccatgggttgctgggcatgttggccacgtgtgaacaagcttcctttcatgaaggacttagccatcgcttgaagctggaagaggttctggagcaactgaggatttctggctggggctaccgcccagtattacccaaaccctcctggactgaccccagcctccaccgctggatgggttgtgggcaacaggattccaactttcctatgtagtttcctcctttcctgtctgcacccaccatacctcctgtcttttccactcggaagacccctctctatagagagagagctggttttctttattcttctgcctattaaacctcagcacaaaaaaaaaaaaaaaagaactgaagtcggttctggactcatccagggaaaatgtgctttaaatttggctgtggtgttctccagtggtcaaggagaatatgctattgatttgtgctctggcattaccactgcacactgacaggcagttcttttaaacacatacttgcgtggtttagacaatgtctgtgtatgactgaagcttcacttgaaatcctagtagttcttggaaatatgtgagctcaatgagctaaatatagtgccgacaggtatgagtgattagcatggtgctaactctgcatcaggaatatcaactttgtgtttccaatgctactttcaactttaaactcaaaggttttttatataaacgtttaataatacctatagcctttctattgggcatgaattcaaaacagacaagaaaataggtgtcttaaccacattatcactgctgatcaccaacaaaactgttaataatcatagacacagaaatctggatatgtcctctagtcatttaacacaatttttttttaaaaagtatatgtagcttttactaataaatattatataagattctgttatccattcaaatcttactttaagaaaaaagtcaatttagactaaaggccatgtatgtggtattatacttcacttttgataaaatctgattaattataaggcataatcttactttttcaggctgagggtcattttaagtgcttattttttccaaagaagtgaggaaaaaatgctgaaatgatttcaaaattcttacatgcacagtgcaaatttaaattgctgttcgaaattacccaagacccatcagaaaagaggaaaccacaggagaactagaaataaacctatttccattcttggaaaaccatcctgtacattaaaaaatgtcacgcttctcataaaaactggcaaataggccagtggaatagaacagagaatccaaaaacaaatctgcacatttacggtcaacccatttttgacaaaggcaccaagaacatacattggggtaaggacaccctcatcaataaacggtgctgagaaaactggatatccatatatagaagaatgcaagtagaccccacctctcaccacatacaaaaatccaatcaaaatggatcaaggacaaatgtacaacccaaagctatgaagctactagaagaaaacattggagaaatgcttcagggtattggcccggcaaagatgtcttttgagaagaccacaaaagcacaggtaacaaaaccaaaaatagacaaatgagattatatcaagctaaaaagcttttgcatagcaaacaaaacaatcaacagagtaaagagacagaatgggagaagatatttgcaaactctccatctgacaagtgattaataatgagactatataaggaactcaactcaatagcaaaaaaaccaccaaaagcaggaaaaaaaaaacaaaaaatgggcaaattaactgaataaactgaatagacatttttcagaagacaaatgcccaacacatatatgaaaaaattctcaacatcattaatcattatgaaatgcaaatcaaaaccataatgagatatcatctcaccccagttaaaatggccattttaaaaaagacgaaaaagaacagatgcttgcaaggatgtagagaagggggaactctcatatcctgttggtgagaatgtaaattagttgagctgttatgcaaaagaaaacattatgaatgttcagtgaaaaactaaaactagaactaccacgtgacccagcaatctcacaggtgggtatgtatccaaaagaaaggaactcagtgcctcaaagagatacctgcactctcatgtttatcacagcactattcacaacagtcaagatacgtaaccaacctgtgcccatcaacagataaatgcataaagaaaatataatgcatatatgtgtggtggaatattactcagccataaaaaagaataaagtcctgtcatttgcagcaacatggataagcctggaggacattatgttaagtgaaataatccaggcacagaaaggcaaatatgttatgttctcactcacatgtgggagctaaaacaatttgaggtagagagtagaggggtggttatcagcggctgcgaacagtagtgggggatgaagagagcttacttaatgggtacaaaaatataattattacgtacaattattatgtatcaataaaactaataaattgaaaatgatttaagttcctaaaacttgataacaaaacctcagagtaataatttttcagtttatttttttttaattccaatagaaattctattagcagaagataaaattttaaaatggtaacaaagggttctgtgcatatttggatacatttaatatataaaaacaatcccattcattggcagtccccttcttacccgccaaatacttttttagaaacagaaccacacagcccatacaaattcctggtttactagaagtcggtgtagcgtgtgtttcactatcctgcatatatcccctatgcggacaggggcagagctgtgtctaactaccaaaaacccacttggccataagggaggtggggccgaacatgtcctaggaacacagctgtattctcactacaaggactactccagccgctgtcatgggggcagctgcctgcgggagaccaccaagatgatgcagtgtttgtgatattcatgttatttctaatcaaaggaaaaaacactaccatgagggctggtgataatgttacactgaaactaacaaagacagggaaaggtacctcatgtgccaggtcctgtgccggggactttccatacactgcgtcctttaatccacacaccaactccgtgtgggaaacacagcagtctacccagcagtatactaccctaggagggctctgataggttaagtaactttcttaaacttagaagagaggactgaaccataagcccagtccttgcacttccgcctgctgtgaaagactacaggatttaagttttgtatcattatgacttagtgtatctggatacttggggctctctcagactgatcttccagagagcatgtcccccgcctcgccaccaacagtccataactttccagacttttaaagccctctgggttgtaacaaggtcaaagaattgccgttcaatgcccaggcagatacacaaaggtccagagccactgctttttctatagcaaaacgcacaggatcactcctggctgtccctcaggattttaaagtgacatatcacatgagccatacttcatttcttcacggctaatgtccctccagaaataccagaaatcagtatcataacaaacctaacacacatcacagttcccacttttcatatctaacctgcatctaaatctgctgagcgtatctcggagcctctctccagtttgcctccttgccattccctccctccatggcggactttcctcttctgtggccctgagtgtttacggcaagccccgcattggtatctctattagaccctctgcccctcccagtgacgtcttgatcctcttctgctcgggcaccatcttcttcaaacagccttctctggtcccctcagctgaactgcaggctcctcttctgggcttccaaagccccgtgcacatatcatcgcatcaatgatgcccagcactggaatgtgtttgtctgtctctccccacaccatgggcttgcgggtggctagcacaaatacaacttcatacttctttccttcacaggaagcaaaacaattcgaaacaggagttaagactgtccaggagaaaggggaaggagcccatggccatttcgtatctcttcatagctactcaatcattaatttaacaaataacttatcgaacttatactgtatgccagataatgtgctaggcactccaagggcagaagtgagtgcacacaggggcaaacaacacagcagaggagtcagcacgcaaatgtaatatgcaacgataaggtgcagacaagcttctttgggagcacagattaggaagacaaatcatgtctaaaggattcaaagaagactgcacaaaacctggacatctgagcttgggactgatgcatctgtgggagttaaccagtaaaagacacaaggaaagggcaggctgacatcaaaaacaccagtcaaatcaatcaagccataaccaggccttaaacccagctgctttctttcaaaggagaaaagcagcccgagcaacacagtgagactctgtctgtacaaaaactcaaaactaagcctagcatggcggcacgtgccacagtcccagctactcaggaagccaaggcaggagcatcgcctgagctcaggagcttgaggctgcagggatccgtgattatgtcattacaccccagcctaagcaacaggcaagaccctgtgtcaaaaaaatacaagaacagtaaataaaggagaaatggcctgaacatcaacttcaactcctatttttcatagagcagggccattactaaaactcccttgaaatatccatacaaagacaccttctatcaagccatgattatagtattttcttcaatatttattggaaattacataaaatatttcccccatgaacagcacacgtgcaattctgtgagaacagagtaaataaaaccgatatatatcaaacagtaccttttctgcagttgagaggtaagcaaaagcatcctctgtttaataaacaagaaaaaaatgttaaggaagaatgtagaataggttgccaccaaatatgcaaatgcattcacgcttaatacctattcttagctgaagtgtctagaggttgctttgtgtcttgcgcatcaatctcagagcaagcagaatagatgatctgaaatattaatcctaaacgggtcttgccagtgggcagctgtgggctcgcagaacctctgtgtagacagtctcattacctacttgttcaggcctctttgctggcaaaaagtatagctgaataaacagaaagacaagatctgcaatgcctcagcgctcagaaaattatgacgatgggaagaatgaagctctgaggtcaaaatcttttaaacagcaataatctttgcactacatcagacacctggcaatctcagtccattgtacttatgggaatgctttttagatgttctgattaatacgggtacttgggagcctaaacacaaagacctaactagaatacattgcaattctgagcctcaggcaatgtatatgaaaaagataccagaactaacttttgttgaataaaaggattcacggttcttgcaaatggttatgattgtaacaaatgtttatcattgtaacaaatggttatcattgtaactctaattccagttacgtgacaacaagtacagtttatgggaaaagacatgtgcaacaaccaccaaatgatctgtccatcttaccaaagacaatgaaatgatgagtccctgctagtttctagatattatttatccaagttgttgatttgtaggtgctcattccattttctcctacataatccagtaatctataatccagtaagaaactcacaacatagacatgcaatttacagtttctgcatagggtcattaaaaattctttcattacaaagtatttcttggattcttaaatatttggaaaatgcacaaaacacgtgaaaaatatagttgttcagacaaagaaacgtcattctgatctcatgttttctccccaggaacagacttcacagcaatccattccctttacatttattgtttccttaacttgcaccaagcctgaggaggtcagtgcttggcacacattaagaaaacaataaatagggagggggttacaaactatgctgattccctgttctatgcctcactctgggtgaattcaaccgtctgaagggatagcaaagtcagaagtatgtggcaagcagcaggatgccgagatggttccagctcagacaaggttccaggagagagagcctacccatctttcccaggccaaaatgttttccatgtaataaaggtcaccagtggttgccaatatgcgtatacgaactatattggcttggtcagagttagctggaaaagcaaaagctctgtagtactccagagttctcagatagacctgtccaaaacctctcattcctttgttccaacctttaatttccaacccccacaatcccaccccagtttccaaccagtactttcaccgagagggctgtaccactgcctgagaagtcacacaataccttctgcttcgtgaccaactcagacttggatatctacctgctacctatcatatcaatatgatgtagaggagtgtccggggccctagacctaaatcactttgtgtggcacctgcatcagccttccttagtgacaatcttaaatctagttggttttctttgagaatttatttccttcccaagtatatttctgtgattaaaattatgtggtgtcagaagtttagtttcaattatattttacagacacccgtctacattaaatttaccttcttgcttttccaccatccttagttttgtcgtagtgtttttgttgcaaccctgttcttccttcctgtgtctaattatttaaaaattaccactaaactgatttttatattttatttccatcaagataaacaagatacaaatagatgccctcaaaaaagttaatgatcaattgggtaaaactatatctatacccgcacccaaaaagacaacataattcaatgcacacatgcaaatcaagaacaagaaagatgatggaattagctccaaaactactaaccttcacattaatctgcctcttgcatgtcaatagtttatttcaaatattcggtccctgtcaatctaagaaagtcctaaatccaaagccctgcgggaatgacatgagtttcctggtgtccagcacacgttcgaaatcctgctgtgtgaagagggttcagagaggccaaaaggcaccattcatggactttaggagaaaatattttgtattttgtgcatttagaaaaaggctacaatttgaatgtttaaatatttaaagccaataaacaaggagctattatttaatttttaaaaaatcttttttcaaatttccctggaatattttatttcatttacaaaataaatgtatgaagatgacaaaatcttagaacttttttgaggctgagtgacacactttatctatactgttctaaattttacattaacaaaattatgttcatcacttagaatgtgacattgtatttagaaagtcagcttcccttgtcctattaaaatggtatttagattgtaagtattttattatactcaacttttcaaaaacataattattatataaagaaagatatgtgtagttatatgtacatgtatatacactcacacacacacatttgtaatcctttcaggcttacacataaacacatgttaaaatattgaaaagcagctccaaaaataactaaaatgtcatttgccaaactacttctaggctatctctgggaatagtagaatttttggtcataaaaggaacaaaacatttcctattttgcttttctcccacccttttccagccaacctcttctaaccagtctccatctttaaataatgctagagacctacaatagttttcaactatcagatttaatctctttggttgtatcagactgataagttgaaaataaatggtaatagccagtttgtgtcgggcctatcgggcaagttgtttcttcagaataatattcaatttgatacgtattttgaaacaaacatttactttgtttcatggccggctgtgaataaacagttctctaagttattagtgaagggacagcaaaatttgaccattctatctacccatctgcttctctgtggcaacaaactgatttccatgggacgcttgaataaagcaaggctgtctgtccaaaagaagtagaactatgtcctcaataggcaatggaacaatgactgacactgagtcctagcactgtcaccaatatcccgaacaatcaagcttcaaacccaaaaaggtgcaaataaaatttaagactagtttgggtttggtcccaatggggctaagaaaaactagtgattgttgaacactggattcactgacaactggagagaaaaaattaaaattccaacattatgatgtcaataataatttcatctgcagcaacattcaggaagctgatgagatgatcctaacgggtgatttaaagtgaaagggaaaaaaaacacccttggcataatttaataagatcttcagactgaagcatattcaagggtttcatgaaagaccttctcatggccttttaatagctctttccaattccaattaactggttaaatgccaattctcattacctcatcagaaatccaaagccagtcttttctgattaaatcattaaataactgttaacagtacaatgactagtaagtatttatggacagcccagcactgatatgcagctttcagttctccgtgccaaaggaaaaactggagtgggcgatttaaaatcataataaattctattcatcttcggaatgtgctaggatatatttatctaatatattcactcttcttaattgttttactggcactaatacatagattgggaagacaggcatgatggctcatgctggtagtcccagctactttggaggctgaggtaagaggatcccttgagcccaggagttcaaggccgtggtgagctatggttgcgccattgcactctagcctggtgacagagcaagacttcaacgcattaaaacaaaaaaaagtttattttagattagtataagcttttcatactctctaaatagactgcagaaatgatgattaaaagggagttcatttttgtggaaaagccaggtaggtagtgaagaaatgggaaaacatgtcaactgtgacctgccgctgcctggcagcatgacgagtcagatggccccactcaggagtcactccaaggcctgtggacgtctccactgggcaattaccacaccaacaggcaatgcctatgtcaactcataccaaagctcactttttccacagatctgcctgcaacccttgctttccctcctccctgactgcttgctgacgctcaggactggacaaacatggctcaagagaccagggttctggttccaagtccaagcttgtcaccatcctcccaagacagaagatattcaccctcagagttggaaaaggtcggctctgccacgtcctctttccttttgcacttttattttttatattcctgagcatcctgggacagagctcctctgagaaaatgaatgcgactctccagaggacgatccacagcaaacccaaagcctcctttgcttacaagttatagaaagatcccacgaacactctattctctatgcaacttcttgtccatgcagtcttaccatgaggaggatattatcatggagaaaaacaggctttgacttaaaaaacaaaataaaataaagcataatcaactaaaactaccatttaacttatgctgtaggtcactgcagcaaagaaatgatcaagtttcagtatcttccagaaactagataaatcgtcatagcttgtttaaatgaatacatcactagtaatatgtatttttaggggttttttgtttttttttttttttttttttttttttttacagagtaagacgcttataatatgtgaagttctgtccacagttacctgagatgttagggttagttgagcttaaaatagatacttccaattagaagcagccaaatataattttttatgtgagaaaataactgcaatgctagtatgaccctttattttcctagggctaaagtcagaaaacagaaacaaatataaaagtatcacattcatgtcaatggcttagtgaagacaggaccttattatcctttaaatgctgcttaaaatgctcccagactcgcccgtttatctgctcctcttccagcagagtgtctggcacaaaatggctgttccttcaatctctgccaatccccatccacatctttcaactggcaggaatttccctaattaaatgctacctgcagtatttttatcacactctcaatcatcactgtacttaaaagcttagctcataactgtcttttaatactttaaaaaatatggcttatgtaaattttataaaaatcatttaattgtacattgaaaatggtattttatggcatgtaaattatgttcatatgcggttaggttcttgttctcaagttatttcattttgcttctttttctttaaaatttattcaacacaacagttcaaggaatgaaaagattccctctttttctttaacatcttttcactcttcccggtaggcaagcgtaagataaacattaagtgacacataaattgcctctttctgtcttttgagctcaatgccctgaaagcagcccaatctcctaccttttatgtttgttggtaaatttaaactgaagaattaaacaggatgcaggtgtttgaaattctctttgttcggcctacgtaaatacctccattatccattttaacaatctattcctaaatgctgatgattcccaaagttctatccggctttaatttctccacagacctttgcatctgagtacataactgcctgctaaagatctccaggcacctcatatggtttctggagctgaactcatcatccttcttcccagcacgcacaggctcttagcaatgcttccactatgtacgtagctcaagcttgaacctgtgtcacctcgaactccttgcctctctcctactttctgacttgaatccacctcgatgtcctaccaattttactttctatttattaactctttagtctgtccccaatattgctgctctagttcagattccaaatatttctcacctgaaccactgcaccgtctctcaggtgtctcccttcttctctacatctcagatccccttctccataatggccagcacaatcccactgaaactccatttggttgcttacttctccattaaagggtaaaccctttaatcgctgttcctctctttctcactcaaccacaaattctcacatgccatatagaacccagcctctgagaatctggccccagccatctcttcctctaaaccctacagtcccttcttggaatgtctctcttgttttcaccggctagcacgttctcatctcctaacagtattctaggccaggcatggtggctcacacctgtaatcccagtgctttgggaggctgaggcaggaggattgcttgaggccatgagttggagactggcctggccaacaaagtgagaccttggctctcaaaaaaaaaaaaaataataataataataatcctacctactccggaggctgaggtggtattaaacccaagtgtttaaagcagcagtgagctatgatcatacaagtgcaccccagcctgggtaacagaaggggaccctgtctctatcaaaacaaaaaacaaaaactattctccttcactgacattcatggccccacattctcagcaagatttgctaattttgctacggctcctgtgagcctatccactccaaccacactgctgtatttaagtgcctgtcctccactttaaaacgtgagctacctgagggcaggatttatgtcttgtatttctatccacaactcataatacaatgattcttacaaggtaagctgtcaataaatattgaagaatgaacaaatgaatatagggagttcaaacatgagaactaaaggtctatatcagaaaactgtcagtcaagattctagctgttataatacagaaggccccatcacattccccaagacaaatttatattttcccactgtccttaattttatttcttatactctcattcctgaaataatgttgattattttgagaacagaatattaaggctatcgagagtgatgcttctctctcctcttggatgcaaaaattatctgtatcttcatccacaggaaaacatgtccctccctgtgattcagtttgtccatgtaaaaagaaaaaaaaaaaagctcgtgctcctcacctggccccccatctcttcccaaaccccactcattcactttcacctctgagacagccctcagatttattccctcctctaaattcccagagccactgctatagttgaggtcgttatcatctcttatttagactgttttgacaacctcttaactaatctctccccttctagtctctccctttcataacccactctttatgcgcctgggctctaaccaaaactgatcatgccttaaaatcttctcatgtgaataagaaaaagctcaaaattattagtgtgaaaatcaaagccttatactgtcttgcttcattctacctttctaacctcacctccctgggtgcattctagaacccacccatctgctgatcacttctcagcaggtgctgtgtgccatctctcctcatttgtgctcatgcttttttcctttgactttatccctctgtcaccctgaaaactccctactcatccttgaagaaaaccttgttcagatgggccattcttctataaaacctttcaacctgcccaattacaaatcatgactcttttcagggtttctgtagcatttatcttatacgcctggtatggaacacaaactattagttctagctccactctaaaatgggagctcctttgaaagaaaagtctatgaattacacatctttgaatattcactggctgagataaggcaagaacaagtcttaccactgaattttcaggagcacctaacaaagctccaagatggagataaatttgtggaataaaagaatcacccacttgtaagagcgaatatgcagaactgggtaaatgagttaacataaaatactttgaaaacataaatatgtccaaaatgatttaaacatttactgtgaaacatccctggtatacaaagactagaacggtgctactcagagcatgctgttcaccagagactgttgtggatccactgtgaaataagaaacaaaataaaaagaataagtatttagaaatttctacagcaatgtgacacggctgatccatcaaaatgcaggctgagtgggctcgtctcctgggagaaggtactggctggttcgggtcttgtcgaacttgtgtataaaagtgacacatggggcaagagctgcaggctggtcatgttgcaataggacgatattcgtctgggacagactggaaatggggggaaaaataacacaagcctttcgcgagacagtttaaaaagcaaagggagtaaaataagaaactccagtgtaccagaaccaatttcctcatgtttaccttccatattcgcttgagacctttcctccccatgataaaaaaaaaattatagatacagttgaaaccacctctatgtccttccccaacccttgcgttccccctcctgctcctatatcattttttaaataggctactgtcaaaggaaaagcagagctggagagcagagcaatgaaaatattttttatcaggactacagcaacagggggaaagagatctcagtcaagaccccaggctgaatccaaacacagcatcggcaagtgggaatttatagccaaagaggagggtggcagtcggtgaatgaaaaattattaagaggcaaaatcacaggtaagaggacattctggccacaccatcctaacaggattcttgccaaagacaggccaagatgatgacacatcacccgatgggggatgaggaagccgatcagacactgagactgatcagatatgaaggactggggttctggctaaattgacttagcagggtccttgctaaaatgcacagatgggccctggtggggacagagttcaggaacctgactaaagtttagaaaagcaaagaatctttgtcagcaccaaatcccgtttaggaggatgaaattttcctgttgaggattagggtcatgttttatttcaccaaaaaaaaagcactaaaaatgaacaatgatcaatgttattgtacagactctagcctgctaaatattatgtgaaaaggtgctgtgcccccttgtctgtgacccttcagccacaactcatacaactcaactcctgaactccaagtgaaaggccctgtgctgccccaacctgcagagggagaaacaccttactgaaatgtctacaatttggaaagaaagactaaagagcatgttgtatggctgtagaaagaataacacagacaacggatttattgctaataaaacagactaagaacaatgggctgatgagacttaactaaaaagatgtttattccaatgttagaggttacctcagagaagacacacagagaaaagaaatgcccgaaatgccaggtggaaagtaatgggctttccacggttaatcaaatgggcactgccatgccaacgtgcctcctgaaattcaaaccctctatttttgcatggctgccaactcatttccaaaacatccactgctaatcaaacttgtttggctgcctccttatcgaaactttacaaaactttaatttcagcctcatgagccctgcagctgtaaattaattgaatgaaattgacaaacattatgcagtgagataaagcactttcaaagtcttttccctattcagttgacttagctgcccagcatgccagttttgcttgacatgagttcagaatccctggaaaccttcctaatcctactctctaggccttgtgcctattcatggaaccatgttaacccatatccggaaaattaataaacctcggatgggtttaagcactcaaaatactcctgatacttcttgccattcattacattgtagacatcctttgcaacaggagaatcctcctcaaaagaccacgacggcagcagataaaatccctgaggttataagcatacaacaaaatgtctcatttaagattactgcagtctgaagccaggaattaaatttgctgaaggtgcagtcacttatgccttagttaaataaagatagtcccaaaactgatttctgaacttacccatttctcaaagggagtgcaaaattatcatgatttttaaacagcaaggcgagtaaactgatcgcctctgtatctgccaactgaacaaatgagtcagctaatcagtggttacatacatcacactgacagagaggagagaagaccattaactttctgaaatgagaagtcctaatataccgaggtgccacaagtcacttaggatttccgtggttatgaaagaagaattgaaacgtctcttccctctggtgggttttcacagcacaactgccacagcttccaactgaggtctagtctctgaccttccctcttcatcaatgttatcagcatctggaagccctctggcctatgtggagccatggggacaatggaggcagtttcaaagcttctgtcttatgacagaaaacctgggtgtaaaacaacctctgatatgaactactaagggacttgtatagattccttaaactctccgaaacactgttctcaacagcaaagtgaggagaaaaacagctctcaagtagggttggtgtgaacgtgaaaaaagagaaagtaatacaagagttgggcatataataggctcttaaaaagaattttgaaggccgggcacggtggctcacgcctgtaatcccagcactttgggaggctgaggcgggcggatcacaaggtcaggagatcgagaccacggtgaaaccccgtctctactaaaaatacaaaaaattagccaggcgtggtggcaggcgcctgtagtcccagctactcgggaggttgaggcaggagaatggtgtgaacctgggaggcggagcttgcagtgagccgagattgcgccactgcactccagcctgggtgacagagcaagattccatcgcaaaaaaagaaaaaaaaaaagaattttgaaatggaaatgtatctatttttcctttctttagaaaacaaacagaaaatgaagccaacatatctcatcacagattgctctttaaatatgcgaccttataccaaaagcagacaagttcacaaagagattatttttataatttaatcacagaaaagactagactatcaggtagttggtggctacagaagtgactgctccccactgaagcaaggaatggatagaataagtccttgaaataaatgctcaggtcttcccttagtaattctggacagtggggaaattagctcattcaaacaaagtttattaaataaataaaatcccagcacttgtctctttagacaaaaaccacatggaaacaatacaaaagattgctaatgctttggcaaatgaatcactcttccaaatgccatttacaaaagcccaccagacctccagctgtgctgatgccatgggaacccctagggcaattataagtggatttaactcaagaccagaaacacaggagtaatttttaaagacccaaaaacttccaaataaataaatctggaaaggaattactgtttacaccacagagccacaggttcaaatagccaaacttaaagaagaaaaaacacacatgtatatatctacttcatcatgtaatctctgaacaataggaactttactgagttgtcactaaggaaagagcaaaatctaagataggtagtttctggaaaatgaaagtccagagaaacttggccataaaatgaaaattataacggacttacagagctcgtcttctttgggttaagaaacaaaggtcttcttgtgcaaaggaagaattcgaaagaggaattcttaagtagatggctgatgcatccacgtctaaacatccaaaatctaccaagcacctattacataactaagccctgtgtcagaggctgtggaacaagaaccactaaaacttatctctgacctcaagaagtttatagttcagggaagtgactgacaatcataatacagaggcataagggctatccaaatagggtcacaggttacgctatgaatacaggtatcacatcagaaaattaccgtacttaaaatctcagcaaagagatcacaccctcacacaattaatgttatcaacatccatccagtctctcaagctcaccctcttcaacaatctttgctttactgagttccgggtggactatttaaatatcatacaaattgattctgacatcacaatcactgcctgcttcctaaaacttgccctccaccgtctattataaatgctttccaatcagtgctcccattcttcattctattcaccacttagttactagaatgtttttctcaactatgaatctgacttcactccctttcttgaaaacctcctgtagttcctgttgtgtacgggataaaggtcagacaacttagtatagcccagctcagtccagctagcaaagcaaatactagctttattccctgcaagcaacgtaagacaaagacaaccacactaaactcagtattagcagaccaccatcctccctgaggcctccactgctttgcacacactcttctctttctcagaaggtcctttcccctcctcctgttggtgcagccaattctttctcttccttctaatgcaccatcttctgtgtagtcttctttgacactaggtagggttacatctttgctctgtgtttctataacactcttcatatgccatggaactgcattcattatattggtataattttatttgtcttttttcttcctagactgtgagcccctggagttcagggaccatttcttaatcatattccagaacctatcacaatgaatgacacgaagaatatatttgataaaaatctgatgaatgaaccactctaaaatgcaactctaataaagaaaattactgcctattcagttggaactgtaccatgttacaaacgtaaaattatgtatagtctgataaagaaatactataatagccttggaaacagctcacatacaattttttttataaatggattcattaccatataactggaccagcttactgaagagtagccctacagcagtcacttcgcagtttgcaattcatttgaggttcaaagctagctcaagggaaaacaacgttagtattaacaaacttatttttaagcttaaggtcagaatttaagggaaaataaataaatatagtatgttctaagaatccaaaggaatttttaaaaattgccccctgcagctgtaatttctgcatggatgagaaaaccttaattgcttgctggcttccaagaaagccattaacctgcatttaaaaattcagctttcatcaagaacaacctcacatatccagctctcatggaaaaaggaatagaagcctctgacctagttttcaattattaccaaactactgataattgatctcctggtctccaggtttgtttgttttactaaaataaattccctctggagctgcaggtgcttaccatggggctgcgcaggtggaaagcagcccagtcttactatgaggatgtccgtttgccatctgggaacaaggaggaagaagcagagacctgggcaagacctcagagtaagtgtcctttttggcggctcccaggggtccccatcatgtgttataggaaggcagaattatttgagataaggataggagctgaaataagcagtgctaatactggttaaaagttggtgcttcagctgcagtcacaacagataatgtctcttcagttatatttccaagctatttctcatttggcaatgtacacttacaccaaaactgtgaaactctcggaagtggcagaccttggcaacaagtgaatggaaactgtgaattacagtacatgccactgagtaaggggtgcacatctagaaaccagaaatcaggttctgtcttggctcagcgtctaactagatgtgtggacttagacaagtcatttaaccattggggattcagtctcttcatctgtaaagagttcatttagatgatctcttaagtccctaagatccccattgttaggtccagggtcaggttccagcccatgctgaggccggaagggagtgggtagatgaatggcagacagctgaaagaacactcagggggctacgggtaggtgaaatacaattttattcagcagctctcttacactgtgtgtctcggctgcttgttccagccactcccaagcacagatctctgctggctctctctccctttggggtcaacagcttaactctttccctctgagcgcaagcaagctgagctgtgtcctggctccccgctgcaagacagacagatctggtgctctctctctttctttgggtgcaagcacgcctgcacagtgtcaccagggcaattataccttttaaagacaacagtggcaaagagccaagtgatggccctcccatgttatggctacatagctgtttatattacacatggagttgcgcgcctgcgctacagacttgctgagtcacccgggatgtttacctcagcccatcctgcctggctgcagtgcagccatgttccttacacctaccaatttaaaagtactgtaattccattttaagggttctaaaccatgaaccatgttcatggtttaggattttagatatttctcatttaaacttaggagcgaactctgcattaggacatttctcctttcattgtccataagataactcaccaaatccttgcgcaaagagaaacaaatataaactacataagaaatgacaggtgagccttaccaaggaccctgacccatgcataacatcttagtatagcatatatatatatagtatatgatagaaacatgccgtgggctttcataccctctacaatagttcattataagtttcatcccccaaagaaggcaacttacatacttaagtttttctaaatagaatccaggtgctttcaccagtgatgctctccaagggatcccatcatagtaatcagtctagccagtgccaacttcagttctactaaatttaatgccctcttattttgactcaggaataaattatctcaatggctacttacatggtccagcatagcagaaaaaaaagccacactgagcaagcagtggtcctttccatgctacacaagcaagaaatgcctataaagacagacttgagtgcagtctaaagaatcttttgctttgccttaacactctacttctggatatccttgctcaaaaagaagtctactcaaggtgtgtatctttcctctttataagccctctggcctcaggaagactggtttcattcatgtggtcatgtttttgcacagcttaagactaaactgtatgatccttccttctgggctcctacaagggcatgccaaagtcccctcaaataaccaaaacggtgcacatcccctttgcgtcccacagcagtctgctagtttatgtaataccataatgacagctatctggagtggaacagtgacactgctttttcccagactacttcaccatgtgaggtaaacggtagaggcagcaataggtctgctcagtctatggctaatacaagaccttgcttatgatagacttcaagagcttcttattagccagctgttaattcatacaaactgcacagaaattcattctggagcaatattatttgtttcacattatacttaaccttgaaaaggttagtttttcaatgggggatgattatcctggatagatgcataccccctacaaacatgaaactggcaagttcactaaagatttctcaagagccaccaagctagcaaaagtcgcaaccaaataatattatatactctgcccttcagagcaaccttcttcatgctgaagtcttcagttcacagaatgactgacttattttcaaaagaggaaggctgtattgcatattgtaactctctccaaatctatacttatgagctaattcttcaaaaggtaagatcaattaccacacagaaggagaagccatccattttcttgaagctgtcaaaatttgagctgtctcccataggatttccactgacagttaatgaaaaaaatcagtatctgtcaattttggaagaaatttaaaagtggtaagatattcttataaatcgatgttaaaattttggtataattattgtatatttggattactttatttgctttcctccaaatcatttctttactaaatttccctaagttagcttaataatgaggttttcttaaggagaaatctgttggttatacacataaattgctaacaaaaaagggatcagagctaaatggatccaatttttcctccttcatatgctacaatacaaggctactgcagaatttacaccgtgaataatgtgtattttgaaaacccaagcttagaatagtagtattttgtttcactatcaaaagacaaagcaaaaaaataaaaaataggctacactaatgtacttttaaaaatatacttggaaaagaaacgaaactatttcatttaatgctgtcttatagaacagaaatgccaatatatttacacagaaataattcagcatcttgaagtataagtaaaaacactaatgaagaccaaatttttagagttatttcatacaaatagaataaatttaggcggggcacagtggctcacgcctgtaatcccagcactttgggaggctgtggcaggcggatcatgaggccaggagttcgagaccagcctggccaacatggtgaaaccccaactctactaaaaatacaaaaaagttagccaggtgtggtggtatgagcctgtaatctcagatactcaggaggctgaggcaggagaatcgcttgaacccaggaggcggagcttgcagtgagccgagatcacgccactgccctccagcctgggcaacagagtaagactctgtctcaaaaaataaataaataaataaataaataaataaataaataaataaataaaatttaataaaaagagactacccattgtttccactagaattgctgccaagggaaatataccttttaaggatcaaggcttagaattgcttttcgcttattagaataaaatctatcagcaatctgaagaaatacataaacaatcagcaaattctagttagatggctacaaactaggtaaattactaaaatgtgccacatgaagataaagttagtcttggtaagaacaaaggtttcaaataatttttgctcttagatgtttgctgacagataaaatagagaacttcattttcaccaagtaacgcaaagtataaaaaggcatcggtatagtgctgtgctgcttttgttaaaatggtacaaggaggaaaagagagtatcttctaaagtccttgaatgggaaagccgtagtttatcacgtcgtattatcactttctatttacacagcatttgtttctcccacagacagggaggttcctgtggacagaaacatctgcttcctgcttatcctgtatctcagcatctgaatggtcatgactggaacacaggcagacttcagaaataaatacataaatatctcatactcctcgaatcttttagaaaaagagtgtgggtaacaataaacatatctgctgagaaatgaccacctcactctactcttctgcagacttcccattctgtgccgagtcaccctcagtaggcctaagtgtgacgatcctctcagcactccctgtaaacctatttaggaatccgcgaaagaaagagaagaccaccaggcagactggtgatgatatttcttggggaggctgtgcagtttttcatagtgaagcctacaacttagattttcagcactaatagaaccccattatcaggaggagagaaaagcactaatttcagatgggctctgacaggggacagttttaagaatttatagagagacatttccgtgtccagccaggatgtaatcatggaaattggatttaccttcccatccatgtgtaacaccaacatccagtggtttttcatgatactgaacaaaggcagcaatcactgagagactgggaaataaacaaaaggactgccccaatttattaagaaagcttccagaccacaatgaaggtaggtggtgtggagtcctgacaaggtaagttagcaccaacaaggaagaggccagcccccgatgggggagaacaattgttctgagagacagctaatcacaaacaacctgcttgtacaacatcctgttcccaaataccttgctctgcatataccccagcagcacaatcctctctgcacataacccctccagcatggccctagaaaacttcctttcagcccctgcctcttggcagacagcctcttctctgctgtgccggccattgcttcccgctaataaacttgttctcgtttttgttgttgttgtttcgagatgaagtttcactctgtcgccaggctggagtgctgtggtgtgatctcggctcactgcaacctctgcctaccaggttcaagcaaatcttgtgcctccgtttcccgaggagcttgggattacaggcgcccgccaccacgcccggctcatttttgtatttttagtagagacggggtttcaccatgttggccaggctggtctcgatctcttgacctcgtgatctgcccacctcggcctcccaaagtactaggattacaggcgtgagcctccgcacccggcctaaacttggttttaactcgcacctgtttcagtaaattatttacttcccgtgaagccagccttagccagtcacgctcacaacaagtagaagccaggcggagcctgaaggaggccctgagttaaggtgacaaagttgagagtatagggagaccaaaaaaggctagagtttacaggacagaataccagagaggaaagaagtgtacagggagagaaatcaacaaatctgcagaaggtcagccttaaatattccacggagtactaatcagcccatgcacatgaacatactgcctgaagctgggacaggaccagctgaaagagttagaggtaacagtagcaggtgctcaaataagaccacgaatactgcctgctcccatcaaccagagtagaaaacctcaaggttcaaggggtattgaatagaagacccaaagagccttgcctcagtgacttgccctacactaaatactgctctggtcccacctaagaaagattaaaagcaagaccccttcccctacacacactaaataaaactgtttccaaataacttcactgtgttacagggggaaaaaaagctcaagaataatttgagggatacaaaaatagctagtacccaaaaagataaaataacaacatctggcattcagtcaaaagtcgcagcttcaagaggacaaatacacgtgcagggaaaaagcagcatggtttcactggacggcagtgcattttcactggacagttgtccccagtgtcatagatgaggtcactgatgacagaaaagaaaaacatttcttgaagaaatcagacatattacttttatacaactagtgctcatcaaataacaactaccatacagagagagaatgagatgactagcactggaaagagataatagatgagccactgagtactttcaataagaattaattgtaatcatggctgggcgtagtggctcacacctgtaatcccagcacttccggaggccaaggcgggcagatcacctgaggtcaggagttcgagatcagcctggccaacatggtgaaaccccatctctactaaaaatacaaaaattagctgggcgtggtggcacatgcctgtaatcccaagctacttgggaggctgaggtacaagaattgcttgaacctgggaggcagaggttgcagtgagccgagatcataccactgcgctccagcctgggcgacaagggcgaaactctgtctaaaaaagaaaaaaagaaaaaaagaattaactgtaatcctatacctcaagcaccctgagatggacacacacacacacacacacacacacacacacacacacacacacacattctgctaaatactgtaccatgctataaatcctaaccagtagagtacagctaacacttcacttctcactttgtaaatcacattgaggaggtttctttcacagcttatcttatgaaatggggctgaaacaagtcaacagattaaatttatcaaaatataaaacacacataatggatttggaacagaactgcagctgtatcttcactggctctcctgcagaggaagataccatataactcaatgactccttcttttaacttgtaagtcagtgaaaagaggcactagtttcctgttaaccactaaaccttgtccattatcttaaacatagaatacatcaaaacacctgataggttttcagtgagaagccctcagctatgctatcttactgtcctgaatcacaggaaaagaaatatagaatattaatgagaaatagaacagctttcatacatagcacatataactagttagccaggcccatcaacatgacttggccatcatttacagaaaaatagtattgctttaattaattaccacattttcaaaggttaagggcatgaaaccaatcagtcagcttaaaccttgttcctttcaacaaacgggaaaattttcacaggcaatactttaaaaataaaacaaaaaaattagactgctaactgactccaaaaccaaaattcagtcaaaaggcattaactcccctgaattttaacaagaaatgaaatggttttccttaaaaactcttactccagtggataaattataaatattagaatgaactgcaaaaacccactagagcatctgcttttctataaacacatagaatgtctactggaaaacaagccccactgaaagctgtactgaattacaaataatccactctacacttgcttgtcagatcttagaacaaaacacacaaatatatccacttcgcagtatctgtataaatggacaagtagaaatccgaatcatgttatctgaaaatgttttgcaatcatttttagaatttaataaataaaagataggactttccactttcatttccttgtagtgtatttacattgcacagcaccttccgttagaaggaaccaacacagatgtgggctttctagttggtttctctgctgcccccttctgcttcaacaaaacacagtaggcaggcaacccagatgccaaaaatacctctcgaagccaggtttcgcagaataaacaaatccaggatgactgattatctcattttttaaaagcattttcatattacaattgaaattatttcacgtgctttctgaaatctgatccaggtgtctggttatacaaactcagtaatgacaaggtaaggtttccctcccactcctgaccccagtgctcgctcttgcgcactctctctctctcccttcaacttagaaacccactatgtcatgcaggcagccagaaacttcaagaaccttttttatttcaagttccagggtacatgtgcaggatgtgcaggtttgttacgtaggtaaacgtgtgccatggtggtttgctgtgcctatcaacccaagaatcttttatagtaaaaacataactactttaaaaacttggttctttcatttccgaaaaacagtagaataacattatttctttgcattggtcaaattacatattctttctgtgacagaatttctttctgctaggaacttaagagataatagttacaatatcacgatcatcacacatagtacaaacagtataggtcctaggaggcaaagaccaataactgtgtaatgctgataatgaacttttaaaggtaagggactacacaaacaatagtgattccgaaaatgctcagaatatatactgagcaaaattctctgcaacgaggtatataaacctgaagtgctaaaaaatttcacaaataattattttaaatacacactaaaggataaatttaaggtaaaaacagtagctgacttttagtttatttttccagaactcaaatgtcaggccaaaaaagtcaaagcagaaaacatcataaatgatacctttaaggttattcaaagagtgggaaatatttttaaagcaggtgagatttttccaagcagaaagtgcaccaaatactgaaatcacggaagacagaactcaactccattcctcacctcaaatgcaccgaagacccttagagacaccctagaagcctccattaaatcccatcaggaagttgcatgtgcaggtattatgtgcaatatggtgcacctgcaccccaatgatccaaatgcctcaagctagaaccatcactgacgcttactcaagaatgtcagcgatgggaaacattaaacgcacaaactgtggcgtgttcgtttctgctggtttcataccctttccaacaaatcctccatcctctgccagggaaatctttgtaaatcaacatctgatgagacacctccaggtgatgaaaaatgccagctagtctgaaatacccattctcccttcttccttgagactcccaatttttttttaaaatgtgtgctaaagagaagtgttgtatgaaacttcaccagaacttaaacttaaaaggtatgaggcacgtgctttttttttttttttggctcttctgcctttctttctcaatgcaggggtaatggctggagctccagcagccaccttgaaccgtgcaggaccttaaggatgaaagtcaggtgcagcacaaccaaaagaaagattgacatctgaggaccttctaaagatgcttctctagacttggaatacttccctctagacgtcatttatttttatttttaattttattatttttttagagacaaggtctcactctgttgcccaggctagagagcagtagcacaatcatagctcactgcagcctcaaaatccagggctaaagccatcctctcgcctcagctttccaagtagctaagactacaaacgcatgccaacatgcttggctaaattttttttttatttttggaagttggtctcaaactcctggcctcaagctatccttccaccttggcctcctaaagtgctgggattacaggcatgagccatcacacccagccaagacttctcctatttgagagtataaactgttgtatctttctgccactgtagttgggtctctgtcttgcagctaagtccaagctgtaactaaaacactcactctttttgttctttctttttttttttttttttgagatggaatctcactttactgaccaggctggagtgtaggggcatgatctctgctcactgcaacctccacctccagggttcaagtgattctcctgcctcagcctcctgagtagctgagactacaggcatatgccaccatgcctggctaatttttatattgttagtagagacgggatttcaccatgttggccaggctgatctcgaactcctgacctcaggtggtccatccacctctgcctcccaaagtgctgccattacaggcataagccaccacacctggcctaaaacactcactcttgaacaactctctatcacctaccagaagttctaagccctgctgcctcgccagtttcatctcctgccatgtacgacatacactatttttcttaagaattctattctctatgtctctatgtaggagaggaaaatgtttcttttcttacccatcagttcgtggctgagatccctataacaaaagacagattgacaagagaaaagcatataaatttattttaatgtaggttttaagtgacccaggagccttcagaaatgaagacccaaagaagcagggaaattggtctatttttatgcttaggtctgacgaagaccagagagttatggggaagtgtgattggacaatgggaatatgatctaatggtaataaattggggaaaacttagcaacgcctgtttgttcacattcttcttggtatctctctgcctttgaggataaggatggtctcttctccaggtatagagagtatgcctctggaatgaaggatttataacttgcttcaggagataaggatgagtagaagataagagcgaccttcttgcttctgctgtttgttctaatgccatattttggggtagcatgtccggaaccccatcacttatcatgctccaaattttcatagatgaggggtttcactgcctgaaaccagaccttaatccaccctctactgacctactaaattcctagtcccccttcctaaactcaagggtcgcttcccgtatagtttttgctgggcctctcttctccggccctactgaggctctcctcttcagtctttctcctccttccacagcatcccattcacagtttctacttgttggattcctaaacatctgtatatgtcttctacaaatcaatgggctcttgagttcagggagtatgttgtgtccagttctgtatcttcagcacttggcataatgcgtggctcataatgacattggctagatggccaatattttgatttataaattatgggtcacaggccagccaaacttgaatgtgatttattctgtgaaatcatctccaacccaaccatccctcctgtgtgtttccagacactctgaatgtatttggggttagttatgtacacatctgtcttccctgctaggctgtgagatccagaagggcagggagcacgtatcacacaagctggtacccccacctctaagcactgtgcctggcttacaccacctgctcaatcagtattttctcagtgttgacaaaaatgactacatgaaggatggctttctttaatctcatgttcattccacgttgctacagtggggatacaaaaacgaataaaacacatttcttgctttgagaaggatacagtctaagaatattagaaaacatgaatacagcttttaagacagaacatcatgttgtgtctgcaatctctagcccctaatatgtactaaactttaaatattttgtgatataaagacaaaacaaaagtaatattttactaggacattatcctaatacataatttctcttgctctatgagtattttttttaagccacccagtaaatgtgtagcaacaaagaaccatttggaagttattccctgtcttgcagactgagtcagatcatggctaactgatggtcggtcctctctcatgtttcttgttttgttttgtgtttagggttatttctttttctttgcttttcaccattactatgaattttgaaattccttccattttgcaaaaaaaaaaaaaaaaaaaaagctttcctaattattgttcattataactgtaatcttttaaaaatgaaagagtccaaaattcatctaaatgtctgttaaaatgaacagaagttgacttaagatacagtgtagtttttagtctacatatttaattttcagtgtattcccagagaaatagcagtgttgattatctctctttcatgtcctaaaattaatagcagctcatactgaacccgtctaatggaaggataaagacttaccctccaggccagtaactacaaaatgactgttgcaggaagtaggaagaacatatgctggaaactggttctaaaatgagtaatcagtgatgtcattatagggaaaagagtgcagcgttaatgacagaaaccgggcatatcatctgtgacaagagcatcacaatatagcaaagcgattactacagagttctaatcaaataaaatatcacaagataattaaactttccatgttcagaatgaaacttcagttaatacaacacctacatcctctggagtggtattcaaaaatagttcaattttaaaggaaaaactctcattctccaaaatttcaaatataaatatcccttgcagaatgaacaggaagaaaagactaattaaaaaaaaaaagaatctccaatattctttggagataagtagacacacttataaagaatgcagggccaggaaaggtagctcatgcctgtaatcccagcactttgggaggcagaggcaggagaatctcttgaggccaggagtttgagactagcctgagcaacatggcaagatcccatctctacaaaaaaatttaaaaaattagccagcaatggtgatgcacacttgtagtcccagctactcaggaggcgggggcaggaggatcacctgagcccaggtgtttgaggctgcagtgtgccaagagccaaggtcgcaccactgcactccagcctaagcaacaaagagagtgctgtttctcaaacacagagtcacacacccttatgaaggtgtattcgtatatgacagaactaagaattctgaaaactactacttgctaccatatggcaaattaccaaggctccgaacatctgtcatgtatttcaaaaatgattcactaaatattaatcccattacatgctaatgaaatatccctagttgccaagtaattttcaaaaatgcaccaactaattaaagaccaaatcacatatttgactaaaggacacgtttcatttaactcttagctggacactttcattgaactctggattgcccagtaaccaaatgtaagatgacattgtgtatggtgaccaggccgaactcagctgatgtcctaaccaaggacaccaaacaaacatgcccctgctctccgggactaatttcacatctgcactgaaaaacacaatgaagggcgtagccatgattaacttcaggccaatcaaatggctcccaaaagaggccaattttaaatctatggatcacagaacttcttcataggaagtttctgtcaagggaaaacatactttgagttttttgattttactttgatttccgtgaaacactctctataataccttatagagctaaagagaaaaattaagaggagataacagactgtcctttacaatgtactatcctcttttaccctgttctctcactgaaaattgaataacaattacaaagttcaaaatcacagatatctgacatttggaagtgccagaacacctttcaaaaaatgagctgaatatgttcaaagcaatccaaaattaaagagaacttcaaggtgcaagcaggtgataatctaaacggaagagccatctgatgcaacagcctacatcattctgcattggccctgcatggtggctcacgcctgtcatcccagcactttgggaggccgaggtgggcagatcatgaggccaagagatcgagaccatcctgaccaacaatggtgaaaccccatctctactaaaagtacaaaaattagctgggcatggtggtgggcacctgtagtcccagctactcgggcagctgaggcaggagaatagcttgaacccgggaggcagaggttgcagtgagccaagatcacgccactacaatctccagcctgggagacagagtgagactccatctcaaaacacacacacacacacacacacacacacacacacacacacacacacacaaatcattctgcactgactttcctaatggtggcagtccttgggttccatctttttatttttgtccctaataaaattgaagctattaaaattgtattacatgcttgtattgttttacataaggcagtatgctaagtccaaaatgcctaattaaaacattacaaagggatgcatactgtccatttttcttgtgttttttttcccctgagaaatgcacaattttacataggaaccgttaacgaaatggcaaccctagcacccaaagatgggactagtcctgcatctgctgccatcagcctttcttcctatcaacgcctcttacaagtcatgtctgtcatccttgtcactatatctatatctacgaatataccacattttctttattttaaaatctctccatttaagatcctttccacaaaagatgttgtcttcgtatttacctcactgccaatgcttaaaccatattttgtgtataacaaagtcaataagtgttgaattaatgatgaattatcctatcactattattgcaaaagcaactgttttaataagtgataaacactctctttaaaaagtacctttagcctgtgttctagtctcagtattgtcactaattggctgtggatttaaggcaagtcacttaacctctctagtttgtttcccagtctgtaaaatgtggagttggccaaagtgactatttaaaaagttccaaatgaatgaatgaatgaataaaaaaagaaagaaagaaagaaagaaaagttacttccagcaataaagactacagctgtacgagttttttttaaggttttatcaaccaaatcactaagtctttgaaggtaattaaattgcataaaatccaaagatgctgtccacaaagaaggcgaggtttgaatagagccaacttcctaacatgtacccatcacctattaggtgcaaaacactgagctagtcaatgtaagtgcaaaaaaatgcctaagactgtccctcagttttccaacctaatgagatagatgaatgagtaaaagagtgactacaataaaaggcagatgacataaggccggagagggacacaagcagcataatttaagacagaaaataaccaggtgtgatggcttcagctagaatatatcttggttgagaatgtatctgatgatcatacacagaggcctggacaggcctcaccccaggccacccatgacactgtaatagagtgatcttttctacttaaaacaaaatctgggcggatcatgaggtcaggagattgagaccacggtgaaaccccatctctactaaaaatacaaaaaaaaattagccgggcgtggtggcgggcgcctgtagtcccagctactgggaaggctgaggcaggagaatggtgtgaacccgagaggcggagcttgcagtgagccgagatcgcgccactgcactccagcctgggcgacagagcgagactccgtctcaaaaaaaaaaaaaaaaacacacacacacacacacatctggaatttcccttatggagttatgatgtctcaatgattacggaactttactacattggtaaagatgttgatggcagcatatttaacactgtgaatagtcttccttagtacttcatatattgaagttgaatctgcatcccatacccttcacaaacccctgcataatgaatactatttaagtcatcagaatataactttcatcatgttaattttatctgaagaatatgcactggctctttattgcctgttatgccacattcaaattcctcagacaaaatcccactgtacctatgtggtaaatggggtaaccatactatgtatgacaagtttctatgacaaagaaacttgagatttctagaaaccaggtctttcagatacctcttcactttgatatagataaactaaagaggaataaacaaataaaatttaaaatttttagctatttaatattttaaaagtaatctactgagtatagaacagtttttaaagttcagctgaggaccacgatttatgagctcgaaggaaagacatacttcgatggagtggtaacatataataaaagaccctttggtaaagctaagaggaataaaagaaagaatggcaatggcaaaaacaagagggatgtgatgacgatcagaagtggtgagagggatcctgaataacagacaaatatgggcaatatggctatgaaccttagataacgacagagaggaaaacagccaatcaagcaatcagtccatcaatgaaacatcaccaccaagaaaacataatttgtaattcgagtagtagtaaaaaggagtggcaactacctatccactgtatccattttatacacaacaaactttgaggaatctataagatgtattggaaggaagagactagagggttagaaaccatcggaacagcatttcagtatccccagaagctatcagccagccatctggaaagtgcttcaagcagaataattccagagcactaagaagcattacttacacacagcgcagtgccgtgccaagctaaatcatggagcaacacagcactgcagcttggacaggatccccatctgggcatgagcactgcaaaggagctttagatcagtggttctcactgggggtactagggaccattttcagtattttcaattgtcacaatggcatgtggtagactgtagccaggcctgctagacaggacagccttagataacaaataattacccagtatcctccaagtctttcagatgttccaccagacttgccggtaggtgagaaaatcctgttacttctttgaatatagagcctaactgtattttacttacagacacaagtgtttcttgcactgtttagtagtcactgaattatcaaggaatgcaacatccttaaatgtaaattgaagaggaattatactttgttttgtttgcaattgtaccaagagttgttcatcattgtgaaaaatcatgtcgacaattcatggcatttcaatcaccaacacaataaccaggcatcaatctacatacacagatgttacatttataggattctatgtatgtttatgtgtatacttatttactccttatttcaaagcttcaaatagaaagaaaagcttttgccaatactcagttgaatgttgttttactcctctttaatccaaatatattcattgcaagtaggtccaaacatctgatgacatcattttatctccaggaatagtcaacaagtaagcatttacataataaaatgcactgaaagctatctttctcttttctttatattaaaattgtaacactattttaatacttaaatttatgtgtagaggcagttatattattaatacatttcatttcagaaatgaaggggatattccaaaacacattacaaagatgcagcactgaatctaatagggttagtaaccactgctttggatgcacagagaaaccgtagagagcggattccaatgtatctacacaggaaggtaaagtgcaaaagtaccaaaaggtgatgctagctctgtaaaggaaaatatcatttgctcatgattagaagagagaaatacagattaatgccatatagaactctgaaagggcagcttttcctgttctttgaggatgcttggttattgtaagcggtcacaaggcaccagttcccatgccaacctgagtcaactgcagcaccaaaccatagactgcataaacacctcaatatttctcattcacagaaaaggtgagaacttttttgtcaataacttcaacaaagatgagcccaagtattttcagaaatactagcattttagtgtgatgatactgcattggaaagttggataaagtagacaaaagatagttgagaaatcctgtagaagaattctgtattttgttttagtattttgtttttaaggagctaatttctagtttgttttcttctatttctgttgtctgtaagcaaaaagaactaatttccttactggtctaatccctaaactcactgcagtggaaatgagtgaaatatgaaaaggaggctgggtgcggtgaatcacgcctgtaatctcagcactttgcggggctgaggcgggtggatcacctgaggtcaggagttcaagagcagcctagccaacataacgaaaccccatctctactaaaaatacaaaaattagccaggcatgatagcgcgtgcctgtaatcccagctactcaggaagctgaggcaggagaatcacttgaacctgggaggcggaggttgcagtgagccacgatcacgcccctgtgctctagcctgggagacagagcaagactctgtctcaaaaagaaaagaaaagaaaagaaaagaaaaatacgaaaaggagaggagattatatagctaaaatgagtgtaaacatagattataatttccagtattactattttaattattagtattaagtatgcatttattattatcatcaacttttacaaaatgcagtaagggtagaaatgtaggcgtaaagcaaagccctgtttggtagaacaaaatcctacttggtagtaacaataacaatcaaatacctccaagtcactgttgaaatgttgtcttctccacgaggcctaatgtgactttctatgtaaaactgcaagttgccccaattcctgcactcctcctccccatctctattacgatgttcagttttatttcatagctcttaccagtttctagcatacaaagtaatttgctcatttattatggttatagttgcctcctacctctagaatatatttctatgaggggaggaactgttcactatacagtccagcatgctgaaaagtgtctggaacagggtaagttaaccagtatgtatttgtggaaagaatgaacaatagcacataccatttactgagtgctttctatgggccaggcacattgataagtgctttacatagaaatcttatttaatttttattataaaagcctgcaaggtaaatattatgaatcctcagttcatagatgaacaaactgggatttagagagagtacaacagctgttctacatggtacagccagtgagcagtggggctggccctcaagcccaggcagtctgacttcaaagttccatactcgccacaacagaaactcagtagagctcagatactctttttctccctttagggggtgaaaggagtatctggattagtcagctccattgtgcgtgtgtgtgtgttgtgtgcttttttggttttgttttgttttgctttgagatggggtctcactctgttgcccaggctggagtgcagtggtgcgatcacagctcactgcagcctcaactttccccagctcaggtgatcctcccacctcagcctcccaagtagctggaactacaagcacacaccaccacaccctgctaatttttttgtatttttcggggttttgccatgttactcaagctagtctcgaactccagggctccagcgatctgcgcacctcggcctccaaacgtgctaggattacaggtgtgtggccctccccactgttgatcccattcttgttcattgcgatccttcaaaaaatatgcaagatggaagacaaggtgcaggcaggggacagatggggaatctttgtgtcttcaaaatctctcaattttgctatgaaactaaaactgctctaaaaaaaattaagcctttaaaaataatgtcttaatgcacttgtatttctgaatagttcaattttggggtcatgaaagctttaataggtaattgttgacttaacacctttacaacaatgaaagatttacacctaaacattacatgaggtaaaaggaaatttattcatcaaatacagtaaaaaaaaaaaaagtagaaattaagaatagagtaaagcatggttgacctcagcttttttgtgagagtttctattttctcatttggtgaaactatctttgagggactgacctttcgacattcagcgccatttcctttgactcctggcatcttctgctgcatgttcactattcaaagtagcccaaagggaaccaagacagtccacagctattgttttgccatttaatcaaacctgaataaagagcttgtacacataaggaaagtaaaaactcactagaggttacatgaaagaggctgccatggagaggactcgtctgttcacgtaacatgaataatttccccatcgagttgagaaagttctgaacacatttctttctctttttttttaaagactgaaaaatggatataagcccatagcacttgttagctagtcaagcaaagagtgtactcactaaatttgtgcatagaaacaatcatgatcccacagcaaaaaatacttccttaccatgcccttcatagcaggcattttgaaaactgaaaattctgccaagtcaaatatataactgtagctatgtctacttctgtttaaaggcagagagaagaggaaactaacaatactaattccataatttcagaatgagttgcaagtacaatattggaaagaatatcctcagaaaacaggttccccagaggcaggtgaccacagcaagtcatcaggagaaaaacttatatgttcaatttttctatcatcatagaattcatcccatcataaatggagggaactcttcaccttgagaggctacaatttaggatgaaagttttaacgtttaatatgtagacaaaattatcactaagatcatttagggttgtccaacttttcatgaagttcccaggcctccatattttcagtgttataaacacttgagctcccatttataagccctgaatccattttatgtctcccaaaaaccaaaatatttaaattaaaatacaggtagctcagattgactgtctctcacaggaagaccatttatgctaaaacatgctgattcttatagagtgactacccttttaaaattaaaaactgcatcagtgaaagaaaattacaacctatatttatcattcaaaaagaagctagaaaccttaagtaaaaacagggcatttttgttttcaaaaatccaatttttattctcgttatataacaaagaattttaatgtctccctaatcacaaaaagaaaatgctgtttggattaaaagcagtagttacatgccactcattgcactccagacagttctgacctttttgtaagagaccaattttgtatttcctttctcctgcctgaactattgcactggcttgagagttgggctccttccttccagtcttgactctctaatctatatttcatgccatgaacaagaattatcgttctaaatcgtcataatcatttcattctcctacttggaaactttaaacagctctttacttaatagagaataacgtccaaacttcatactagagcactgaagcaaccccacaatcaaacctcgtcttaacactcctagtcctgtacactacacacactctatgctccaaggactagaagcagataaagtcctttccatgggctcaggaaccttccttgtgtggcttcctcattccctccacttggctgctgctgaaatttaaaatcagcacatgttctacttttcccatgaagacatttccagttctcacagtcataattacttatgtcttcctttgcattcccaacacacatacattttatcttatcatgattagtattatagggggttgcctccattgccctatttccctctattgtgtgagatcaaaggtcttgtcgtgtttaattccagattattataacaaaacactgtgtacatggtggtggctcaggaaatgtttgctaaatgaaagaatgaatgaatcatgtaaacatccaatcagtcaatcagtaagaaggaataagggtgaaatgttgagtcaaagacaggactttgagtgcctgcactttcacttagaagaaccttaggttcttattcataaggctgaccatgcctgctctaccatgataataacaaggaaagaatatacatttccgttacttcatagtcaacccaaaatgatctgagatgtattatacattcccaacactgtgcggggcacattgagagacagaacataaatttcggctataactcttactgattgtcttttgtctattgaaatattcccctcctgactacacaaattgtttctttaaaaaggtgagtttgaaccacaattttatgatttatgcaatgataaagtctgacataaatttccggagaagtctagaactggttattaaacaatgatgaacacatatgaagacaatgaccaattaaagacagaacattttcattaaaatactttatatgaaactaaatattttcccttttttatatggttataaggctgaaggtcagaaaaagactataatgtttaaatgagaaattcttgatgtccttctgagcacaatgaagaagcacaggggaatgatatcagttatgtttgcaacacacccaaacagtatagactgaaaaatgaatgttgaaattcaatttttagcactatctctaatgggctgttattaagtcctggaattgggacaattctactaaacatgcccatcggcgacttggctgagatcataaaaggcatgcttaccaaatttagagatgacaaaaaattgggagaagtagtgtatatattaaatttatatatttaaaaaagctttacaagaaactcatcagattggaagacgggcctaaacaaacaagattacattcatccagattaaattccaggttctgaatttatgtttttaaaaaattaattgggttatgaaaaaaacaatccatgtacatggattagaaaactatatggtcaaataatctttaacaagagtgctaagaccattcaatggaggaaaggacagtctttttgacaaatgctcttgttaaaactgtttatctacatgcaaaagaatgaagttggatgcttacgttacaccatatacaaaaattaaagcacctaaacaaaagacctaaaactataaaactctcaggagaaacataaaggaagtcttcatggcattggcttgagcaatgattactcaggtatgatacaaaacacaggcaacaaaagtaaaagtagaaaaagtgggctacatcaaaattaaaactgctatgtatcaaagaacacaatcaacattgtgaaaaagcaatccatagaatgggagaaaatacttgcaaatcatttatctggtcagggtataatatccagaatatatggataactccaaaactcaacaacaaaaaaggaaaaacccaatttttaaaatggggaaaggactcaaacagatatttctccaaagaagaattacaaattgccaacaatcacatgaaatgatgttcaccatcattagtcattagggaaatgcatattgaagccataatgaggttgccacttcacattcactaggatggctactatcaaataaacagaaaagaagaaatggcggcaaggatgcagagaaactgaaacccttgggtactgctggtggaaatatgaaaggtgctataataaaaactacaaaaaacagtatggcatttcttaaaaaaacataaaaataattaccatattatccagcaatcccatttatgggtatgcatccaaaagaactgaatagtatctagtatagtatctagaatatataaagaactctcaaaactcaagtttgaacaactgaacatttgattgaataactttcccaaagcttgtcatttaaatgaacccacggcatgactgagggaaaagcagaacatcataagattccactcccaggctcgtgaagttactgaaaacatctattggtccaattcccaccaagttgggaaaggatgagaatgtttcccataacaaatctccacactttactcaatgaaaaacctgaaaaagtaaataaataaatacttctaaagacctgagtgttgttaaacttattatctaatgatagtatctcattgttccttcagtttttaatatagttttccttagttaagaatgtacaggaaaagaagggccaaaggggcctgttgcactgcttacctcaccagcaactatcttcttgatatatgtcatcacgattggctgatactaacggaagcaggggtgtggctttattaaagtgcatcaggagaaacatcttcttaaggaaatgccagcttttatattattttataagaagaaggagaaagagggagaacacatgtgcaagcgagctgaatgcacacacgctcaatgaactcaactactgtcaaaaaaaagcttgaaaacatttcactattttataatagccacagctgagccagcaaatgacactgttgtagctactatttatataattaaaattataccctaacatttcattttagaactccatattaaaccacttccatctttaagctaaaagcacttcaaaagaaatgtattcttgttatggtcaactaattaaaagtgcattgtatctggaccagaagaacctatttccatgcacaggctaaagacagcccggggaaatgactagtgaaccttcagataagatgacattttaattttcctttatatatcacatcgcctacacctagcttcataagcatgtcagctcactttgtcacctgctgtattacattaagaaaatgtttttattttcccaccttttcttctagaagtggcctatgactgacatttcaggaggaatagccttacttggaaatattctcttttataaatagtactcccaaagtctattccaacctaagctccacttcaacataatttaaaatgcagctttctatataaggcattttatatatgtttattaaatgccttataataaacacttatgtattcaattcagctagatcatgtatatgattcataagtaatctagataatttataaattttatacactaaatttaaattatatacccatgattttcatcacataaattaacacatactatttatatgcccctagcagaatatgcttcagaatccatgaatccattgaaataatatgcaaattttatatctgtacatacatgtgcttagctttccacagtttctcaaaagaatctgtgaatcaaaagaagttaagaaccactagtctattcccaaatgtccatcatattatttaaatataagcagcatctctgaacaggagacataagaccctctgacttttagagggttaaataaccatgcagctttccatttgcatctacacctatatgcaactgaaattgattgaccacattttcttcccccccctgccgcttttaatgactcatttttaatttccacttcaatgctaaataatatctatttttaaagtgtgcttgtttgcatatcacaccaaactaaaattacatccccaagaaaatgttcccagtcaagctaaaaaaaaaaaaaaaacttagcatatatgctgaagaggctgctgtttggtaccttggttagtgctgaagtaggcaggaagagctggaaatgcaaaacagcttctctgacttagaattacatcaatattacagttcaggaaaatcacattatttaaaactataacatgctcataaaaattcaaaaactggctctttttctgttacaatatgctgaagagctacagtgattcagtcatctacctgaaagcttttgtttcaaatcctttctaataggtctcactactcctctgtgaatggtttagagtaggacctttggtcccattcatccttctatgtggagcatcagacacagtacctgcgaacacaaagcaattcaaaaagttttttattaattaatattgtatgacctaattaaatcctaaaatttaagcttctggaagctatcccagtgtgcacagcttaagtatgttctaaaatgacagaggggcaaaagtaagccatcttagggacatgcgtcaaattattccaaacaactatcacttccagtaacattcctgagtcatctcaagataagtccatgctggcaaatatagaagtcattaggcaaagaacataaatttgcttaagatgcagaggcaaaagtgatcccaatatcaatcaccttaaagcttcataattaaaatgagtctggcaattgtctcagacacacacacacacacatacgtgtatgtatacaatgtatacatattatatatgcataatgtatacatattatatatgaacagagtagaaatatacagctaaaattgttttaatatacaaaccaaaatgacattttaaataaaagagaagcatatgacatcatccaagtagaaggaactgctaagagtcatctagttcaaactctaatctggtccattacctttcaagcattcaagtaagttttctgtcctgttttttaaaggcctctaggattgtataatgtatatcaagtgtaaggctttccaaaatcatcctttattcacttatgcaaaataagaaagaaaacaatgtgagaaaagatgaatattctcaaatctggcagtgcctgctgataacttctcactgttagatcagagagttattggtactgtttgtcattcatgtcctgaaatcttcaagtacaccaggaactgcacatgttcccaaaccaccatttcaaattagcaccaacagattggagttaatggcacatataacacattctgcagaatttaaagctttcaggccagctctaataggtagctgtgccttgatttgtggttattatcctacaataacataaaaattagctatccaggtaaagagtggctctccattttttagttggctacccacccccaattccaaaagcataggtccatcatgttcagattttaaagttgaaagaaaggtagacaccttagacacctcatggaggagcccggagacagttgtgaataatgctgccccatctgagatagaaccttcttttgttatgtactgggcacttaaagaaaaaaagtacaactctgtaatggcaaaagaaaggtgcaaaaaaatgcaggatagaagcagggccttgagaatatatctgggagttggaggaagaaggtgggaaaaaggctgagacaatgtacagcatgggctctgcagactgggcagggagaacataacaaccagtaggcaagataaggaatacagttaaatgaatcaatgagtgagtaaatgaatgaatgaaccaacataggaaccaatgaacatacaaataaaatgaatgaataagtgaatgagtgggcatataaatgaatgaagttgctgaatggtaggctggaactaagatgcagacagtcctaaatgtcatgtaatgagtctgaattcatccaaaaaagcagaatgagaaagacatttcttagacttctgcagagcacagtctgcccaactgtatgcacagacctaactaaaagcaatgagagttcacggaaagtttttaactctattaaatcagtcactgtggaagatcattcagggaacagtaggcagaggataagaaacagaagtcttacaacaggtccaaggactacgagctaagcaattgggttgttgtttttctgatcatgcatatactagaattttggatttgggtttttttaattgttatataagtcacgtgctgtaatattcatgcttctaaagtatacaattcagttgtttctcatatatttgcaaaactgtacactcatcaccactatgtaattccagaatatttcatcactccataaggaaactctggacctattagtggttactcgccatttctcctcacctgagtccatgggattcacatgttttaatcttaatattaatttctcctttatgtatctccccaaagtgcatacaaggacaatataagggtatctgcacaaagcagactctcagtaaaagatacatgattatctgccaaagaaatattgtcagaatgcaggaagtatcaagacaattttctttgctacccacctgatgcgacatttttactctcacacggtgagtagcaattttcaaggttcattaagttttttaaagtatcacttggtttcccaattgcaaaagtttaagttgtttttctccccactggataccataacaacctaaatatagtggccagatcaaaagacggtaaaagtagatggtgcacaactaataacccaattcagcaaccacagccttagatcatgatcgatttttccctccaccctacagagtgaaacaagttctgagaacgcacaggtgtttctctgcaagtccctgggcggaagtagcgggttataggataagccgatttctttttccattttaaagtcatctaagaaggtatttccattacattttgtatataattctactactgagttttggaatggctctttggtatttgggagcacacatttaaaaaaaaaggaaatctccaaattcctctcagagattattaccctgaattttagaacaaatttcatttaggctttgtatgtcatcccccattacacacacaaacacataattttttttcttatttctgttaaaaatgtaaaatacctttaatgataaaaagatattccttaagataattaaatccagctgaataaaaatatagtatgtatgtcttactcattttcctcattctgtgcatagggccaagggactaaatttacacatagcaccgaggctgtgcacagtcctcctctgtcccatcctcactccgccccgagtgctgcactgtgagaacaagacaccctcttcgtatatattcgctcactacttatgaaagatatttgcattaaaacagttgttttcataatactaagcttctaggatttaaaacaaaataaagcccgaactgaaaacaaaaaacaaaaaacctgactgcattttggtcagttcatctcttcctataaactattttaaaaatttatttatttatttattttttttctgagacggagtctcgctctgtcgcccaggctggagtgcagtggcgcgatctcagctcactgcaagctccgcctcccaggttcacaccattctcctgcctcagcctcccgagtagctgggactgcaggctcccgccaccacgcccggctaattttttgtatttttagtagagacggggtttcaccgtgttagccaggatggtctcgatctcctgacctcgtgatccgcccgcctcggcctcccaaagtgctgggattacaggcatgagtcaccgcgcccagccaaaaatttatttttaaaaaaagtttaaatactttgcacagtacctaaatttctttgtaccgctctctataaacaaatcatgtggaaaatattttctaaatgctcaggtctgtcaagtttgctagacataatctaatcccttttgtatcttctctcagtaactcaagactttgtaaagctgcaggacagttaagacaacagggacccaggggacagagccttcacaatcagtcacagcagccaccaaacccctggcctgagctatacagaggaaggggtttttatcttcttccttcacaatgcctgaatactctcaaggaatcctccataaataattcattagcagcaaaaagaatacagtctaatcaataaggagtaatggcgaaactcacagcaggttcaggggactgattgagtgttacattaatgtctgattaagcttcctgggaaattttaattgttcatagaccaaagacctaaaattaaccttttaaccttctgttataaagggtctttctcaatggaccaaaaaatgtttataaaatatatctaatgaaaatgggaggctaacatgagtatttcaatacatagattttctcaagaccacacagaaaaacagaacttggttgacttcattctacctaaaacattcctaatccaatcatattgtctaatatttaatgattattttccagtgggtgttataagagctttataacacactttcatttctcaactatcaattccctattttccaggaaaggaatttagcaaactctgcactctttttctctttttctagtaattccctttgtcaattcacagcaaaacaaactgcatgccataagcattcaagaagctgagtttgaaacacatttctttaacaaaaatgaaaaattctgattttatagttacacatgtagaattttaaattaaaaattgttgatatgtgctaatattacacagaaaatccaagatggttaacaatggtgggttatagaaggccttaatgacaggctatttctccaattttgttttgttcaagctaatgttaaaagaattgaatatttcatcacactctgagaagacagcaaagaatcctgctggaaaggaaagagcagctgatctaagcttttaaatatgccatggatagtccgcacaaagatatgaatcacctgtgtttcactctacaatgacacagctctccctttcattaagatatgaatcacccatatttcactctgcaatgacacagttctccctttcatcaagatattcttttcatcatgtattggttgatcgaagacaaaacataagaatggacaaatcattctttagttacataagaatattatctaaaccaagatctctttcaaaaggatcatgaagaatgcacatatatacaaatgagaagacttgccagtaatggtcaatgaggtacaagtgccaggtttctgctgaaatgcttggtaaaacaggtaaaaggatgatgggttctggggatcaggacctttcgcttcaaattccagctccaccgctttggatgtgcattattttggcccagacacttttctctaagcctatttcctcctctggaaaattattagtggtattcatcttgtacacgtattctttgggactaagaaaaaatgaaagacttacactttctagcaacaatataaggtcaacaaatgttagctttagtattagtactagcaccagtagtattagtaccgctagcagttactgcagctgtgcaacagagaacggaagtgtccaccatcttcattgaaggaactgctccgtggtggattattttcctattaaagtttatactttaaagcatcaaacctttttatcccgcccatttggaaggaaatgctatttatttatttattattttttagagataggggtctcaatctgtcacccaggctggggtacagtggcacaatcacagcttactgcagcctcaaactcttgtgttaaagtgatcctcctgcctcagcctcccaagtagtagggactataagcacatgccatcatgccccgttagagatggagtctcactatgttgcccaggctgctcttgaactcctggccttaagccatcctcccctctccgcctcctgagttgctgggatcacagaactgagccaccaagcccagctggaaggaaatgcgtttcaaatgcacatcacggtcactggcttagcagagtggagtctatcttccttggcaattcaggaccatctttaggatcaatacttactatcttatataacttatgacagtagaggtattgtcaggggctacccaagtgggcaggcttcattcaggtgacctatccgttcaactgctatgtttttcttgaagctggtgactctgtcaggaaaactcagaacaattctcagaaaggttcataggacactaaatgtcttagggtcacatggagctaatacataagggagcagtcacttgaacccaaaagtatctggcttggaaatcaactctctctaacaacccatactgaactcagctgtcactgtatacacacaacagaactggaaactctgcaaaagatctagcaggatttgaattccacacgatatgagcaaatgttgaacagggcgacaggatacagctaccaaaaagcctaatggtaaaacaaagacaaacaattatttctcaaattttatcatttgtacggatattcaaaggaattttaatgtcttaagcacaccttgacagatggtgcattcctatgattacttactttcattttactgtcctcaattctctccttcacagttatggtagccaacaaaagcaacagcagcataatgtctattaaacatgtacagtgtgctagaaactgtggtaagtcctttacagaaccacagcccccctgaatgtactcaaaattctgcagtaaatgactaacatgccaacgtaaacacatttaaaaaaaatcttcatttaaatttattaaacagtccagaattcataaagcaatgtaaaaacattcaagattccatttagtaaacacatctcctggaatacagcactagttgctgtttaaaccctggtgattgagttctatgttcagtggaagcagagtcgagctggaagcaatgaaagacttattttgaaacaaagttaagtttcctataaagaagtcaaattatgtttgggttcattctctttttcaaagttttcctcttccttactctcacatttaagaaattacctttaagcaaaaagaacttgctcagaagatagcagtcactaagaatcaggcatcaccggccttgaacctcagtataccacattcttttttctttctttagcaccagaaggatacctctcttctcgattcagtagtcccccttacccttaggggatacatttcaagaccctcagtgggtgcctgaaaccacagatagtactgtaccctctatactctatgctttttcttatacatacatacctatgataaagcttaatttataaattaggcacagagattaacaaaaataattactaataaaacaattataataatatactattcacagtctcatggatagattctttcttcctgtagatcttagcaacctcagcgtattttttttttctttccttattaagtcgggaactttcaccttttcactgaaggaagcactttacagcttctttttggcatatccaaattgacagcgctagtcttgcactttgggagcattattaagtcaaataagggttacttgaacacaagcactgtgagactgcaatactccatctgataactgagggtgactgctaggtgactaatgggtaggtcgtgtatacgcatggatacgcttgatgaaagaatgattcatgtcccgggggatacgggattccatcatgcttctcagaacagtgcacgactgtaaacctatgaactgtttatttctggaattttccatgtaatatttttagactgtagttgaccaaaggtaactaaaagcacagaaaatgaaacctcagataaggggggcactgctgtactttcagtagagagttctcgtaagtatattgctcttttctggacacctacaaacacaaattggccagaacatcatgaagcatgtttagtgtgaagacaagtaagaagggcttggtgatcttagttccaacctttggcagcttcttcatggagataaacacgagggtagaaagttctgtgcaagtctggctgtgcaaccagcctctcttaattgtgtaagacccacatggaatggtaagaaataattgccaccacaatggacaacaaaatctcactaatgtgaattaacaggcaaaaaagctaacctggattacattatcttttttaatggaaatacagttgtatatttaatacacacacacacacacacacacacacacacacacacacaaacatgcatcctccaattagactaacagtgtagagggtcttgggacctgcttaaaggatagggactcttagtgaatcatgcattactgcaagaaatacgtcttcccaaaggcttcaaaacaggtgcctttctttgtaagtttaaacagtgtccttgcagtcttgggtatacaataggattctaagtcagttctctccataacacattttgaaagaaaaaaagtcaaagcaggacaggcatggtgctcacacctgtaatcccagcactgtgggaggccaaggcaggtggatagcttgttcaagaccaaccggggcaatgtggcaaaatcccatctccactaaaaatacaaaaaatcagccggctatagaggcatgtggctacggtcccagctacttgggaggctgaggtgggaggatcacttgagcccacgaggtcaaggctgcagtgatccatgattgtgtcactgcatttcagcctgggcaacagagcgagaccctatctcaaatcaatcaatcaatcaatcaaagcagcactatatgaatcatcataaatgtcaaattagtaaggtctaaattctagattctgcttattcatgctttgggatcccagcctctatgcttctggatcctcccatctgttaggtcaacaccatttacctatatgtctagaagaatgctccactacatcacctcacagaagggcacaggatcaagatattgaacatttgatttaatgcagaaaaagtaactttcccaaagccttgtgctttccagccaggcactcgtttcctcacacaacagcagcatggctaaccaacagcttccagaagtacctgtaaagattgataactttagctggaggaaaagctggagattttcttctccattccctgactgtacttataagctacttactgcagcccggcaaggctctcctcacctggacggacagcctccctgtcgagctgacaagagctgacggatacacccgccagaggactactaaagatcgggatgctgctaccgccatgtccctggcactcttcagggcaagcctgggtaccaatgtcttctcttactcatggcaaacactgacgtggaaccagcctaaaaattctaacacagccccttctcaattaaatttattgaatgtgtttttggtattcgaagctcatttttatgtttgcaataatgtcagtacaactgatccattattattaaactacagtttttaataaaactccatttcaccataacatctaaaatactgcagctgaacttgattaattataccctagaagaaagtaataacagatttccctatttcaaatacaaaatgggaagctcctgttttattcttctaattatatgagaatgggcaaagtaatataccctccctgtcaacaaatttcagaaacttgcttttatctttttatttttcctccagtcagagtccttgttaatgacaggagcatatcataatttaattagctgacaccaactggcaatctacccacttctttttaattggaatcatttcatagaactatccataaaggcccattttgcataactaataaccttcataaacaagacctttggaaaactgctgactttaatggaaagagataaaacacttggacacaggcaccatgttcccacttcacagaagactagggacacagaatttactctgcaatgtatataacagagctaattcaggaagcacgaatcgggtttcccggatctggatagcaaaaaacttccagaaagtcaacttccccaccgcctcacgaaagcatcctaatagttttgtatagtggaaagaacacaggcttgaaaatctgaatttgtctttcttctttctttagacaaggtctcactgtgttgctcaggctggagtacagtggctattcacacactcaatcatagtaaactatagccttgacctcctgggctcatgggatccttctgctttagcctcctgagttactgagactacacatgcctggctcagatgcaaattttaatctgagctacaatgtgaccttgatcaagttcagaaacttctctgagcttctggttcttatttgcaaaatgaaagcggtataacatctaactcaaaaggctgtcaggaatattagttataatgtatgtagtgtcagcagcgaatagctcaataaatagcttttattctcccaattattacatattaaatttgactaataatactgaattgttgggatcatattagataattttgtgcaagtgcttagacaattaaaaggcaatataggcatctgagcttcactggattaaagacaagttttaaagtgctgttcttacattttacttgttttgattattgattaactgctatatactcaccaaatgttgctgccttcaatgaacctgagatcttaagagcacaggcttggcaatcaggtgaccgagtgtgaactcagcccactttctagctgtgtaacattcagtaagtagcgtaagcctcttaaattgactttccgacctgagaaaagcagctaattaaaaaaacagcattcatctcacagacatcacgaaggttaaatgaaaccatccatgtagactgctaagcataatgcctggcacaaactaagtggtcaatatatgttagtagctattattgaattagtgacaatccaagatcgaatctgatacaaatgaggaagtgagacttagaaaggtcaaagagtcttaccgatattaaggagtagaggaaggaattttattccaggtctgtctgacttcaaaactcatattcaaccctaatgcttttaaagcactcttaaagcaggctcagtcattattttctaatatacagttattgagtattcacaggctgatcgaagtgccaattgttgaggatataatcgcaagaaggtagagggtatccctgccctcagggagcttacctatctgggagaaatagataaagggcaagacaagaaagcatgccatgttctccgataaggaaaatacaccagcctaaaggtgcaccatgcaggaagaacagggaagtgaataaacatgaactttttagaagaatccaggtactaaaacagcttatgaccttttcttaaaactaaaatttctagggatttccagcaacccaggacatttgtatatcaaagaatcaaactacagaactgtaaatggaccaaaaagaagaaaatgcttatggcctgacctcagtagaacacgtacctgcacatgtgagttaacgacaagggtttgggaaagagacctctgtccaaacaaacctccttctccgccaagtgccaacacccatccttccttcagcagttaaagaggagacagtaaacacaattggctttctcagaatggagggtatgcagacccggtgcagggtaaggcataaaagactaacagaagaccgtcctgggggtgagttttgaggaagacagaataaactagaagtgaagcggagtgtggagaaccagtctgggaagcagagactagaaaggaggcaaactgcccaggaatctaataatggggcctacacacccatgctagccagagccacatactccaattcacctagaattggcacaacagcaccaattctgagaggaggaaggggaaggatggcagaagagaagaaagaaagcagcagctgaaaatttcaagaactctccaaactgttcctcccttggtgaaggttgatggtgtcgtccaatcactgcagcaaactgacacaggggcctgcagacggttgtgtgtggcttttggagttagagacaggccgttttcttgttaatcggcaggcaggcgtgacagtgttcggcagaggacaatctgttcgagaataattagattccccctcgcttcttgcgttggtggcggaagcacccggagtatttacaatacaccattttgcttccatccgagtccatatgttcgctggtcaggttaaaactgaggctgcatggcacatttttcactgtaaacaacgctgccccggcaaaccctaggggaagggaggcgatcttgccctcttaatttcccagtccaaggaaaggctcgccttcaggaacggcagcagcttcgatatttattgctggagaaaggccacacctccggggagtcatgtcaggagccataggtccagccaggggagcagccctcatttgatgtgagacaaagaagctagaaaacagcccccatgaagagtatgcctttataacatgttgaaagtcacgtgaatcaggacgtgctcggtggttgtaattccatctattgatggcagctgctgctgcaacagggaggccggctagggctgcacactccatggaggcggtgggagcctcacccattctgggttggggcaggggctccgtgggtgccactgcagccacccaaatcgtggctgcagaccaggcttcctgctctatggagcaggcaggcgccccgccttcctgggtggggctacagctgcccaaactgatgctggagatcggagcttccctgtgctcttggtgggggccgggagcagacaggatctgccctccagggtagagctgcagcctccctgctgcggctgcagacctgggcttcgcgctcaatcgagcaggcaggagccagggacaagagggagccccacctttactgagttggtggagcgtgaactccgcaggtgcagacctggcatctctgcagcctgcaccctggagggcccgggaagacccgccccccacttcatccctgcaggctcgggggtgtctgctcccgcttcccagcccctctcctctccagatgcctgctctgatctccgaccggggttggggccgagcccggggcagcaggaggcagagagattcctgggtggaaggcggcagtccccgtaaggcccctccttcagaccagggagggcctgaaggctgggggccaggatgccagtccgggaccggagtggggacttgtggtgcctcgtctgggtgcacatggaggaccatgggccaatcggcaggaacttcctcccctctgaggtccataaaagcctcaggctcagccagagcagggcacgtggagacaatgggcgaaccagctacagagaggagctgccctctgctgagagcttcagagacctgcagagatgtctgaacggcctgcttgtgaagaggagccaccatctccagggcctcctctctgctgagagctcaacactccactagatgacctgcctacagagaggaactacccacagtgggcttcctctgagctgttctgacactcaataaagctcctcttcatcttcttcaccttccacttctctgagtacctcattcttcctggacacaggacaaaaacgggcaaaggtgccaccagccacagaggtttccggccagaaaagcgacaccccgaagatcacataacactatgatttggaggcaaagaatggaggaaaatggagggaggaagaaaagatggagaaaaatctcttaggcatacatgcctgctgttcaacaaacactgtgctaggcaaggtatacaggccatctccaagaaaagatgactaagtgacttctggaacgaaaagcacaactgccatcctaaccccctccccaacattttccagggatcagccctttacttgttaataagcaagaagacaatgcatctgttgcaactgtgccatcagaggacaccagggcagagttactgcagcacttaattagcttagtgcacttgaaggctcagcctggagttctcaggtgagtggcaggaaaaccctacaactcagggtgggtcccaggacaaatgcagctgatgtcagaaaactatgtttggcaatgcagttagagacaaggagtagacgcctcatttgagaatcatttctcgaaagaaaattctagaaatgtgacagtagctggaggaggatgtggggtcagtagagatgaaaaatatgcaaggcctgatttttaaaatacctctttttgcatttcaattaaatgattaaaaattagcactaaaaagaaccatggagatctatatcaaaacccttcttttctctacgaagaaactgagatgcagaaatgttgagtgactgcttgtctgagacacctagctaatgaagagcagggctcgacttagaatttaggattcctgtccccatcactgggcctctactccatctaccacaatgccatgccatgtttctcactctgctgtgactgatcctcaattttagttttagttttgtctttattaatatgtttcaaaataccctaaagagaaaggtatcagattaactagcagaagtgataattttttttcctttcaaaaggaaaattttaactaccttcaccaacaaagggattaagtctgctctatgatggaactgcattaaaaataatgaggcagataaaaaaaagcttttattattttaatgaattcaaaagccggaagcattattgagatgagcagtgtgttactgccctaatccaatgttaccatgttttaaaaattattctgggtaggaacttttctgctacatcagacaaaaccccaaaatatgccaagtagacagaatattaaattaacatcaaatcctcatccctttcaaaatagagatcacgattctaaggagcatccttgaaagcaccacctataagacacaaaacttgctcatatgcaaagatcacccctctgtctacaatgtaacccaaagattcctctgtctgccatttaacccatgtcctaagaaatttatgattctacacattctttatctgaaacaaccattaacttctatatgtacaagcaagttaatttaatctctctgttcttttgcatccgcagctatagagaaagaaattctgtttttttaacttaccttacagggattgattctatagaagaaaacatcacagtaacatttggcataaacacaaatttgccactttaatgtgatactctcttaagtctcagaagaaaataacagaatcttctttcccaatttcaatgttcacagaaatgttactcaaagaaagtatactataaactataatattccattcttgtgtactatagactataatattccattctctttcaaaacagatcacatttcttggccattaagttgacaccattctgccacattcttgacacatcaagtttagaaattagtactcgggtaactgtgggaacaaaaatgactctggtaaagtgaagttaattacatttaacttattctgaagggttgtattttctaccacagctcacttatacagaccactcccattctgtaatcaggcctagtattacaaaggtatgctgaagcattttttacatctgttggttaaaatgacttattactatactgctaattctgtacatactgtactaatgtttctgtctgcataaagcacaagaatagcctatatggaaaaactgggacccaaaccaaggatttctcctctgcagctatggaggggatgaagcgagtctatttgtctaagaagggaaatgtctggcccagccgtggaagtccaggggttggggggacatggaaaaaggccacagggaaggagacaaaaccagaaaaccctgtccacattaccacagtgacatcccaatggcttactcacttcccctccagagccctgccaaagagccaagaagtcttaaacatcatgccccagcttaccatcctaaaagagatggaggaaggcttgttcagatggctggctccaggttgaaatgatactctagagaagttattactcataaaatattccttggctgggcgcagtggctcacgcctgtaatcccagcactttgggaggtcgaggcgggtggatcacgaggtcaggagttcaagaccagcctggccaagatggtgaaaccctgtctctactaaaaatccaaaaattagccaggcgcggtggcgggcacctgtaatcccagctactcagaaggctgagtcaggagaattgcttgaattcaggggacagaggttgcagtgagccaagaccgtgccactgcactccagcctgggtaacagagtaagactctgtctcaaaaaaaaaaaaaaaaattccttgaggggaaaaaatagccccacagccccctactttcaatatcattttgtccttctacaagcaggatagatggacttcctgttagataatgaatctaactccctttttttttgatatggtacaaaaagtatggggttcatggccaaggtgtttaaaatcctggctctgctacttagtgcaatgaaccaagtaactttaatttctttgaccttcagttttcccatctgtgaaatgaggataacaaacctatgttgaaagactactggaacaaagaaaaaataaaaaactctttgaaaaggacctagcctatagtgtcacattcagcatctactcaataaatatttgtcgatccttcctccacagtcctcactccaccagcagacagattcaaacatcacttgattagatgagcaaataattttctttaactacccaagtatctttaaggcccgtttcaaccccagaagtagattcaataccatacagaggtattttcagagcctagctgtgcattcccaaggattcaggcgtatgtaggcctgtctggcattctactaggcctgctttccagtgaccttcctgtggcaggagccgagatcttctggagaaagtaatgggaagaagcaaatgcttacagacttggtcaaaagaaaatggagaaatagaagaaggaaatttcaagtggacaactccaacccctgagtcagaggtcagcactgtgggatgtgggggccaaaacaacaataaatgaaaaactacttcactgagaacgctgtttctgggagctcaaggaggaactacttcctctggagtctgtgaaacaaaacaagctccctggaagtgaagggttcagcccagtggctgctggagcagaaaacaaacatgaaagtgcctgggtgacaaaataagagaggctcccggcaggcagcccacatccagaggagagaaaaggcagcctgggacacctggcgtctggagagcagggatgacgatgtagagaagtggagggaagagagtgtttgttaacacatcctggggacaagggtgtagtccacagatcagccacaaggacactcagaactgacttggaggagcttgtcattggctatgtgaagaccgagcatggaagtaccatgttgttgctattttcatcctgagcaattataagttggtaaagcaagagttatgtgccttgaaactaatgccacctcagtctagctgctcactcagagcaagtgcagaggaaggcaagggaaccaatattctccatacacttgctatgttttacgcactgagtgaagatttttctcatttaattgcatgtaatttcattctaaagagcagacaaacaatttcattcgattagatatacttcctcaataaaggcttttgaatgaaagcaaatttcattttgctgatcaggctacactacgtgagtgtgtccttatagaaataaattaacctggaattaacattacgtatttttgttgttgttttcaaagacagagtctcatcctgtcacccagatttaacctttctcagccacatctgcaaaatggggatggtaaaaataggtaatgataggagctatttcacactgttttgaggactgtgttactacacagtaaggtgcctggcacaaagtaagcactcaataaatgttagcaatttttatgttttataacactaggctgctaagctttgatggaggaaatcatgcaacaaattctggggagtgtttcctcaacatatctgatgtccaattttctcttgtagctgcatggggcccagaaccgtatcacatggtgcagaagttctctcaaatttccaactgtctactcaagcaccaagcctctgcgtgtgtgcgtctccctcagatgatcttgcttccaaattcacaaagaaaacagaagccacagccctgctaccaacttcctacccaacccccataaacagcattatccttctcctttaaactctccccacttttgagaggaacagtcctcctacacagaccatccattctcctgtgttccacatcctctctgtctcctacagtcataacctggacttccttatcttcagtctcatttacttcccactcatcacttcccctcagcctaaaaccctgctggagatagggaaggagggagggagggagggagagggggagggagggagggaaatatattttatttatattttgattggccgattgcttttcagggtttcactctgtcacccaggctggagtgcagtggtatgatcatagctcactacagccttgaactcctgggttcaacaaatcctcttgccttagcctccccagaagctgcgccaccatgcctggctaattacttttttgttttgttttgtttgttttttaatacagacagggtatcaatatgtttcccaagctggtctcaaactcctagcctcaagcaatcctcctgccttggcctcccaaagcctgggattacaagtgtgagccaccactcctggcctaagtcttctattttaaacaatcccacctttaacctcattcacctctagctacaacactttatttatcccttaatagccaggttgctagaaaaaaaaccctttatacttgctatcatctccatttccccaaatttccaacctctcataatatgtactgtgacatcattaggcactaaatctacccttgctttgggtgggttctaatgacctcttaaatgcaaagtgcagaagactttaatcctttctgcttactgccccatacatgagtcactccctcttctacattactgtggcctcattacactgcaagtttactaaaggcaatccatcaatcaatctggcatagctttggctatatccactcatgtggtattgcacgcagcctacattcactgaacgaatcaatggaaataataagggccttaaaggctccgatggcttcattgtgccatccgctctgcttctatcgctactaactatggaaaaagttaacatttctcttactaagtgaatgatacctttggcaaagtaagatataaaaggtgtaatgttctagctgatcctgctccatacagctccaggtaagtaatctgccccagtgagagatctgtttataccggcaaagtgcttcagggcttaagtcttcagaatttgacccccgctcacggcacagaaggatgcccaggacacactataaagctattagaaattgaaaccaatagccctcctagtttcttttaatagactttcagatgcagtgttttctgctttcctttaaaaacagtagaatagtaattaacatttagtaattttcaaagcagttgtgcaggaagatttcctgaactatgaaagcccacaaatttggcaacaagaagtatcacaacagagaaacagctcttggtttattgttcattgttccccacacttagttaatgtgttacaatgacaatgtatgaaatacatgaagttaccatcaaaacaaacaatgttttttttttgttttgttttttgttttttgttttttttttgagatggagtctcactctgtcgcccaggctggagtgcactggtgcaattttggctcactctaagctccgcctcccgggttcatgtgattctcctgcctcagcttcataagaagctgggactacaggcgcctaccaccacgcctggctaattttttgtatttttagtagagacagggtttcaccgtgttagccaggatggtctcgagctcctgaccttgtgatctgcccgcctcggcctcccaaagtgctgggattacaggcatgagccaccgtgcctggcccaaaacaaacagtatattaaacaagaaaaatgaatttatgaattagctttcttccctcccaaactcccttactctacacaagtcattcctgatggagagattgaaataaaatgagaaatttaataatgaataatagtaatactattactaataattccagcaattatactggtattactttaaaaagaaaaaaatattgcttaatctttagcttttgctccacagcaaattccaattctttcaggacacagccaagagaaagcagataatgttcgtcccttatttccatacgtttcttgtttcaaaatggcaacccaaaaggaatactccactgattgtttgtagatatgctgattaaagaaaaatataaaatttcaagcccatcaaccagtgctgctctataataatcaaaaactacctttacaataaaaggttatcaaaccaaacagtctgatcatcacataatttctcatgaaagctgaaaaggaaatacaatcattcacttattggttcatctttcaccaaacacttattgtactaaatgctggcaatacagaagtgaagatctgcttcatgccctaaagatgctcatagttagcaccaagaactacacatctcgccaggtacaggggctcgtgcctgtaatcccggcactttgggaggccgaggcaggtggatcacttgaggtcaggagttcgagaccagcctggccaatatgggaaaatcccatctctactaaaaataaaaaataaaaaaaaatagcctagtgtggtggcacgcacctgtagtcctggctactcagaggctgaggcaggagaatcgcttgaatctcagaggctgaggttgcaatgagccaagattgtgccactgtactccagcctgggtgacagagcgagactatgtcttcaaaaaaaaaaaaatatatcgacctctaagaatcacatttatcttgagctacagagttcgaaggacagaatttttttttttcaattaatgttaaggtctggaagtttgactttggctcttaacctttggctcacatacctaatttggttactatgtgtttactacatgcaaaaagacttccttgggcctatgaatcatttctagtaaatggagctaataataactttccatcagaaagctctttgtcccatttttgtatcagaaatgggcaagaaaaaagtgaaacaaaataaaacaacaacgtgaagatttttttaaatcctgcccctgggatgttgatgagggcagagacaagcaatttacctgcacacaaaattaagttttttaaataatttagattctaaagaaaggaacttttagaatgacatctgctaatactctaaagcttataactctgagttattgggaaggtaagaacatattttccccataaaaataagttctatatcatggttatgatccaaggtgaactcacagaaacctactttctttggttccttcaataaacattaaaagcctgttatttgtgaggcactatgccaaccattagggatataaaaccaaataggactcagtctctgcccacaggagcttaagagtctagtggaggaaactaaattaacatttgcaagaaatgctgtgtttcctaaaatatctacaaggtgttttggggagcaaagaaaacgggcaccttaatcagactacgaaagggagagtcacagaatgctttcccttaagaggtcatatttgagctgaatttgaaggctgatgaggaattacctacactaaaaaggaaatcacaggtaaaaaggtcgaacaaaccgtatttagtgatttgctgaatcatggaggtgggtgacacaaaggaccctagaatgactcaggtgtctggtttggataaacaatccaacgtaggcaccattcacaaagaaagggatgctaggaggtacgagggcaaagatgaaaaggtcatacgcagaccgcaaagcttaaaccttcgcctcacatctgtttggaacagcagtagctttttacttagcgcttacatcaccaaagccaatgagtagcgaagtctgggacgaggacaagagctgcccttggcatcactgcctgtcacctgtcccttcggggcgccccctgcctccactgcttggcctctgtttgtagcttgtgttttggccttgccagcaagtgtccttcagggaggtctggctactcacagtttatagatgagaacactgaggcagagcgataattaactcgacaagagaaaacaaccagcaaatggccctcttgtcccagagcccacgttcttcaccagaacactgcctagtttaagaaacagcagcaattctgtttcttataaactcatgagcttcccaaagacaggctctcatccggtcaggcatcatgggtggatcatcaagcaaacagatgccaacagacattccctcccaagttattccttttaatcctgtcctttgtcagatgcaaaaggcctaattcaatactggaattcctctatatccattatcaggtcacctggatagcctgtcctaaaagaatgaagtccctccttgccacaacaataagctttgtcttttttcccccccataggtcagcttccttcttttatattctgctacaatctgttgttgtggttaattacacaagagactagcatgggtgtgtcaatccctagtggaactgcgttgagaatctgcaaaccagaccatatattatggggcttccaaattttcaagtgccacagaatcgcaagcttctgatcactgcattaaggatctagacctgtggttcagatgagagatgagcttcataaagaagtatgttgccagtgagaccccactaggttgaagattgcaggaagctgagatgcttaaattattctaattaatgggcttattccccactggttatgcacagcagattgaatggacagttgcaggtgcaaactgagaggtaaacagacctttaaataagtaaagagccagggagcactagctggggaagcacaggtttcagaatgaattattaaagcctgcactgatccacagtcgagggtatgactgatttctaagtgaagacatcttatcctgaatgctgctactttaaggtaaaaatagactcattcttcccctgactctctttctccatcattggtgcaaaatgaaacagctccgttggtttgtaattgatgtatctgacactaaaatttcattctatgtacttccatcctctgaaatgcacagtaagggaagaagatcatcttgacaggtaaaatagtaggttttgacacaaagtcattgagatatatgtgatggagaattttctactgagacaaaatgcagttctatttgaaagtttactacacatttcaactttcactttgaagaaacactttcagataaataaataaatacgcaatgattaaaagaggaaattggctttgtttttttgagaactaccccgtagagtaaagcatacctttttatatttactcttttttataaaactattgattgaaaaatatgaaaaggtagaaggtgcttagaattcctagcacataatacgtgctcaatttattgatgtgaattatatttacacataaatatacagacaaaccagaatatataaatataaagggatataatcactccaacaccatgaattccaccttaattttcctctccttgacaaactactgattaaatgtaaaaagttgctctttaatctagataacacgttttgtatgcatttaagaaacatttactgagcacctgctttacatcagcatagttctcagtacagatagagcaatgaacaagatacaccaggtccttattccaatggagcttaattctacccagcgtgagatatgcagtaccgagaagtaaataaatgagaagatattttcagataatgttcatgatgtggcgacaataaaacagaatacaccacgagcgtgtggaagaagagctactttagagggaatgaccaaggaaggcatctttgaggcagtcacattcaatggagtcctgaagaatgagagcgccaaccattaaaaaaggtttttctaaagtgctggggggaaagcacgtgtaatagccggagttaaattcactgctttcaacagaataccaaataaaatgatttacccacagaaagggtcccttttctcactggattcccacaatgccattagggagccaagctccttatacctttttctttgcccctcctggtgtgtagctcaccgggggctgctctactactgagcagtaactcagccttccagtgatgaagaatggggaaggctgaagggcagggtgtgtctagccagcctagtcagtcccttcctatccgcaaatagtaccttccccagaagccctgcccataagtgttcacttacatctgctctaaactgtcccacagatacagtaaagctaaggaagtttcttgcttttaactggcatgaatgggccttttgtagccccgaaaaaaaaaaaaattgaaactctgttagcaggaagaaagcaagaatgggcactggcctgtgataagccatgtctgctgaagcatcctaggcagggccatggcaagtgcgaagtcccttgtgggataataggtccagcttgtaaaacagaagaccagggtgtaggagtgcagggaacacgacggaagcacagcccaggaagactgtgagtgaaatgggagccaccggtactgagggctcgccaggtcctggagtggggggagtacttttttttttctccacaccacctcccagatgtggtcttgctatgctgcccaggctggtcttcaactactaggcccaagagatcttcctgcctcagcctcctgaggagctgggattacaggagtgcaccactttacctggtgatattacctttattttacaaataatgaagtaaactcagtaggttaagttgactcagctaaattcacagattaggaatgagaggagacacaattataacccagcttgatctgactcctaaattcatgcctgtaacccctgtactctgctgctgtcttcatatccctgctttaacaatatgcctctgagtatgagctgacagaatccattcttccaaatccattccggttattacctactgtcctattcactcacatttataggaagtgtttatttgttctaatattttcatttatttcaaagttctagatagagagaactctatgtctttctttgcctacctaatatgcatagaagaaaaaaatattaaaactgaaaatgactatcttcatctgatgctgaggtttggggtgaaaattcatattagtgggaaagcagatctctatactgctccttctcactctgagatacctggggagggagaaaagacaacactgaaatgtcaaagctcctgccagttcctcggtgctgaaacattaatgagcttctgaatgtgcaaaggtgggcccagagccgaaggatgtttgagagttaaattgctctgcataatcaaggaaaggtaattgagtttcccgaggaatcagagaatcaagaggtctaggagaagtgagaaaggcagggagctatgaaggtggctgctgtctaaccccacatgacgtctctcatgatttccacattaccagcaacactgttcccaaattcctgacacagagctatagcaagctctcacatgggggacagcagtgagtgaggattctgtgggtgactcctgtgggtaagcattggggaaatactttcagatcacatccaggataaaccattattttcaaatctgggaagattaaatagagatggtgaatgtaaaagaacctgtgggacctggcagagcaactctgatattctccagagcagcagcagacagaagctggggctgtttgcttactcctctcgccctgaacattaccaacatgcaggctgggactgtgagacaacgccatcagacaagcgagacgatgccatcagacaagacaggtgttccagcgattgctctaggtaagcctcattctctttgttcactggcagcaccaccccgctccaccctgcgcctcatttgcagagtcctctacaaatgaacatgcagcctgcctggcacacctggcacagctcacctgcatgccgccaagcatgacagactgtctttgctgtggttgtaaaggcctattttcccaagaggcttcttctccggggccctacagctttcagcgtgcacttcaaactcactgaggactgagtgacttacagttttctctgtgtgctaagctgttagattgtttccatctttacacaggctgttccctccatttcaggcatcctctcttccaggctgaacccgttttcatcagattatcttttaccagttcttcagaaagcaattcaggcctcgtttctccaggaagccttctctggcctccacctttgatttcgatggtctccttcatgttccccagcccccgtctatgcctccaccttggtatatcatgctctattgtaattattaatttacttttctttctccgcgaatagatgtacccacagagcctagcagtaaacctgcaacaaagtggtggtttgatcattcttatcaaatgtatggcttaaaagtattgttcttctaaaatgtaaaaagagaatcaaatacaggtctggccaatgacagtatatttcaaatgacaggcaggaacatgtcttcccaagtcctgatttttctttgaatgcacagctctgacttatctggcctctctccagaccttcatatgactcttctctagttaagccaatagcaggcttcaagccaaaaactcctagaagtaggagtttgccaggcaatagtgcatgtgtgttggttgcaagagggtaaaaaaaatattacaaagataacagcctgggtgcaagcttggagagtttcaggaacagaagaggacagcgtggcagagctgtgggttcagtaagtgaggtcaaagcgtgtggacgtgtacctggccggctaagcaacagtagtttcttggtgaatctatcagagaaggactactatacaacataagtcggtgggagcaatgtatctaaagtgagaatgagtgaagtaatgctatcccgcaatgaccactaattgaaatgccaacaactccaagttggctaagtgaaaagagagtcttacctcaattaccctaaaagaacattctagaactaggttaagctaacaggaataagcatatgtggagggtgtttctgggaaaagaagtctgtcagaggcaggcagaagtatcaattggaatgtgtctcagagacaacctaagttgacaccatataaataaatatttctgaagattgcagccaactgatctgaactctactgccacgtaaggcatattaattatttttaaactaatagaattggtgtgcatgttcttgaatcatttaaaattcttatctcctcaagaatctggaatttttgtttgtgttacccctaaatccaaatttcacaatgctgaggagtccatggttttcaggcatcattacaaaataaccagcacttcctaacagctggtggcagcaaaaatctgaaacttatatttctcagttacaatgcctacttaagaatcacctcaaacctttaagtacaatacaatgtgagggttactcagaggtacagagactagtggtatggtcaggatttcaaccgtaccatataacctgcataatgaacaactcagacttacctcacttgttactaaatatttgctttatgtaagggaaaattatcttcagccaaaatggtagagcacaaccaacttaatatatatcctaagtggcttagaggctaagtacataatcccttcagcagtagcctcaactacatttctcttattgtagctagctcttgcacatttaaccaccttcatctgtattgttaacttgaaattttaaatgtgcatattcccagaacgcatcaactaatttttatcattctttcatttgaaaatatccttggaacattaatggttgaagagataaaggataccatgttcctaagagaatttattgtgactcttacactcagtgactggttgtaactgggaaactcaaaaccacaactatatatgactataaaatgacaatgaaaatagtttattctatacttgtaggctgtttgacattttccagcttgccttgattttataaaaagaaatgaccttgaaaataattaagcatatcaaagggtaaggctgtagctcactgaaacacagcaatatgttcacgtctttataacactgctaagcattcatgaaatagcaagagattgtattgctctttaaccaagttctactttaattttataggcttatacatattcactacgaggccattctaatcttcacctacctgcattcttctgaacttgcaaataaaggcaatcaggactctacctgctagacttggaacagatcagattttgcaagaggcatcagggtctggttgattctttttttttccagcctgtgtttaatgagagtgctctcaataaaaacacaaattcagattaggtttctgtactcaatgtttattaatttagatactctttaaaagagcatgtaagcatcttgagaaataaatttagctactgtcactttataaaaggaacaagtgcaattaaaaaagaaacaggaaatcggcaatgatatggaaggaaagtgcttctgagacctggatgctatcagccccactgcatacaactgagtgtgctccctgcagtgttgcaaagggctcagagaaatcacaactggccaaatgttagaaccttccgcagagaaataatgacagaggaaagtcagaatctccaagaatggaagacctaatgctcggagatctgcagacatcttaataaaaggaatattcaggagggaaggtgccattttgacttagttcaagttctctgctgggtttcctcctctacccccaccctagcaagagtcaactcagaccacaaaatttaaattaaaacacaaaatgtttagctggtttctcccaacttgaaaaggggttgacctgggatcccaggtgagagaaaacgagctatataaaaataaggcttcttgggaggccaaggcaggcagattgcctgaggtcaggagttccagaccagactggccaatatggtgaaaccctgtctctactaaaaatacaaaaaaattagctgggcgtggtggcgggtgcctgtcccagctactcaggaggctgaggcaggagaatcacttgaacccgggaggcggaggttgcagtgagctgcgatcatgccactgcactccagcctgggcgacagagcgagactccgtctcaagaaataaataaataaatagataaataaataaataaataagacttctctcatgaggtgatggaatgccttagagatctgctatttccaaaccaccaggaccagccccagtgagccaaatccttaatgcttacatctttcctcttcctacaacacatggacgggggcatgtgagtaaccaaggaagccaggcccaaagagaaacttcctggtgccaggatcattttgggtgagccacttgttttttgctcatactggatacgtgtgccacgtgccaggcacacagtcctgaacaagactgataacgtctctgctctcatggagtttatgttcttgtgatgggtgacaaatggtaataatgaaagattttgggaagagtatcaatcatggaaaacatctatttatcagtccgttcatttacttaacataggctactgttgtgcaacaggtcccatgttggctgctggaagtatacaaaggtaactaaaacacaagctaactttgggagtcagccacacagagacggtgaatgaagctacaggaatcagtaaggtaacccacagacagtgtgcagagaacaaacaaggtggcgaaagaaccccaccgactgggaagacagtagtgcaggaagaaaactaggagagtatggtgtcaccgaagcccagggaaaagcgttcccgaaagggagcggtccacaggacacatgaagttagagtatccggaggattgagcaacatggagattgctgctcatcgcaactacagcagtttcaattgagttaaggacctgaacgccagactacagcggaggtgacaagaagtaagaaagtgaagactaaaaatgtaaataatttcagttgtaattgtgaaaggagagatgattcaaagataagtagaggaagaggtggagcaaaggcattacttctttttttcccctccctcgctttcttccttcctaagaggaagacaggcacatttaaaggctaaaaaaggtgaaaataattgagactagataactagtagagtgaggtccatcaaataataaaagagtgagctctagaaaacaggaaaagacatccttgcctttggggatttcgggacagaaagagggaggtttgctgatgctttcaggggtgaggagaggtgaagggttaaaagtcgtcgaaacaatcttccaccttatagcctcaggccaggaaaactcccaggcaagattgtgtgcagctgaagaggccaccatgtaccagtcacaggtttttaaggtgagcttagatgcaaatggtaaaagtgaataaaggtcggggagtggagaaggtggcttgtctgattattaaagttacttacagatatatatatctgttatatagatatatgaaatttttacaatgagacaataaagtaatatttgggtaagaaaaattcacacatttttaagtaaaaatgtccacttcccactctacattagggtgagaggaggccctggcaatgcagacaatgctgaatcaataatttcagtaacctaagagggctgtctagaagtaaatggatctacatgtgcacatctgaatgggagagatcaggaatgtaggtcaacaagggtcatcctcggtgacccacacccccattacctacaccagacaaactgctttgctgcactgtggactaggttcccctcccttttttaaaaaaaaaagaagaagaaaagcactatctgttttcttgcaactcctcaaggatttagtgcagtgtatgtgtcatgcttctgggcaacttggaaaataacctgagaacatcaaaggtctatactgaacgtgaaaaaccctctgggcacaggctgcaccaggccacacactgccacgttcccttcacagtcctaaagaaaaaaaggtacatgtttgtatagggttctttcagattctctcaccggaatcatttgctccagcatgcatgactgaaacctaccctgattaggaggaggataagatcatgctgcctgagcacacatgtaagtctggtaacaccctactcactgtgtgaaaaagcattttagctgttggcgtcaccaaaatgtaagccctttatttgctgagtgtctgctaaatcaacatacagccttcatattttgtctgttcccctgttaattcttaaaggctgttggttcctggagtctcggctggagtctgggaaccacgtcagtcattgtgcttgtccacacatgtaaagtgctcaagataatgtttgcctatcacagtgtttgtttaacttgctattggcccaataacatgcaaatatgtgctccataaaagctgcaactgactgtaatacctgagagctaggggccgcgggataacttagtcattattgttttttcttgaggtgaaacataaaattaactattttaagaacaattcagtaacattgagtgcattcacaatgataaacgaccaccaacctatccagctccaaaacatttgtatcactacagaggaaaactcgatacccactgaaggcagctgctctcgggtgccccttcccacaagccctagcgaccatcaatctgcactccgtctctatggattcatctactttgaacatttcatacaaacggaatcacagagcatgtggcgtcttgtgtctggctcccttcattaagcataatgtattccgggttcacccgtgctggagcatgtatgggtacttcattcatttgatggctgaatgatactcgattgtatggatagatcacaattggtgtattcattcaactaacaacgagcattttggctgttgctaccttttcactattgtaaatactaatactatttataatatatgtatgtgaaattaagtatcagttttccattcttttgtgtgtgtatatggcagtggaattcctgggtcatacatcaactttttaaggaagtggattccacagtggctaccacactgtacattcctatcagcaatgtacagggttccagtttcttcacatccttactattttccattttactgatcacggccatcctactacatttcattctattacatttaatagtaaatgtgaagtggcacctcattacggtttttttttctttttttttttttttgaagacggagtctcgctctgtggcccaggctggagtgcagtggcatgatctcagctcacggcaacctctgcctcccgggttcaagcgattctcctgcctcgacctcccgagtagctgggattataggcacaccccaccaggcctggctaatttttgtatttttaggagagacagggtttctccacgttggccaggctggtctcaaactcctgacctcaggtgatcttcccaccttggcctcccaaagtgctgggattacaggcgtgagccaccacgcccagcctcattgtggttttgatttgcatttccttaataactgatgatgaggagcatcttttcacgtgcttgtcggccatttgtatatcttctttggagaaaggtctattcaactcctttgctcttttatatttagggttatctgtcctttggtcatttttaagcaaggtactccaatattcttctctatgcatactcctttaaacagacaaaacgcaaaacagtgcggtggttaggaagctgtgctatgaaaccagactgcttgggtctgtcctgcaacttagtcactatgagaccttgacaaaattatctctctgagccaaaatatcttaagagtaaacctcgtggatatgtagtaaatattaaataatcaatgtaatatacatatcatggcatgtgacacatagaaaagctataaaatgtttcaaaagccaataaaagtatgcacaggtagcacgttcatgtaattacttgtgtacttccataaggatgggaaaaatgcacgaacctctcccagattcagccatgtaagggtagaaggaacttcagggaggaagtcacaggttttttgcctccatgttaagacaaaaatggccccataatgaaaagcactgtgcaaaatattaatttttaaatatctttttaacaacataggaaaggcattcttctacttttgcaaaggaggcagaaccaaaatctgtgaagaacctttggctatacagacactccacagggaccaaatctcctgccccatcacacattcctgggaattaaaaagaatggagaacgtttacaagctgctgtactttataattgttatttctttgaaatgattctttttctttgtgagaggaaaataaaccacagtatattgctgagaagtattaagactcattcctttctgcccacacacaaaaattcgttgcacccggaggaatcatgtcaagcagtccacctgcttgggtctaaaagtcatgtatattgttctgacaagtctaccttgctgccaatatgcttttgccgtctttagaaaggagtgtttagtaaaacaaatgatgcctatacagtgtccatgtacaaaggcccctgtgttccagttctatcccatacttgaaaaacaaaggctctttcagggtagggggttcaatatcacctgctatgtactctggtccaattaaatttcccatttgtaatacacaattttatacctataattctttctgtcattttacattgctttaatatgaaaagaagtctctgcttcacttgaattccttagagagcctggcttttctaaaagcttgtgtgtccgtccctacatccctcccacctacaccaaatttaaaccttgacagactaatacattggatagcaatccaggcagtctgcaaaagacagatgccaaggcccaggagtcacgggtaagctcacgtttatcttccacactgcaacgaatagataggatggaagaggtagtcagaaattagtaagccaagatgaaaaacgccaaagttaatttaacaaatatagagaaggaaaattggtcaaagtcagttacagggcaaaagactttctttcaaaaaaaaaaaaaaaaaaaaaaacctctaacaatatatgtgaaaagggcaaagcttaaaaagctggactatctaagaaacaaaataatgttcctggagtagcaaacagaagtcctgtttgctcttcttgggacaaatgctcttgcttgtcccagatcacaggtgaaaaaagatacttccaggcagaataacaatggatagcactgggagtctcaagtttgagttccagctctaaagatacagcaaggccgggtgcggtggctcgggcctgtaatcccagcattcggccaaggcaggcggatcaccttaggtcaggagtttgagaccagcctggccaacacggtgaaaccccatgtctactaaaactacaaaaattagcagggcattgtggcacaagcctataaccccagctacccgagaagctgaggcaggagaatcgcttgaacccaggaggtgaaggttgcagagagccaagattgtgccactgcactccagcctaggcaacagagcaagactctgccaaaaaaaaaaaaaagatacagcaagaaatcttcagtctaaaatgtacctataaactcatttttcacagattatggaaatatttttgattttcaagttttgataacaaaactagaatgtgttacagtttaattctgagtctgcatcgttcttggtttttgatcattatagaaaatacagaaaacacagaataaggaaaaaagagaatgtgacatagtacaacttaagaaaaaataatttgggtgttatttcctcactatcaaaaacaataattaaataatatatttttcattaacctaaaatgaagaatttaacacaatgattttctccccctcctagaaatatgctcaattaaaaatatcagaatagtgtgatatatattatgtatgaaatataatccaactaatactgcagcatggttagtttccatattactaaatatgcctcatggttgcatgtagcttccctttacatttatttataattcatttaaccactcccacactcattacttttttttttttttgctattaaaaaaaagtataattactgctttcaccaaacaaggattgctatgaataattttttcttaattttaatttttctttttttattggcctacttaggaattctactatgagtaatttttgactcgataaatatttctaaatttgcttgtctcaaaatataaatcaatttacacaaaaacggtagtaatacaagactgcctgtcttaaactctccctaagatttgggcattaacatttcttgttcatttttgtcaaatggcatttcactatttacctttcattcttccaaatgaacactaaaaaattacctggaaaactgctttcaagaaacgtagtcgagaaagactgacacgttataatgctcagtcttatcatctacaaacatactatgtctttccaagtaatcttctacatttcttaaagctcgtagacttcttattttcctgcactgtttgtgaccgctaaatactgtattttgcaaaacctttcagtttttttatatgcaaaattcatgttatttttcaaacaaccctctaattttttttaaaccagaagattattttctatggtttcatagtctacaaattactactttcagattatcaatttctgagtatactttgtttctttcagtacatgttatggttctctattctagttttctaagtggttttgatttctactttggtctaatagagtttctgtgctcccacgcattgggtgaggtagaaccaatgctgtctgtgtacaatcaagaattgattttggtaaacgtttcaaagataactgaaaaaaaggtatatttcttttataaaagatatcaagtttatcctatcaattgttttttatcttaaattatttttatatgacattaatataatccctcctttctttgaatttctctgattcacctttgcatatccttttgctttaaatcataacattttagatcattctttttccagagggatgggggtagggagtgccggtgtcatcactggaaaagagcttacacctgagagtactggagtcatgtcttcttaacagagacacctgccaagaaattcattgttaggtgattttgtccttgtgtcaacatcatagacacactaacgcaaacctagatgagacagtctactacacacctgggctacatgatattgcctattgctcctaggctacaaacctgtacagtatgttcttgtactgaatactataggcagttgtaatacaatggtaggtatttatgtatctacacttatctaaacatagaagaggtacaataaaaatacagtataaggttgggcatggtggctcatgcctatgattccaatgctttgggaggccaaggtgggggaattgcttgaggccgggagtttgagaccagactgggcaacatagcaagacctcaactctagaaaaacttaaaaaattaacccagcatgttggcaaacatctgtaatcatagctactcagcaggctgaggcaagagaattgcttgagcccaggagttcgaggctacagtgagccaagatcacatcactgcattccatcctgggtgacagactatgactttatctcatgaaggaaaagaaagttatgaaagataaaaatggtatacctatgtagagcactgaccatgaatggagcttgcaggactacaagttgctctccgtgaatgagcgagtggcaggtgaatgtgaaggcctagaacactcactgtactctactgtagactatccacactgcacgcttaggctacacaggcctagaacactcactgttctctactgtagactttatcaacaccacacacttaggctacacaggcctagaacactcactgttctctactgcagactatccacactgtacgcttaggctacacaggcctagaacactcactgtactctactgtagactttatcaacactgcacacttaggctacacaggcctagaacactcactgtactgtagactttatcaacactacacacttaggctacacaggcctagaacactcactgttctctactgcagactatccacactgtatgcttaggctacacaggcctagaacactcactgttctctactgtagactttatcaacactgcacacttaggctacacaggcctagaacactcactgtactctactgtagactttatcaacactacacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagactttatcaacactgtacacttaggctacacaggcctagaacactcactgtactctactgtagactttatcaacactacacacttaggctacacaggcctagaacactcactgtactgtactgtagactttatcaacactacacacttatgctacacaggcctagaacactcactgtactctactgtagactttatcaacactgtacgcttaggctacacaggcctagaacactcactgtactctactgtagactttatcaacaccgcacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagacttcatcaacactacacacttaggctacaccggcctagaacactcactgtactctactgtagactttatcaacactacacacttaggctacacaggcctagaacactcactgtattctactctagactttatcaacgctgtacacttaggctacactacatttattaaaaatctttttctttcttcagtaataaattaagcttagcttactgtaactttttactttataaactttttttaaccttttgactcttgtaataatacttaccttaaaacactaacacattgttcagctgtatgaaaacatttccttttttataaccttattctataagctttgaactatttttaaattttttttactttttaaactttttgttaaaaacgacgacacaaacacacacattagtctatgcctacacagggtcggggtcatgaatagcactgtcttccacctccatatcagatctcactggaaagtattcagggtcaataaaggcatggagctgtcagctcttatgataacaatgccttctctggaatacctcctaaaggaactacctgaggctgtttacagttaattttttaatgctttttttttctgagacagggtcttgctttcctgccctggctgaagtgcagtagcgggatcatagctcacataaacctcaaactcctgggctcaagctatcctcccacctcggcctcctgagtacccaggactacaggtgcgtgtcaccacacctgactattttttatttttatttttgcagacacagggtctcattatgctactcagattggtctcaaactccttatgtcaagcaatccttctacctcaggctcccaaagggctgggactacaggcatgagccactgcatctggccaactttattttttttaataagtagaaggagtgtgctctaaggataaaagtataatatagtaaatatataaacgagcaacacagtcatttcttatcactatcaagtattatatatggcacagaattacatgtgctacactttgatagaactggcagtaccgtagggtttttaataccaggttcaccacaaacacgagtaatgtgttgtctgtggagttatgacaggtggtagaaagttccccgctctattataatattatgggaccagcattgtatacacagtccatccttaaccaaaacatcattatgctgccatgacaacatttgtttggttttcttgtttgttgtttgtttttaagaccaggtctggccctgtcgcccaggttggagtgcagtggcacaattaaagcccactgcagcctctgcctcccaggctcaagaaattctcctacctcagcctcttgagtagctgggactacaggcacatgccaccacgcctgactaatttttgtatttttagtagagatggggtttcactatgttggccaggctggtctcaaactcctgagttcaggtgaccctcccgccttggcctcccaaaatgctggaattacaggtacacaccgctgcatgactacatttgtttcttaacagtggatctattccaggagagtggagtctcaacaattactaattattagttataatatatctgcctttcttcttcacactttcatctggtaagcacctgataaactgaaataacgtttgctctgatcaccagtcgatgaatctctgctgcttttagaaatatctaaaatattacaatactttctaaggtcatgaaaatcttttaggtattaatgagagtgtgggttacatgaatatgcatttatctatactcaaatatcatcaaattatatccttaaatatacacattttatcatttatacaatacacctcaaagttcagaaattattgggggaaaaactaagtatagctcaaggagtaactgcgcctgtgccctatgtagaaaacgcactggtgatacagacaaacattcatttatttacaaaatcgtatttgagtagaaaatattgtgtcatcgtattttgtaacatggtaaatatccctttatattgcaccaaaaattagagtcaggcttcaagatgatttttacataccttattataataaacttagtattatccaactgataggagataaaacaaaaagcaccactgggagaggtttacaattcaggtaaaataaatgctttgttctttgagatctggagtaataactgtctgcttattaaacaaaaaggttattttttcctatgcataacctttacagtacagaagtactccagacttgaaaatccctctaccacctgaggattaaaacactttaaatattcaaatctaacttcttaagtttgaactatactttccatcacagatctggaagtagtctgtgaactatcgaggaagacagggccattcacagggtggtcattcactcaatttggggaaacagagtatcttctaatctgttaggattttgctgaatgacatttgctaggggaaagttttaaacatttattgccgacactccaggaaaatagagggtaatttactggcatgtgtgattgtcaagtgggagaatatgtcaatcacctaattatcattattcattaaggagggctttcaaatacattgtaaatgaaacatgtgtaaagtagccatgaattccaagtatattatactgtgcagacacagaataaaaacttttttcaaaatacataatttacttgaaggagtttcctttcttaaatacattctctatgaaaagcaatttgtactgactcaagttaccacatcttccatggtccttttagaagagatatttattcaaaagcagaaagataatggaaaccaagtgttttactctaagctaatgttacacaaaatcactaagataattttttatttcgttccagtactctcctttccattgagtcctccaggcctcaacccaaaccccctcaccagtaaccacaaaataataattcttttttatctgctacttagtctcagaaacaaactgtggagtcccaaaatcaggtcagctgacaaaattagccttcctcaactacacccataagtaccagtggatccaggccattcctacatccattcaccactgtccggctcttaagaaggactatatttagctcttcagagcccttggcagaaagagataaacattaaaaaacaaaacattattttgaactgaattgataccgtaacaaaaaagtaacatttgactctttaaaacattggaaaacacttacatggtctgaccctcagcaacacgaaaacatattcgaagcaatgagattaatgcttatataggcttttgtttgttttgagacaaggtcttgctgtggcccagactggaatgcagtggcgcaagatcacagctcactgcagccttgacctcccgggctcaggcaactctcctaccacagcctcctgagtagctgggcccacaggtgcgtgccaacatgcctggcaaattactgtattttttgcagagacagggttttgccatgttgtccaggctggtctgaaactcctgagctcaagcaacctgctcacctcggcctcccaaagtgttgggattacagatgtgagccaccacaccagcctatactggccgtttgttaatggcactggtaatattggctcttccccttagacggctcatgaggctagccactcttgaactaaaagaatgcacgtataacatacaaacataatgtctgaatccccaaactatagactttaacccaaattggtgaaacacaaaggaaaaggaaaagaaactttaaattgtttttaggcctgctgtttggatattacaggaaccactgtgatttatatttggcctgagggtataaagatctatgattttatttatggcttggttaaatcttttcaaaacacaagagccacctattcataatattaagaaatcaggtgatttaaaccttactacactctgctaatatactgttctcttcagtagaaacatgtaggagtatgttagggacaatctctcaattatgagcaaatttacaacttcaatgctgtcttcttaaattacatgccatcacttacaatccaaacatcatttaagagtttataagtttaaaaggaggacaaaacaaaaacctttaacaactcattattatttaagccagagttgcaccaagttaccccttcaattgtctaaataaattctagacatggcagcctactgaataaataaaagcaattgataatcccactctatagaaaagcaaaaaagcacaaacataaaatcaagagaccacaccgaagtagcatcatggagaagaataaacattttcaggacagaaaatgtttaagaagaacagcaaaaaagaacaaaggtaggtatattaaatgagcaaggaaggagtggaactgttgaaaggtggggtctaaaaaggctgtgacctgctttctaagtaaagcctagtccaaaaatgtcttgtgaccagatcaatttccattccttctcgaaagatggaagacataagcaaaacacatagagctatgaggacagagtggataatgattagtacatagaaaagttgctacttcgaaggattcagatattaagtagagcaattaaagaatttctccaatgacatcaatctcaaccagacggatgttctcaacatttcgcctagcaactcccccaggccatccttacagcaggcttagggaggtgctactctcttggttcctgctttcaaaaagggtgctgcctccatttagtgatgtttataaaaatggcagtggtttcctatttgaatgttaattattgttatgacacacaaggtaatttaacttgctttggtaatttattcacccttctaattagatgtagttactggaaaatcttccagagtgtagcaacagttccaaaggtgaaatggcaggaggagggagctttcccataggatcgcaactgtaaatctgggatggatgttcaattgccagtcacctgaatgaacaatgccagggatcagagacggtccttctggaatcaagcaggtggcacccatcaccttcaagaatttgatgattcaagaggaaggtaaagccccaaaagatggttggagctactctgaaaagattaaagactgaacttgaatgaaccaaggaacaataccacacaacaccattttaaatctcctagaccgggagtcatttacatacagttgagaaatgccgtagacagagtataagccaaaaacaccactgaagtgggagaggctccactcgagttacttgctttgtggaagtattttcacgcttgccacatcatacctgctcgatcaatatttactgaaacaagcaaatgaatgaatggacaagtgcatgcatggctacagcataaaaacaggcacacccactccatctctctcattacggcctcctcagcaagcagaccttttttcttaatttgaaggtccccaaagtgagcgagtttcaatcaacagaaatttctttgtctttaattaaactgagctgccactgcttcttctgtgaggtctaagtgccagcctgtagccatgttctacgctagccagaagggaaagactgaatcatatttgtgaccaaaaaaaaaaacccattagactccaatcaatgcagagcaggtggctgatgactgcagcgatccctatgaggagcacggattgatactgccaaatgaacacattaactgaaactacccaggccttaggggaatggccagaggcccctgtagggaacagtttaagtcaaacttttcctgcttccattgtaggatggaggattcaagggctcagattatataaacaagttcaaggccatgcaagaatgtatacagaaatactcaaacctctaaccccaacaggaagaggaagaggaggaggaggagaagtagccagcagaacaagtggaagaaacagcttccagtgaggtcactgcacccaaagaagaggagcagtcaagctaacgaaagccacatggcactgggctccagtccttccacttcagagtgatatggaccttcgcaaaaggcctttcaattgccctccaagaaagcgtctttccctctgttgtcctcttcactgtaatgcacaaaataatttattttggtgatgaggggtcctgatctcttgacatacagactgaaaaaatgggggttgtatgtgtgtcctacatataaatctgtcagcaaatattgccaccactgaattctattttctcagattgccctcaattttgccactctgaaataatgtgctgaataatctcagcaaccagaaatcatcatccaggaatgtttcttatgagacagctgatttattcggattcactagatcccttttagtagatttaatccccctttgggaaatgtaatagcaagaaaaacatcttttaaaagtgctggagtgaggccacttctcctagaagaagccagatggtcagatatatatttctcaaaacccatcttaaccttgagtatatgaagggatactacatttcattcctgataaattttggtttccatgttggcattgagctccaggctttctatgtgttgatagcggagatttggaccctccatccacagtctctttctaagtgaaggggaagattggtttttgctgttccttgttattccaaaagctctggtctggggcccatgttcaccctggctctcagtctggtcagatgcaatgttcttcaaaggtggggacctacttgttatcagagtagcagccaaaagaggaaaaggtgtgaattaagtactcagttaaaaggaaacatgagaccaggtgtggtggctcatgccaataaccccagcactttgggaggtcaaggcaggaggatcacttgagccacagagttcaagaccaccctgggcaatatagcaagatcccatatctaatatatctaatatagatatattagaaaatatatatctacatatagtagaaaaatatatatacacatatattagaaaatatatatacatatatgtatattagaaaacataatctctctctatatatatgtgtatatataaactacttatatatatataagtatatatataaactacttatatatataagtatatatataaactacttatatatatataagtatatatataaactacctattctatcttataccttccactcaaggtcatgaagatttgattttggagactgatgcaaatgtttgccacctgattttaaaactcaggagggttaggccgggtgtggtggttcatgcctgtaatcccagcactttaggaggccgaggcaggtggatcatgaagtcaggagatcaagaccatcctggttaacatggtgaaactccatctctactaaaaatacaaaaaaagttagctgggagtggtggtggatgcctgtagtcccagctacttgagaggctaacgcaggagaacagcttgaacctgggaggcagtgcttgcagtgagctgagatcgcaccaccacactccaagcctgggcaacagagcaagactctgtctcaaaaaaaaaaaaaaaaaaaaaaaaaaaaaaaaaaaaaacaactcaggagggcagaagagaatgggtaatcactatacctagtttccagcaagagattcctccctttagaaacactccccagaactgacagaaacagagaaagaggcgtaaggagccataaagagatgtgacgtgctttaaaagcaacaaaatatcagggaggaacatactctactctaatatgtccatcataggggttctatttgtttcctacagataaagtgatcatttaactatgaaaattactatcattcatctctccacatgcattcccatccttgagaagtggtaggaaccatgcgcctctgggatgtggaaacaagtgctcttgtgaacagaggtttcattccactgagagaaatggccatgcaaagcagtgtctcaagagagcaaggcaaatcaatgtctcgcctagagtatattttacaaatttctaatacaaatgattgcactgaaggacaaaggttttcctgtactcttcctccatccaaccttcaaacagatacactagtctcagctctagtggaagtaggaggcatccttgacattatactcagctgtgatgtaaggaatctgtgtacttacaaaactaatgcaaagcatttcaggctgtcagctgacatccctgccactccccacagctgagactattcagtaatggcagtacatctgacatcctgtctgacatctagaggactcaggaaattcaaagaaaatactataaattctatcatttcatgattcacacttcatgcaaccaaagatctcctctacacaaaaacacaggaaatgtcagaataccccataggtatgtgatttttcttaacttgtatggttttatttataagaaataaattcagttactgaattatgaaacagacacataggggtcccctttgggatctagtccttaagatgcgttcaagaggatgaaggatgtccatctctgagatatattagtacttctacaacccgtgtgccaagcaccagtgggctaacatatcctccagatacatagacacaacttaaagcagagaagccaggtagagagatttgaaaaatgaattctaacactagcatactaaattcccaaataaattgtttaattacattgtacctacatttccccaatgatcacgtagagataattacctttgcttatttcacagggggcatttgtaataataaaaagaattatttgaaatcttcaaagaaagagcactattttaacctacttatataaggaacagaaagagaaaattgagttaacagtcttaaattctgccaaattaatctaatttttaaaaagagagaccaagtaaaacctcaccactgttgttctcatcgtaactgaaatccagcacattaaagagagagagaaagagatcaacttttaaaacttgtaaaactccatccctggtggccacaaacactcttatcagttccccactgaaaacccctcctcgccatctcccttccttcccctttctcctattacctcagccttcactccacttaatcttcccatctctcgacttctctatcacctcttcctccctgatagttatgacctcactcccactgtcacacatagaactgatccaaaggggacctaagaattattctaaccaatctcccacacagtaaaaaggacaactggagactgaagtgataacgtcacaggctcagggtcaggtagccactttcatgcaaagctgggtcctcacctagatatatgactcccagtacagtactctttccagtaccccacacaacagtctacctggacctgttcaccagccttatccaagagatccatttctgaaacagttaggtgcactttgttgttcttccaccatataaagcactttgagtcacaattagaaaaataaaactgatgacagcaatcagattagaatcctgtatctggaagacacctttacccataatccatcttatccaggaagtaagactcaggaggccatttccacaatgcctctcctccccagacactcattcctatgttcaacatcacttccattgctcaaacctaaatccttcctaatgatgatactgaagcaaaatcacaataccaggttttccagacccggctgagaagacactaactgagcccctaagtacaaatgagcatacttaacatagagaagacacagttagcacattgctaaatttctccacacccttatttttagcagattaaataattgtaacccctttaactttatcttctaagtctatttttggcttttatctaaggcccctttaaattctccatgttgcttttggaaagctagagtccagaaccaaggacaggtagctaaagtgtttcacataagagaaactccatcaacaaaagtattgcgaagtctgtacaagcccagggcaatcaatgaaatctgcatgtaaacgaggcagttttccagacaatacttttcaattagactaacttacaaacttgaggaataacgagaaactacaaagaaaacatcaactgcgtcttcaaagcattttcaagcacaaaccctaatacagtttactggatgccatttaattgggcagctctaagcatgtagctaaatacaagaaggttggcataagagataaaaaagcaaacaatgtccaagctacatcacttaaatactgtcagaacaaggttaagaagaagcaaggtgagaaatcagggaaaatgcaaataagaattccatttcctacaagataaagaaagataaataaaaatcctgactagctaggggagtatgtccagcaccaaaaaaaaaaagtaattatttcatgtgtggtcctgatataaagtcttgaaaataataaggctgctaaattgcaaatatcagggaagtgaagtagtagctcaaaagattatgaaaattgagatttccaaactgaatttgaaaaggaaacaggtaaaatgaggtcaggacattacagatgagaaagaagcttctactatttggctggctgttttaaattaataacctggaacattagcaggtttaaagtcctataaaaatgacacggagggagaagtaaatgcggtagaaacagcagtgtttacaccttcatcatagaaaggtattactaaaaggatttacaaggtggtaacaggatacatatcaaagtcaaagcgctttaataaatgatgagaaaagacattaggcatggaagtaaagccgaagggcttgaaataactccacctatccacgtcccagattattttaaaccaagtaagccactccaagatccacaaaagatcaggttgtatttttccctaagtggcagtattcccatgagcaccaaagcagtaaaggcagtaggtagaaaaaccaggagttaaaagaatataaaacactagtcctttctgggatattgttacacatgctgaaagaatctaaatatatatatcatgacccaaagaggtctcaggcttaaaatccaaaaagaaagaaaagcaagtatattgcccttttttcctattgggaaaaccttgtaaccactgaaaaattagaacagataaataggaatgggtcagtataattagtatcttctaattatagaagcacccagattggcatcaaactcaccaactcttggctgtcttcaacaatgaccaggcctcctctggggagactacttcttgccatcctcaatctgtacctcagatgtgtgacttcttgcttctaacaatatcacagattatggactaaatgtttgtgtcctcccaaaattcttacgttgcagccctaaccctctgattctatttggagaaggggcttctcagacagtaattaaggttaaatgaggtcatacaggtggggacctgacacaataggattagtgtcctcacaggtagagaccagagagctcattgacctgctcccttcctccctgtgtgcttgcatgaggaagggccatgtgaggacttagcaaggaggcaccatctgcaagccaggaagagagacctcaccagaaacctagtgggccagaaccttgtcttaggcttctagtgttgagaactgtgaggaattataaatttctgttttttaagccacccagtctgtggagttttgttacagtaccctgaggtggctcagacatacctaccacattgatgcttaatagtgactacccaaacagcaggaataaaagtttcaatttgtttcttacatttcctaatgcaatgctctgtaaggctagatgttttagaaatgctttttgaacttaataatggttttaaaaagtcacagacttcaataacagccatcattttctataagcactaatggtgttatatgccaagaatttttaaaggcaaataaatttttcttcttatctaaaaagctgcctggagaatgctcacccttcctttactcactactgaaaactgtcaatagcaattcaagtaatataattccttttttttggaggcagagtcttgctctatcccccaggctggagtgcagtggcgcgatctcggctactgcaacctccgcctcccgggttcaagcgattctcctgcctcattctcctgagtagctgggactgcaggtgcccgccaacacgcccggctaatttttgtacttttagtagagacagggttttgccatgttagtgattctttttttttttttttttttttttgagacggagttttgctctgtcgcccaggctggagtgtggagtgcagtggcgcgatctcggctcactgcaagctccgcctcccgggttcaagccattctcctgcctcagcctcacgagtagctgaaactacaggcgcccgccaccacgcccggctaattttttgtatgtttagtagacatggggtttcaccatgttagccaggatggtctcgatctcctgatttcgtgatcacccgcctcggcctcccaaagtgctgggattacaggcatgagccaccgtgcctggctggtaattccttttcaagaattacaaacaccaaagtatcttgtacaatggtaatttatgtgcacacgtatgctaaaaatgccaaaaagaacttacacaatttttacatacataacatactttagttccttgattctatgccaattcacctaaatattaacaaacttaggacagtggaccttgggcttacagaatattaaattgtagaataacagaatcataaaatcatagaatcacagactagaggtttgtctcggtcaaatctcaccattttttttaaatgaggaaaaccagagctcagtaccttgctcaaagtaacataaatagttcccttaattcccagaattgtggttttttactgtattgttaagaaataattttctgtaaagcaaaataatgattctcaaaattaataaaacacatataaaagatttaactcactagaaaatgagtaagatgctaagtctgatttttaaaagaattcaaagaagacacaaatacataagcatcagaaatgccagcaagatgtaaaatgtgcaaaactagtcaatatgcataggaaaataatctattgcattctccaaacacaactgcattttatggacaagaaccaggcgctttactgtctattttctgcagcacacacaattctagtacagctcaaagacagtgaaaggcagagctgacctgatggttgagtagacaaaacatgctcttttttttttaatcatttcaaagtctttcctcacagtcccttaccatgcacaagtactctgaaaccagagaacagcacggtgggtgaattcaaaaaacagaatttagaattcttgtttaattgctaactttctgaaagccctcagaaaaagacccaagttcatttcatatcagccccaaaactaagagacaatgaaaacttgacctgtgagagtctggcactgtcaatgtccacagcacttctctcaaaatgatccctctgaatacttacaataatcccaccagggcaaaaggttcacaacagcagttcctcagccaagtcgtgggaaaggctgtatcacattccggtcttctgcttcccagtctcacactctccccacatcacaggcacagttacctcgcaggagaatgtctctgaagccccttagagtcattatgcaagaggtctcacggaacaacttttcgctgtgactgaagagatgaaatgtaaaatgaggaaacacgaaagaagaaatggtctgctacacaaacatacaaagtaggtgtgatgtgctagataacgaggtgatgtgctgatggagctcaactctgaccccagttccacagctccagtcaaaagatctgcgtttaagaaaggagaaacaaggtggctcatgcctgtaatcccagcactttggtgcggtggcgcacgcctatattcccagctactcgggaggctgaggcaggagaatggtgtgaacccggaggcagagcctgcattgagcagagatcgtgccactgcactccagcctaggcaacagagtgagactctgtctcaaaaaaaaaaaaaagaaaagaaaagaaaggagaaacaaataggaatgaagagtggaaaagatatcaaataaggacccaaaagcactctgagaaaacaataaggttcttatgtcctgtgttcaggcaaagaaacacaagacatagacatgaagagaacagaaagcaaggaataatgtttaaaactaatttggcacaattttttttcttttaaaatgctcaagaggatcattgcagaaaacacagtggtaaagcaagctgctgagggatttttcaatagctccactgtgaaaaaacaagcacatcttaaaactacaagctttgaaacttttaaatttcttaattaaaatatttctagattccgttcatttctaagcaagactgcagccctaaagagaccagtaaatttttattcatcttttttgaaacaaacatgattaacaagtcattgtttgaatagaaaactatgaattaaacaaacaagcaaacaaccccacaataatggaacccattccttggagataatgacaatgcaaagtacaagaaacccattttgaagcattagtttcatgtgagcacttgttgacggaaatattacaagaagtccccctaagaacagttctcttcattgtcgtatcaatggtcttggtggctcacattcctcacgtgcactgagggccgtcttgataaaaagtatctagtagacctcttggtgtcaagttgtaaagctcgaacttgttttgggatttttaagaatgtataataaatatcgatttattaatttacaataaaaaaactaatgggtgaaaggactggacactcagcctctgaccttcatgttttctccctgcataggaagtcaaactactatcagaatgttgtcgtgtctggcactacagcaagagcaatgagttgcacaaaccatgaagcaaacagactgttcattcatccagcacgtcctggcctagagctagaaatacagcagcgaacaggagcgatcagagtccagattggactctgaaaagaggatctccttgccccaggagctgtgcagtatggccccagttctagctttctctggcctagacaatgcctaatggagccctgcaaagattcacttcactgacttttttaaaaatatttttatataacataaaattttcactttaaccattttaagtgtacacttcaatggcattaaattcaaaatgttgtgtaaccatgaccactatttccaaaagatttttgtcatcccaaacagaaactctgaacaagtttgctttttaaaagtggcacaagttactaacatttgtggttgacatttttttttttaatatctatgttaagaactcgattataggcctacccataatatgcttctttaagaggtctggggccaggcgtggtggctcatgcctgtaatcccaacactttggggggccaaagtgggtggattgcttgaactcaggagtttgagatcagcctgggcaacatggtgagaccctatcgctactaaaaacacaaaaaagagccaggcatggtggtgcacatttgtggtcccagctactcgggaggctagtgaggaggatcactggagcctgcagggcaaaagctgcaatgagccaagatcgcaccactgcactccagcctgcgtgacagagcaagaccctgtctcaaaaaaaaaaaaaaaggtctgtatgtttcattagccattgtgtgtgtttatgttaaaaatatgaagtgtttcacaaatttgcatgtcacccttgtacaggagccatactaatcttctctgtctcattctaattttttagtatatgtgctgctgaagcacgaactagccattgggttttgattttataactgttttccagaaggcaaacttctaacttcttaaagagaaaggtaccttgttgccatgtcctccctcccaccccactacacagaggcgctttcttctacaatgcacactatttcatccaactcttacaaatatctaaagagatgctatcatcagctttttagacataaggaagctgagactcacaggaatgatatttctcaaagctactcaggaagcaagggaacaacgcaagtgtcggtaacagttattccatattggagcatgactgactggatgaatatatgtttgtttttgctatacagctaacattaactggttctaagactgaatactgtattaaatttgttattaaaatacatactcctataacaagaagggacatataagacaaaataggaaagatgaaaaggttttaaagacacaggagaggctaaagaagtgatttttaatggatatactctgggagaaattctcaactatttccctacaaatgggtgacattagtcacttagggtggctgccttttttctgaaagctatcagacatctccatgggcaaaataaagaaagagaccccctacggtttatttatgtacgtatcatggtagcactccgtggttttaagacatattgaaactccatcatatgctgcttttaaagcccaaataactaaaataaaaactcccaggcacagcaacggcaaaatactgtcatttgtatgtgcttaggagacacgtgtctctaaaagcaacatgtacatttctcttttcaagcaaatgtttaaagaactggcaccgtaacaaacaaggggaaatatggagatcagttttaaaggcaggatttgtttttgtggagtctaatttatttcaagaaatccagattattaaattcacctcctatctgaggaaggatctcaaaggaaaggtaatacaggctagtcgtccttaaatgcccaagtccaaaagactagtatttaagacccaagtttatcacttactaagtgtcagaccttggccatgttacataatcgctctcaatctgtttcctcaaaataatactgcttaacaaaggattaagtaaaatggtgcgtataaagcaccacacacagaccgtagcgtatacttaagagttttatttcagcattagaaagcatgggaggccgggcgcggtggctcacgcctgtaatcccaacactctgggaggccaaggagggtggatcacaaggtcaggagttcgagaccagtctggccaatatggtgaaaccccgtctctactaagaatacaaaaattagccaggcgtggtggcaggcacctgtagtcccagctactcgggaggctgaggcaggagaatcgcttgaacccgggaggcagaggttgcagtgggccaagatcgtgccattgcactccaacctaggtgacagagtaagactctgtctcaaaaaaaaaaaaaaaaaaaaaaaaggaagcatgggaagtaggggagtcgctaaagctcactgatttaaattactactcaattagactaaattttttaaaaatcatgattttctttgtccccctccccaactcacacacaaaaagccaacactatactaaataatagaagatagtcgaggtcaagattttcaccttgttctccagctatcattttttccctcccgacttctattttggattaaggtatttcaggggccccaacatcaaagtagaacagaagaaggaaagcaagagaaaatgagaggtaggaactagaaaagccagtatcagaaaagcatacagcacttcctcactatactagcaaagcttaccatgcaatattcaacaggtaaatcctgatggatggctgacaccgggttcaagacactagtccacatgctccacatactgaataccctaaggtagttcagagagaaactgaggggaagacggagaaaacgcacctcacggtgcattctgtatgtcactgccttacacgcaggagtttcaatgttttggtaccaattaaagaccaactatcagttctccatggaagcagcaaaatataaaagtatccttgaaatcagtacagggcccttctgcgagggtctggtgatgtggttttgagattctttgttttggatcattcctcgtttggtggacccacaaataatggtcctgcctagaaccatcaccgcaagctagagtgaaaaaatgccagaagactaggctggtgggtaaaaaaattcaacgtttttcctcatgattaaccttgggtggccttgacaagttatgtaaggttttgtttcttcagaaagacactgcatttttagaacatctctaggcacaaaaattagtcatgtaactgaaagacaagaaaattttaagcatatattataaataaatgtgaatattaggggtgtgtatccaaacacatgaatagctcttaaaagaataagacaaaaagatcaaacatatttgaaatcagagagatgtcttttgggaactgaactcttgccatgagcaggagaaaaccagaaaggtcttcatgggttctggtacctgttcaaccattaattcatgatgtgtcgctggaaaaagatcacaaatgtcttcaagcttcattttccctatctgtatctgcccaagatctcactggattctcgaagaatcaaatatgataacacagtcattcctgaagtatggccacggaccaacagcatcagtaagtcaggaacttgttcaaatgcagttgagtcccacccagtcctaataaatgagaaacttcagcaatcggttattctgatgcaccttgaagtttgagaaccactgcacaaaaacagatacaatctgaaacatctgaaaacactggagtgttgttattacggaaaaaattaagaatcatacattgaagatcttaagaactttcacttaaaagttggatacagaagaggctatgtgtggcttttgttgttgtttttgttgctgttgttgaaacaaggtgtcactctgtcacccaggctggagtgcagtggtattattatagctcactgtagccttgaatacctgagctcaagcgatcctccttcctcagcctcccaagcagctggaaccacaggcatgtgccatcatgctcagctattttttattttatttacttatttacttttttaatttataagaaaagaggtttaattgaagaaattggcaaaaagaaaggggctacagaactcctgcaactttggaacccagcagggcagttgttaaatgttaaagctccaaaataacctggctcatttttaatttttcttttgtagtgatgaagtcttgctgtgttgcccaggctggtgtcgaactcctgggccgaagcgatcctcctacctcagcctcccaaagtgctggaattacaggcgtgagccactgtgcctaacctatgtgtggcttttttaaagccaagattcgcagttaatgtaaatgctacaataaaataaaatccaaaattacggtacctatcaatgttaaaatgcagtattatttccttataactttaaaagggttaagggaaaagaaataaaattagtaatgattgtaatgattacatattctttaaagagtaaatatgagactaaatgtatctcaatccaactattaataaaaaaagagtgaacttgagattagctctctctagggaaaaaggagaacagtaagtcctcctgggatctttacattttcttggcaagagtaatgcattcattgcttttaaaaaggtaaaaggtaaagtcaaaaaaaaaaaagaaatgtagttacaaaagatgcatttcaattgataatgaaggcttttaatgtaatgattataggaaatcttggaggagttctaataagtacagccaaattaagaacaaaatatgctaagaaaacagagaagtcatattgtttttcattctacattctagttaaacccaataaaacatgtgaagacaaaagtattcctcattagaagtatccttaggtcccatttatcgtcatatcttgtttactaccagttaagaaaatatggtactacagcctctgacaaattagggacaacctgagagccacattggtagaaacatacagatctgaaaaaattctgggatgaaagtaaggaagaagagattggaagaataaattaacatttaaaatacaacaagatcacatagaaatagaaatagttcgatgaaaagacttgtccataaaaagcaaaattaccaactatctggagatttaaattagactgtactgatgaatgtattcttcagaatatgtttatttgtatgatcttttacgtacccttcaataaaactctagactaagtccctacgacaaaagaggcagccccagcagtggccttgtggcctgatctacagagacagcaagccgccattcactgacccacccccatcacactggcaccccacgtttctctccaagcttcttccccacagtataaatcagatccaaattagctgctagtcataatcagcagaaaggatggagaggccttacagttaccttagacacagccctagtggtcttctcctacttcctcagggacggcctccgccagcagcacaacagcacacttcctgtagatctacaatcagttcttccgagccgcagacggctgctatcgtcctcgcagctctccgggtactcacgcttctttttctccctctttaattctaggccttcttttctttcttacctttgtgtcccctttcaagctttcccttttattcaaacgtacaccaaaatggcaaaagcagcaaagcattctaaatcatgttcacgcaagccagtgctggggaacaaaatggatacaaattggtcattatgttctctttcatttgggggtggcgcacaattaagagaggtacgctgtttttatgtacttctctataactgcagctctaaaggttcctcataccatcatgaaatttaagaggtacatgagcaatggcactatactgggaaagttaaaacaaaagatttattaacctgtgggttgttgttttaaaaaagtatcaagggggtctacacacttcctaaggggaaaagtaaacatttttttgaacacttcatatactacagttcttgtggggtttttttgtttttttttttttgacatggaggctcgcccagtcacccaggctggagtgcagtagtgcgatctcagctcaccacaacctcccacctcctgggttcaagcggttctcctgcctcagcctcccgagtagctgggactacgggcatgtgccatcatgcccggctaatttttgtatctttagtagagacagggtttcactatatcggccaggctggtctcgaactcccgacctcgtgttccgcctgcttaggcctccgaaagtgctgggattacaggcgtcagccactgcacccggctgcatgccacagtttttcacagacattatctcacgagtagacatgccaaacctagccatctagagctgtgctatccaaaaggtagtcactaaccacatgtagctatttaaatttaaaacatcattaaaattaaatttgaaattcaattcctcagtcacattcaacgcatttcaagtgtttgatacatgaaaacggctactgattgccatattgcacaacaaagagagaacatttccattatcagagaaattctacggcacaacaatgatctaagtctccttcacgaagattttccacaaaaacgtctgaagaattacattgggtccctcgtacaatgaagattaattcgctcacactaaagctgtaactacaatccatatacgtgtgttctcttgtacctgcagccaggttttcaccactgccagtttctacgctatacttggcctactgagagctccagtcttttacaaacacttactacatcctaacctctcttgaatgtctggcaaaggtttggatcaaaaaagacatcacatttttgcacatatgacataatacttgtagttgcctggaaatttattggcccatatgaagtgggatccccggggcagtgacaaaactaagtttatgctactgaggttttgcttgcccaggaaatataaaaaacttgtgactgtgaagtcactaaataaactaatggttttaataatgagggcaaaaaattattttaataggtataatgtcattatcaaaccacagaaaatgctatacctgaaatagagttcaattttggttagatttcctttaaagtctcacaggactcatgtggtacggggcctctgtgacaataggtaacttttcataaatgcttaagcacatctggactctactccagtgacctacaaggtaatacatcattctgtcagtttcagaggtacattcacatcctattctccaaaaccagaaatcgcccagggattcctagaccatatgacatgttgctgaaggaatatacaaatatatacacacaaatgtgcgtgcacgcgcgcacacacacacacacacacgcactgaaagaatattataaccattcacctttcttctaaattttaccttctgtgttaactttccctgtgttgacaaagaatgcctctcactaagtcatgaccctgcaggtcactgtaatacaacatcgcatacctggattattataatgggtgaagggttcttacatatagctcaaccggaggttaggaagccctacgaacactcagatttttgcttcatttttaaccaaaaggggtcagagcctttgtcaataccagctgttgcagtggttggctgcctgtgataataggctgcctttcacctgaaagaatgaaggggtgtttctcagagtaatatcttacgatacagaggatgatactgtctttaaagctagtgaaaatcaattttactgtcacttctttatttaaaaaaaaacctccctttgcagaaatatcactgagatgtcatgtttaaattttttttctacttcacattatttataagccaatattttaaagatttttggcagttctttaggcctgggcaggggtgatatttgcccagaatacatctgatatggtctcctggttgtttctaaatttcctgttttgactgatcaatgcttgtacagtgcttgttattaactactagacaataactcctgggtacagacactgctccttgtcttttttcctttgtgtaattcagatagtaaatgtccagcaaaaagcaagattccaaggggtaaattcaattgctgacgtatttgcatttctaattctaatccaagttaaataaatgaaaaatccactgtaaaagagaagcacaaaaggcaaaatcttcacaatcattacccagggaatcactgctttgtataaaatcattaaaaattatcttgaaaaataataaaagcaagttgactgagacaattatacaattctaagaaatgtttttagaaatgttcttctaagtattgttctttttaaattttatttttggcaattctcaactgtaactacaatacaacattctttccccaatgaaaaacaaattttaaactatttatttaacacttttggccaccaacatttacagaaatagttgcttagtatagcagctcaagcagcttaaaaaatttaaaagttaaaactttcatagggcctagaagcaaagaaaactcattagcaataaacataaatagtgcccaatcttgttttctaaaactattctccaatttctaaattctccaatttctaaaactattctccaataaaagaaaacagggcacattgaagaaatggctgcttctaggatatgagcaggaaacataaaaaataagcctgaagcatcttgtagtgccagaaagtgaggaggtgctaaagaaaaaaaaaaacaactctgcaatgatgaggatatgtcaaacggacacagaaatcaactgaaaaagttccctgcggccaaaagttagaatattttgggcaagaacataaagtagtattggattataactagagatataaaataaattgtgtacgaatacatactgatataaataaaagacaaatctcctgttcagaggaattccaaataatttacatattaaatactcctccttcaaggaggtggaacgtggctcccctctccttaggtctgggtggtgcctagtgacgtccctgtgacgaggacagtgtggaagggaaaaggaggagctctgcagtggcgaaggctgacaaacgcgacctcagctaggtgatcaaggtcaaaatcaacaagtcaagtcaatagagcatattccaggtaggatgtaatgaaaacggcactttatctctgtggtcttcctccccaaaatccgtaactccactctaatcatgaaaaaaaattcagacaggtattaccttctttccacgtaaggtacgttctacaaaatacctgaccaataatattcctccaaactgtcaaggatcatcaaaaacaaagaaagtatgaaaaactgtaccaagagaagcctaaagcaacacaaggaccaaaaataacgtggtatcctgtgtggcatactggtacagacactgggtaaaatccaagggaatctgaataaagtatggactttagttagtaccagtatatcaatattggttcattaattgtaataatgcaccatactaatataaggtgtcaatagggaaaactgggtacagaatatataggggaacactctgtactattcacaattttgctgtatatctacactttctaaaatttaaagtctatttaaaaaatttaaacagtctttccaatactaaatcatactgcatacaattaaaaatatttatttgtttgccattgtaattgtggttaagagtgtgggctaggataaaactgctggatctgaatcccgttcccctgtctaagttgatttttactattaatagttatgtgcttgacctgtacacagtatatagctaacacgggcccattctgacatcagttatgttcagcagtctttgctttcccagtaagagaaaagaagacaaataaggcccaatcagcccaaagcttctcatcacagggtagccatatttagtaaagaaccaggcaacatttgctgagtatcacagggactaaacctggggcaaactggacccccattcacagtcaaggcaggttctctttcccaagaacagatgtaaccagcaatgtgaataatgcctctgggcaaagtgcaggactgattttaagagctgtcagcaatttcacatgatatgaactctgtttatttctaatattcaaatgagctcaactaatgaaatactattttattttcataagcaaaaagagcagtaaaatgaatttgataaaaaatatctgaagacacattcaataagaatgaccggggtacatagtatgttattcatcttttttaaagtctacatgttaaaagatttacaaccaatgaatgcttcttaaatgaatattcatacagcaattgcagtggcttttttactgcctaagagagtcattaaaggcttgtcatcctggcccagcaatgcctctggtgcttctaaatcattagatcttagtctactgctttgaatgttgtaattgcaacataaaaatgagaaataaattaccagtatgaacaatcaaaggtcacgattttcagcaaaagcttagaattttatagtggcacctactttttaatataaacgattaagggtatttttcttgaccagactgagtaaataaacagatgcaattaatgaaacaaatgaaaaggctgagagcaactggctattctttaaacagattataagtaactaatgggcattaaagggttttttaatgtaaatttttgcttataatttcaacttctattttagattcgggggtacatccacaggctcgatacatgggtatgtagtgtggcgctgaggcttggggtagaaatgactccatcacccagggggtgagcctagtacccaatgggtagtttttcagcccttgcccccatcccctcttccccctctagtagtcccagtacctactgttcccatccttatgtccataactgatgtttttagagttagattaactgtcactatacctaatacaaaattcagtctgggattgtgcctcaggctatgctccacgtctgctactactctaagatcacgtgccctctgtgaagtcactgagctgagcacaccccagggacagggaacctgatatttctcttctatgaatgcactcagcacctcacactggatatataaagaataaggaaatcacttaataattcttggattaaacaaatgaatgcatctgcttgtggaattatttccaattcagtgcaccaaacagggaactttggtatacagccaaccaggctattttaagttttgttttgttttgaaaaaagtatttactgtgagggcttagagcagttacagggctctaaacagaaattactggatactccctcccttcaggacaacgtttgacacatttccaatatcttgtcacgtacaaaattcagaagagcacacctgattcgctggcttggtggggtggatgcttaccaggagatcttgattgacaatgacaccaaggctttatccaaggtggaagttaaacaaagtaaacacggagatgctattcctagaagagaacagcatagatgctgagcgagaatgtacacagacagccactgtaacagagaagatggagaacagcgtagatgctgaacaagaatgtacacagacgcccactgtaatagagaagatagagaacagtgtagactctgagcaagaatgtacacagatgtccactgtaatagagaagatagaggagaacagcgtagacgctgaggtagaatgtacacagacgcccactgtaatagagaagatagaagagaacagtgtagactctgagcaagaatgtacacaaacacccactgtgatagagtagaggagaacagcatagacgctgaggtagaatgtacacagacgtccactgtaatagagaagatagagaacagtgtagacgctgagcaagtatgtacacagatgtccactgtgatagagaagacagaggagaacagtgtagacgctgagcaagaatgtacacagatgcccactgtaatagagtagagaacagtgtagacgctgagcgagaatgtacacagacgcccactgtaatagagaagatagaggagaacagcgtagacgctgagcaagaatgtacacaaacgtccactgtgatacagaggatggagaacagcgcagacgctgagcaagaatgtaaacagacgcccactgtgatagagaagatggagaacagcgtagatgctgagcaagaatgtacacagacgcccactgtaatagagaagatagagaatagtgtagacgctgagaaagaatgtacacagacacccactgtaatagagaagatagaggagaacagcgtagacgctgaggtagaatgtacacagacgtcactataatagagaagatagaggagaacagcgtagacactgagcaagaatgtacacagacgcccactgtaatagagaagatgcacgggatgggaacaactaacaattccccaggaactacagtaggcattttgcttttcatatatatgatttgattctccaaacaaccttttgacgtgggtattatcaaccccatctttctagagccgaaaatgaagttcaccaaatttaagttacttagctaaagtcatgatatcaaacctaggtctttctaacctcttctacctcccaaccaaaaaaaaagtttcttatcaaagcatcatgtgaaacattaaatccatgaagtctcagaaatgcaagtcatctttgaaaacaatgtttcttgacaacgaggatttcttgcccccatattaacaaggttttctcacaacatattcagcaaatctttttcattcaatcaaaatatgttatttgcttttatataaacctaagtttccatggctattgacagaaaatggtgataccaacgtgacaagtacaattcttacagacaaattaataatctgctcatccctacaagctcaagattcccctctaagtaagtctatcagtccttatatatggtagcagtaataagagataccagatgagaatatggacacatccacaaaaattgctaatccctaatggcagtcaaccttattaatagggggttaaagcaggagcattttttaaaccagcgcaagcccagcacttttctaccatgcagaaaatgggtgttcatctctctggatcagcttaagcacacgcatgctattttgtttattatttgggtcactatatctgtaacctaagcagatggtaatatgcattttatatgaaatatttaattaggccatcaaaaacatggcagtaccagctgtcacggcctgctgaccttgggaaaggaggaagtatcagcaaaatgaggatgacaatgttcagatgaaacccagaaatgaagtgtttatgaaaatctcagttgctctaacttaccacacttcaaaccaagaaatgtcacggaagcataatgatccggttcacatcaatcacctacaggtccactgggtttattaaaaactattttcaggccaggcgcggtggctcacgccagtaatcccaacactttgggaggccgaggcaagtggatcacttgaagtcaggagtttgagaccagcctgggcaacttggagaaaccctgtctctactaaaagtataaaaattagctgggcgtggtggctcatgcctataatcccagctactcaggaggctgaggcaggagaatcgcttgcacccgggaggtggaggttgcagtgagctgagatcatgccattgcactccagcctgggcaacagagactctgtctcaatttaaaaaaaaaaaacaaaaaaaagccatttttaaatgatttatactgatacatacatagaaaaactggaaatatgtactgcaaaataataattattatttctagatggtgagctaatgggtgatttttatttaatacttttacttaacgatattttctataatgtacttttatgatttgaaatatttttaatttaaaaaaacagtgacatatacatatcagtccttttatttagtactgtagttcctgaaacactgccttaaaaatccatttttctcataaataaatttgaacacatttgatcctttctcatttctacatgaccacctttacatttttcatatctgaccgccctatcattggcctatgaagctttccaatctcttagcccaagttctttttccaaccaagtcagaggactcctgctactgcaaaccccaggctgggccttgactctgcctgcaagaattcagctggaaccgagtcaactccttccccctttcctcagaggcttttccagagacttctccctttcctcagttccccaacccatcaccatctccctcaaatcatcgaaatgtgacgtattaaatccacgcacagtctcagaaatgcaattcctccttgaaaacaacagttcttgacaacaaggacttcctggtatcacgctagctaacaaaatatactccaaatccttttccattcaatacattatgatacctgcttatgcataagcctaaagcctccatggctagtgagagaatatggtgataccacagtaacaaatccaacccaatcactcctccacctcttcgcccagaaaataaagtctggaggctgggtgaggtggctcacgctttaatcccagcactttgggaggccaagatagtggatcacttgaggtcaggagttcgagaccagcctggccaatatgggaaaacccgtctctactaaaaatacaaaatttagctggtcgtggtggtgggcgcctataatcccagctactcaggaggctgagacaggagaatcacttcaacctgggagggtgaggttgcactgagctgagatcgcaccactgcactccagagcaagactccgtctcaaaaaataaaagaaaagaaaaagaaaaagaaaataaaggctggagacttaagaactttctccagtttccttccctggtccacagcaaatccctctgaccccagggctttgtttccctctcactggtccttcagtgaaattaattcaataaatatccacagagctttaatccagatgtgtgcaagatattggggatttgttcagccaccatcagacacaatctctgctccatcaattctctcccgcttctggacgccagcacctccccatggttgttcgctagagctgccataacagaatactacagactggtggctgaaacaacagcaactgattctcacagttctggagtctggaagttcaagatgaaagtatctataggtttggtttcctccgagccctctctggctggaggagccactgtcttgctgcctcctgacacggcagtccctctgcgcacatgtgctgttggtgtctcttcctcttcctacaaggacaccagtcatactggactagggtcaaccctaaaggcctcatgttaaatcacctcttcaaagaccttctctccaaatatggtcacattctgaagtaccggtggttagaacatcaacatatgaatttgcggggacacagttcagcccagaacacactctccttctcctgggtttctcacttgctcctggctcttctacctcagtcaataacatcctcaaatctttttcatatttaatgcaccaacaacccactcctagtccagatcttccccctgtcctatctagctgcttcccatcactgccaagatgtgaaaataccctaaactagaagtctcaaactcaaatatagaggagccaggagaatcctaagtggaccggatggagaacaagagagtaccagtgcctgctaaaggtggagatcactatccattgccagctaacttcagtcaggtgtgaaaacagagcccagggtatctactgtgttttgtaagagaacccagaaatatatttatatgtaatttcccaagttttatatgctgataataaaaacagaaactccccccaaaaactgtaagtgggccaaataaaataggtttataatctatttttcccctattttttccctataatctcttaaatttactttccccatttcctgacctgtcactcatcctcacattaatgaaaacaggcttctttgtaccaattccttttcccagaccccacttaaacagctaatgctgaagcccccatatcttacctgccatgcttcccttctcaagtgtgagctccttgaaagcagatcctgtgtctctatatttccagtgctgagcactgtgtccagcatagaatgtgggctcagtaaatgattactaaataaattggcttaactctttctttagaacaacccaatgaaatggaggaatgataaatcaaagaatcttacctttgtcaaagctcaccacttaatttacctatttgcttcactggtttagcaagattctggaccatcatgtcacatatatactcttacatggcacgacagcttaaaatccccacttttccttcaaatggcacaattgagcttccaaagagacaaatgctgatatcattctgtcatttacccaaaaggtccatttatctgcatgcttaacattttagaacacagtcaatcatcagaaggtaagaaaaaaattctatgaattgtcaaaataggtgattaatgttcattcattaatttcactcataagcaaactcttcaggccttgactcagaatctcctggcttttaatttttaaactattctaacataacttcatttgcaggagaaatacatcaggccagaactatcttttacatctgttagcctgagagccagacttaattcctgagataccagtgtgctgctctgcggagggggttcctttgaacccactccgaactacactgaatttagcctcttctcatctgtcacttcacttatgaactgtcaaaattactccagaagggtggagtctatgaagatgacaataaaagaagttttgtacttaaaaggaggcatggaatttagacgtaagaagacagaaacctagggtggtccttacaaggagatacagttcagctatcacaaattagctcaagaaaatacttaggtgtcatctctttctaacaaagttattttcttgaccaggaagcttccagtgttccaatgaagtgctccaaaccctcttttctttcactataaatgtgggcatggtctccctcctggagtcctttcccatgaaatatccagtacagtcatgcgcagtctagccacaactcgccacaggaaaagcacaatatgagggacagtgttcactctcatacatctctgcttttgttcaatccaggcataacaggaattagacaggactagattaaaagttcccagttccggcccagcgtggtggctcacgcctggaatcccagcactttgggaggccaaggcagacagatcgtgaggtcaggagtttgagaccagtctggccaatatggtgaaaccccgtctctactaaaaatacaaaaattagctgggcatggtggcgagcgcctgtagtcccagctactcgggaagctgaggcaggagaatcgcttgaacccaggaggcgaggttgcattgagctgagatcgtgccactgcactccagcctgggtgacagagagagatgccacctcaaaaaacaacaaagacaacaacaacaagagcaaacttcccagttctgctacactcttaaggcaagttactaaacttttctaaatcttcacttcctcatatgtaaagtggggatcacaatattaaagcctataaaagggtgaacaaatactaaattcactggtgtgatgaattacccatcatgctgtcttcaatttccacgtctcagctgaggctttccctgatgctgcatgtgtggcaaggatcgggctttctatagaaaatattgaataaaataatattcctccactgtttttaggacaacttcaattagatgtggaaatactagggaaaaaagagtagtcttaaaatgtattttataaaaatctagatacaacttaagcctaaaataaatttaaaaaaagaaaaacaaattaatccagatgacatataactaaacatcaaaatggggaaggaaggaaggaagggaaacctacattgaaatctattctaccataaaccaacatgaacacttctgaaaagaatgtaagaggagttctgggctatctcttaagtaaaagcaacaggaatcccatgggtaaagaaacttgtaataaagaggtatttagactcaaagaatctcacagaaatataagaaatagagttagggtcatatggaatgttctagtggtaccaaaagccacacaaaaatgacagagaaaaattatgtacagaacttgtatgcttgaaaaaaaagttacagtattattcttctcttgctaccaatgcaaaacaaaaatcaataaccaattctgttttcagatttttatccactgtgctgcataaaggcaatttggggactgtctgaacagaacttctaactcagcatcttctcagacaagtagatttgtcattctaaccaataaataactagtcatactgtggctaagagagcactttatatttaatgctttaataaagctctgaaaaagttgggaaaactttaaaaccttagccactttagagtaatcatattaaattttaatatagttttataaactgtataacagctcagctgatttaacaactgtaaaaagctaaattcacagaaaaataactcgtattaattattgaattcacttttcagaagcactgattcaccgaaagtgatggcagactcagaagcttctgaaggaacacagttgagttccctaaacatttcattagtgggcattaccagggaacacaattctatgccaaacgtataaggcaggttttaggacttcagattacctaaaatgaacataataatgagtagtcacttctataaagatactggatattggatataaaaattaaatatgtgttatttgacacacctattctctatgaataggctgtaccacacataaaacatcagaaaatctgaattcttgtgtgtaggtcattcatatgtttactcctgtcttttaaattcatctttatcaccatcagatcctcattacttattgtctggatgcaggtttctcttttacttacactgcctctccttccacgttttcatcgttatcagtggcccatgttagtaggttaatcttagtttgtgagcctgaagatctcttagcgctccaagatggaactggtacgtgtcatcttatttccatctaaatacagcataaggagtgaaaaaggtcaatggactgggagttactaaataaaggtgatgtggaaaacaaatcataacataggagtataagctaaaggaaagggccattatggtaatatctatcaaggacacttacaaacagtaaaagacaaaaggacatacaaagaaacgtacaacttaactaaaacagaaaagaaaaaagaaaagctctgaagtctacaaaattataacaacgatgggatatgaatcatgttttttcaattctaagtggaaggaagaaaaataaatcacatgtgcctggtaggggagaatttgcttaagaaagttttctcattttagatttgcttttggggtagatggtactttttcactatattcttcaatctcaagttttcacaggaatcacattaataagagacagggactggacaataacctggggagcagtaaatttgggggttattcttttgcattaattggtctagttaaccaagatgtgcaaactgccagagtagaagtaaatctacattctcaaaatttttttaaaaatgaagagtgacaaggaagaatatgcctcattctagcaaagtcatatctgaagagagagctgggaaaataggtgagatttgaaatttgtgtctatatgatgtaagacaattttagaatgatagttattatctcataggctaaatcaaagcacagctgtctctctgcatgcacattttgattctgcaacagaggtcctgcaagagccatcataatgccagcaaattaaataaggagagtttgaaaggcccagtcattgtgaacaagactgaggctatttcattcacttcacgtggtgaagtgcattacgaggagctgatatgactgtaaaatgtatggagacactattaagctgaaaggaatctagacatgtggatagttccctactcactaacacttcatgataatagagttaaatattctgaatagttcacttctaagggattaatacacttccccagtactcaaaatcatgtctgcctttcaacttatttgaaaggttcagtaataactcctcaaatactcactgcttgtcatattctaaatactgaattcttagatgcaaacacgcagctcctattagggctaacggaagctacatgtttgtaccaagggaaaaacatacgtctagaaaactgttctctgctgctcataggcaatcacgttgcatgtcctctcgtggacggtataaaaatgcgtgactatttacgcagaaccattcaggtgttacaggcacttccatagcatccaagaatgcattagccaaaaccaactaaagtagtttttgggctcatgatcattcaagctgaatcaataatattaaacagcatgtggaatgggggaaaaccaagtgtaaagcaacattaaaacctctttccactcaagcataattcattttgatctttactactggattcagctaaaggtcaaataatatatgatgatttagattcagaaaatatattatttcgctgttgagtatagtctgaaatgagggcaactaatttaaaaatggaatcaattttaaaaatataaatgtaataaaaatgtctccatcacagaatatacaaattaagtcccactattgattactgccaacattttaagcctccctactcatattggtaatgtctttagtgcaacttaattttcttcatattgtgtcatacacattcaatgaacatcattccagtgagggaccaagaacgaggtcagaaatggctgtgatgataaattacagaccttaataacttctgaacaatttgaaatgtaaaagccatctataagtcattcagcttgatagatgaatggttaatgaattatacaaactaataaaaaccattaattatttatctgtactacaaaatggcataaggccaagatcttaaacatggtctgcattaagaccaaaactgggattcagggtatatataacaagagggggaaaaaaagagttatctattagaagactgtataagcaaaaatcacttaagctttataagcatagaagattttattaaaggactggtcagattcataactgacagaccactgaaatattatcagcattggggtaaaaaaaaaaaaaggtaactggttgatttagatgtttccttgttcttttgctttttgttttcagtgaaaggcagtttgaaatttccgtcttagtggtttgtactgcagaacactgagatcaagacttgggtacttttgtatacttgcatttcttgctcttgcatgagtcccaagcagtgatggggggctacccctccccactaaggaataatcacattccagtttctggaaagaactcaaattagtctgactctagtgaatcaagagcaagtccaagatggaaacacaggagaggcaacctgggagggaacagactgaacaggtaaaactacagttagtagcctccccgttcatgaattacaactgacaaatgacatcttatctggtaactctgtcaaatcttcactaattcttcgacttcagtatttctcaagaatggctcttctactaccaatatcagaatcacctagagagcctgtttaaaatgcatattcctaagttactttccagacctcaggtaacaggacatattccagaggtctggaaataggtaacagacctcaccaagtgtggggctgagaaagcttttaatgatctgcccaggatattccaatgtgccctaaagtttgagagtcacagtcctaagaggatgctctccattacaccaccctgcagcaatggtgcctaccatcacacgcatagtgcacatgtcagcaacgtaagagatgccaagctcttaagtgtaacagggtgccttgaatattccctaaatatgtgagaacataggcatgactggatggataaatgcatgaaggagaaaactaacagtacttctgatataaaataggaattctgattcctttagaattggctctacagcactttgggaggccgaggtgggtggttcacctgaggtcaggagttcaagaccagcctcaccaacatggcgaaaccccgtctctactaaaaatgcaaaaattagctgggcgtggttgcgggcacctgtaatctcagctactcaggaggctgaggcaggagaatcacttgaacccgggaagcggaggttgcagtgagccgacattgtgccactgcactccagcctgggcaacaagggcgaaactaaaaaaaaaaaaacaaaaacaaaaaaaacagaattggctctacaaatccattcgcagctctccaaaaatccccaaggtgctccaaatttctcacagtctatatatttgaccgtacgatcttaacttctcaggtattgatcagagaaagtcgagaggaaggaggaaatgcagggcttcaattctgatttcgcagaaacatgagtgctgcactgctttcggccccgcatggtgtgctggcagacaccaccactgtcccaggcgcgtctgctgtgaaagccgttgcttagcaacagcaatcaatgctgtatttcctcttcaccattttcctgaagattgagacactgctccaaggtatcattttcaaataccttctgtttcactgaccaaacatgtttgttaatttttctattataggaaaaaaaaatcatgaaccaaattggtctaagaatccaggaaagaggagtgagggaaggtcagtataacaccagtgctttgggatttgtttgatgaagaaaaattctttgacagctcattgactttatttgctataccgtttcattctgccattttagcattgatttctgctacctcatgggatatgaaagtcgttagcatgaattatcattctaaatgcagatccacaaggtactgccataaaacacaaaaagcaaatgattttcagagactggttgaatacacatctcacatctctgttaaagctcttgtcttggtcatgttcttattaaccaataacaacaaaatgttaaaaaaaaataaacatctctccactgataccacaatatataattctttcagatgggcaatgtttctactaaattaattgtacctgtgatgaaagcatatagacaataccaatatttaccttaggaaaaaggcagagaaagtacacaagagggagacaaataaaagggggaagaggtagtaatttttatcaatatgtcctaccaatgaatagattcttcatataaaaccaaaaatgagacttgggaactttacatgacatcttccaataaagaaacttgatacttgcttgaagtatatacgtgcagatatgttagtaagtggtggaatccaacaaggtggatattgtgtgatatttatttttcatgtttattgaatatctactgtgtaaaaattctatgggtagcataaagatgagtaaaatgtaatccctgtacaagattgtggtaaaaaaaaaaaaagtcacataaataaatacagaagaatacatattacctcagataatcactcaagtatttagtaacaacaaatattccacttaaggtggattatatctacaacagacaaaatgagtaaatcggaatcaaaagcttttatttttttaaaacactcaatactggtaaggatgtagcgacataaaaatgcatcatgtgccagaaaagacacagggctggtaaactaaatcaactttttcaaagatagttagcaatatgcaacaaaacttttaaatatgcaaatttaaaatgctgacacagtaattgtatatctagtcaattatttcaaggaaataaagatgccaacaaaagatatttatttctgctacatttaaaataataaatactaaaatgttcaatattagaagaatgattaaatgcataatggtaataattatatgataaatgagtaccattagggtattcaagaatattttatgaaaggaaataattcctataatgttaacaggaaaaacataaaagcagccaatacataaatgcatagataaaatagtggaacaaatgaaaatgctaatgatttttggtgatttttattttcctctctttattttttctatgcgtttctaggttttttgtattgactgtctactgcatatttggtcaccgaaaaatgtcccaacaaataaaatctatcagtctcatttgacttcctattaaccgatctgttttatttcaacttagaacttcaaccctcactggtatcaagtactgccaagttgaatgatagtactcttaagtttcccaagcatttttagaccagcagtttttcatttccataaagatctaataaatttggttaatattttccacagagaatagctgtaatgaaagcataaaatttaagttaatctaaacaacaaatatgtaccaagcacaaggcatacaaatgtagacaggacgttcttgggttatgagaaatggatttcagtaacttgctctcccttcagtgtccttccagaagatatggggccttcaggtacagcatttctctggtgtcagaatatatagtctgtctacaaaaggagctctagtatcatccagggcaggtgatgacactgtctacaactgctaaccctctaccatcagataaactaaagagtgaaggatgcagagaaatgaataaaattaaaagaattctgtcaagggaaattagtattctttcaaccttcctcaatctcatatgatgtcgacacagatacacaggatatcacatgctctttttgtcagttacctgtgactatggatgctgacaaaagcacttttctaaacccaaacaccaagggccagactttccaatgcttacacagcagcatgtatgttaatacctgcattatcaaaggaggaaactgaagatttggaatggtgaagtacattggctagggtccagctcatccgcaagaagacaaaactccagtgagttttgagtcaggttatctcctaagtccgtgtttccaccattatagcacatatgatctttgagaaaatggataggagaaaggcacccattgcaaaggaataacatgagcaaaacagagcagcagaagtcaacagaacattctcaggccctgcacacccaagtttgctagaacaagggcaggggaacactcagctacctggtttgttcacccaacctgccctgtctactgcacttccacgccaggacagtggccctgttcaaaggtcaaaaccagtcccactctgatgctcccctccctggctccattctcacttcagcatgatgatcttctcatggtccctgagaatatcttagcatctgtaatggccatcggccattgagtaaatcccagttttaaacttgcctataaagaacgaacttagtgtgcttttctgctgctttctctcattgaacacagttctttctcttccttcaagaagaacctttctgaagcaccttgaatttcctagtttataatctctgtgaactcctgctatcaagagctctgcagagctagcttccataacctgtcctctttggtgactctctcgtaacaccaaaagctcccttctaacaccaacaggcaaaagatggtcatggtttaatattttaggtactgttccagaattagccagactgtggttcttaatgtttgcatctgtttgtttacagaaatggtggtattgatctaatggaacactggaacttggtctttacaatggcaagttgtggatgataaggttgaaaaagacaagagaggagtctagaaatccagtcagagattagatttcacatcccaggtcacaaaatggtagggagataatacatttgtgaaagctttatttggtaaaagaatgcaagataaccaaagaggagacaaatgtcatagcaatccagctatgagttgtgtactctgtgctggaatggtaaaccaagcatggcaagatatctcaaaggaaaaatgaacagaactgtcaattaactgtatatgaggtaaaacaaaggaaaaaagacaaagagatgagttttgaaaccaatatgttgaagctcatagtatcagctcatttatttaagtgaaatatatgaaggaattgtttaaaataaaaaccaaggaatttttaaaatagcatgccaaagtaagtaaatacataataagtatgcctccaagaagtaaggctaagagagaaaccaatttagatcagtggcctctttcaggaagagagaaggttctgccctatccagcattttctataaggacaagagaaaatattttttcagtcttccaaagacagctaccggaatatttaggaacagtcctaaaaatcaagaaacagaatcttctgaatatggaggaatgatcattaaaacaaagaggaatggagaatagcaaagccattttgcagctaaacttgctgagccccaaaattatccactcatgtttatgttagcagtactataaaacttatatatatgctctattatcaaatacatttttccactttctagtaggtaaaattcatggaaacacttaattttctttatttatgcagatttttacctctctaaaaaatgctgctgctgagctttctatttttgttcattccagttgaaatgcgatgattcatcggtcatcaccacaatggccacacgcatgtggaagagaagctcatgattctaatctgcacagttgctggcggctagatatgcctaaagaggatgtgaaacagcagcttcacttccaatggagatccggacagtaataaaacagtttcgcaatctcttcactaaatacatctttgtttgcatggtctatgtatattgtcatggggcaggtgcaggaaaatataaaatatacatatttaaaatcctactgagctgctgtgaagtcagtgacaaagaaaaacacacacacgctggggcttcatgcatgtagttaaataaataactttgagatcatcaaaaagagtcagcacacccatatttcttacttggcgctcattactgttcaaagacaccatttttttttaatgctgagccatcttaaaactttgtcaggcaacattaaattcttcaagtcttaagccctaaagaaagttaccagtaatgggcagtaacattaagttagctttgcatttaagaaaaaatatttatccatctgccttctcccacagagtactttggatcactctcagtggccatcgttctctgtcctgtcttcatgcagctgggctgagcagcagcatgccacagaaaggggccagcggaactcaactgtccaaagaaatgtccaaactgcttctgttacgtaaagccaatgtcactttccttttttaaaggaagccctggggtgtaatcctgcctgagatgagtccactgacacgacaaaaatctaaaatgtgtaactatttggaggaaagtcagtgtgtatcttccacttgaaaggtataattccttaaaagggacataaaaatattttttctattgtatactctaacagtcaataactcacaaggaaaccgaatagagagcgaaagatggagcactctggactaatgtgaaaaacaaactcaaggccgggcacggtggctcacacttgtaatcccagcactttgggaggccaacaggggcaggtcatgaggtcagcagttcaagaccagcctggccaacatggtgaaaccccgtctctactaaaaatacaaaattagccaagcgtgatggtgcacacctgcaatcccagctactcaggaggctgaggcaggagaatcgcttgaacccgggaggcagaggttgcagtgagccgagatagcgccatggcactcctgcctgggcagtagagtaagactccatttcaaaaaaaaaaaaaaactcataagcagacttcaggaaaatgccaaacaataaaatacatctccatattggacaatatggtgaccccaacaacccagatagacgcactgacaaatatcttctaaatgcatcagtacattgtttgtaccctcatttggggaaaaatatgcaaaaaagatacctaggaacaagtgggaaaatctgatatggattaggtattacagaaaatattagagaattgttactaattgtctaagacgtgctatggcattgttataaaagagaacgtctttgtttttagaatgctaacaattgatgaatctaggtgctaaatttctggttgtattccttcaccttttctgcattattgaaaatataataaaaaatgaagaaaaataaaggcataaaagaagttgtatttaaaaagagaacattaaaataaaattcatgatttaagtgataagaaagaaatatccttagagtattacagtcaagtaaagataccaggccagtaagtaaactctgaagctagctttctcactagaaacatttagctaacctgaggatcctgaactttccccttgacggagacgtgggcacaaagcactggaggctgtgtgtgggcctcatccagactggaaagtctaaaaccaaactcctgaacagacctaggattttccaaggactatatgctgtgagttagaatcactgtaaattacaaaaaatctattccacacaagggagagcaaagaagttctcaatctagaccctaaatactggacagagggggataatttttttctagactcataagcagaagttggcatctaaccaagcttgtagcctaaatttatattatctttgtgggagaagaaacctcaagcccagaaattaacctgagcaggatccaaggttgttaatgccttagttatccatcaaaacaaaaggcaaattcactcagggtgaatacaccttcaatccaggcctcaaagaatttctaaagagtgtgaacttacagcttaaaaaacaaaatcacaagccagggtaacgtagggagaccctgtctctacgaaaaattaactgggcgtggtgatgtgtgcctatggtcccagctacttggaaggctgggatgggaggatcgctcgagcccgggaggcagaggttgcactgagccgagattgtacaactgcactccagcctgggtaatagaccaagaccctgtctcaaaatataaataaactaaaaattctcacaaagaaaacaaagaaacaaagatcagtgaacaagactcagcagaagtattatattgctgaatcaactcacaaagagtttctaatttggtattatcagaatttaaagtaaatatgtttaagatgtttaaaggaataagagattgaaaatatgaggaaggataaagaaaattttttaatgtctagctaggaaaaaaaataccatctagaaatgataaatataattgtaattaaagtgctaatgtaaaaattggcaacagtttttaaatcccacaatgtcaaatgctggtgaagatggttcagtacgaatgaagtcaactttcagaaacaatttgacattatctagtgaagttgcaataagcatactcatggcccaacaattccattacaagttatatatccaagaaaaactcctgtacatgttcaatggaagataaatacatgaatgttcatggcaatgatatgtgtaacagttaaaaacagaaaataaataaactatggtacattcatagaaaacaatacagcgataaaactgaatgagttgcagttacatgaccatcacgaataaatctcagaatactaggtcaaaaaaagaaagtagacaagaatacgtacactctgacatgagtaaagttaaaaacataccaaattataacacataaaaaactgatttcaatacatacaagaaaacctgttaaaaaaaaagccagtgaaaggaacataagattcaagatagtgattatttcgtggggtggagagggagataagagagagaagcagttgtgcagctttaaaagtagtggcaacaggccgggcgcggtggctcacgcctgtaatcccagcactttgggaggccgaggcaggcggatcacgaggtcaggagatcgagaccatcctggctaacacggtgaaaccccgtctctactaaaaatacaaaaaattagccagggggtggcgggcggctgtagtcccagctactctggaggctgaggcaggagaatggcctgaacccaggagacggagcttgcagtaaaccgagatggcgccactgcactccagcctgggtgacagagcgagactccgtctcaaaaaaaaaaaaaagtagtggcaacactgtatttcttaagactggctgactgctatgcaagttgtttgtttactgttatttgtaccttatatttaaggtattttgtgtgtgttcaataaaaattatttaacaaaacaaaaaagcaataatactcacgggtatcttagccaaaagcctgaagctatactagttctgcacacaacaaacatgctttagaaaaagaggaaaccagtaacattcaggaatatcatagcaagacaatcacatgcttctggaaaatacaggatactgtggtaaggaaatgaccaacgttgtcaattctgtcccctttccagggatgtagatctccatttcacagagcaccaatagctttatctgtatgcctgggagttgtcaagcctctcttttatataggttgggcttaatttaactaaaactcctgattttcccctccaactattgatagggacagggggcagagaaattctaggcagaaaatggtggtccccaacaaaaccccaccttcaagcctcaaaccatggcccaaagtagaacttacatccctgtttccctgcttgaatgctgccttttccaaaaccacctgtggccctatcccaccccaccctgtgcctataaaaaccccagatccagccagcagagagaagagaagcagctggacatcaaagactgcagctggatgtcggagagaagcagcttgacttcagagggacagcctgacggggtaactctggagaagaatctggccagagatgaccgcatttcacaggaagattaccttcctgccccatccccttttcagctcaccttgccactgagagccacttccattggcaataaaactccctgcatttatcatccttcaattcattcgtgtgacttcatttctcccagatgccagacaagattctggagccatgagtgtgaagacaaaaaggttgtcacactgaccctttgccctcgttagcagaaggcagctgcctcatgcgaaaaggcagagggcccattgagctgttaacgcataagccgtctgcagagagcagagctaaaaggtcactgtaacactccctctggggctttcgtggtcacaggcactcccagcccccagatgcagctgcaggcaagcacagagttggctcctgccagcaaccaaaaaacactcacccaggctcctgcactcacacacctgcatgcctcctttcatgaggggtggaacgcagcagatccgactgagtggggttcactgctggtgccgtagtggctggctgactccagcgaccatgtactccacctcccaccttgttgactcatgcactccctcctgtgaggagctgagagctgcaggtgagtaaacagaacacccctgttgcaagtcccacgagggtgtcagggaaatatactgcttcattattgctgttcatttgatttcaaatataatgatatctaaacgcaattttttggcatttacgttcctctaagcccagccttaaatttagatgatgaaaatcttaaattgtcccaaatggacactacctccttccacatctgttgactaggatattgatggtagtggccattccagacgacccactgctaccatcacaccagctgcagtgaggaggaatggccgggcctgcacactccacagagcagggagaagaccccacccgccccacccgccatgctctccccaacccaccatgcagctgcagacccaggcacctgcagcctcccaaaccatggctgcagacctgggactcctgctccacgaagcaggtgggagccccacctgcctgggcacagctgcagctgaccaaaccacagctgtggatccagacatccctgcactttggggggcccaggaaggcccctgactgcactcacagtctcagaaatgcctgcttcagctgcctggcttctctctgctatcgatgcccactccgacctgggagcaaagtcagggctgagtccgggcaccatgaacagcagcaggaggcaggcaggttcctgggcggatggggcctggtcaccagtgaggccccattgtcaagccaggaagggcctgaaggctgggggctgggctgccagttccggggcatggagtggaaacttgtggtgccttttccggcccacccatggccacctatggaccaatcagtgcaaacttcctcccctctgaggcctgtaaatgccccaggctcagtcagagctgagcagactgggacaaccagctgcagagaggagctacccactccagggtctcctctctagactgagagctgcagagatggtactaccagctgcagaggggagcaacccactctggggcctcctctctgctgagagaacagacagatgatgggacgaccagctgcagagaggagctaccctctctgcctagagctgcagatgatgggacgacctgcctgcagagaacagtctcttactctagggcctcctctctgccaagagctggagacaacggaacaactagccaaacagagaagctaccctctctgctgagaactgaacactcgttgggatgacctaccagcagaggggagcaagtctctctgctaaggagctgaacgctcattgggacatcctggctacggagaggacctgcccactgtgggttttctctgagttgttctattgctcagtaaagctcctcttcatcctgctcaccctccacattgcatacctcattcttcctggtcacaggacaagaactcaggacccaccgaatggtgaggctaaaagagctactgtaacacaaacagggctaaaacatgccccttgctcgccacgttgtgggcaaagagaaggagaaaggagctgcaacccttcgggtagcccagacctgggagctccctgagccagggctgtgagcccttctttggggccctgtggttcctggcatctccaagtttccgggatgtcaccacattccccggtgccagacgggaaagccgcttgcagtgaacccggtccagccacagcctcacagagagctggtgctcacgccagcacctggagctgcccacaccatagcagcagctggtgtgtctgaccgcacagtgggcggaccccacgtttgctgacacacacccctcaccactccatgcctgactccagactccctttgaagcacgggatccaggctggtagcatgagctgagcgcagcctgccagggcgagtgggtggaacaagcccagcaggtccaagcaaaactcaggcaagggcaccaccagtcacatgtttccggccagaaaagtgacaccccaaagaccccatgacagtatgacttatatcctgttatattgtctcatcacaattcacatagggttgaatctgctattttgactgtttgtgatgttttggctagcatctgaacagatgggcagtttttcttcagtatgactatttgccaacaattggaagggtgtaaaactcattctcagagcaacccaaacataactacaaggagtctaacagataaaatatccactgttgtattcagaaatcctgtataaagtgccagtgaattaaaagaacactttggtaatgtggttaaatgaatgctactaataatcataatagaactggaaatttgtataggtattgtgttcacattcatctgattatcatagctctaagaaatagatattacaggtattattacggactttattatcgacaaggaacaaagcacagagagatccatattacagaaaatggactgaactcagaaataagaacaggatttgagccgatctgtgcctcattagctgtgtaaacttaaacaagtaacttaatttctcacagcctccattgcctcatttgaacacgcaagcacagtgagacctaactcacaaggtcctcctgagaattatataaaatatataaaagttatcagcaagagctcctgtcatagagtagattcttcatgaatatatccttccttaatttatgaaatcctccttgataagaagaagtcaaaacttttatcattactcttttcacaaaggagtcaaaggtgatttcaatttagggaaaaagaaaagtttagacctaaaacattaatataaactgaaggatgcaaagaactcaatgttctacaatcatacttcagtggcctctcattgtctcctgaagaaatatacagaatataatgagtgggtcaccatgcggtttagaaggggcagagttgtcctacagtaataatcacggtacatttgatgctaaatcgtatgtgctctaatattgtaatttcacatctaatacatgaaaatctttccaatgaagttagtttattccctatagcatgaagatagatgaagttaaatagtttatttcctatagcataaagatagcccttgacattcattgtcacacatttcctgtttctgagatcagtaatttgtagattccttcctgaaggttccagcaaagagcttttacccatctgcccaactcctttgattcaagacagggaggggaacagaggtctcctcaggaaagagagtctcctgtacccagggtgaggagaaaagtggtcataaggaagccgtggggccacagatgtatgaccactcacaactgattcagtgagccaagaagacagcagtgttgccagagatggaaggtgttctcagaatgctaacaggacttgctgatgaaggggatggtggtaggggatgacagaaagaattaatcaagagcgatgccttgattttggtcctgagcacctgactgggagtaactactgaactggaaaagatagaggcagcctgagtctcctgtaaaattcagacaccttccaatctccataattctagtttcttgttcctggacctcttgctttagggaggcatatagcactttacaaagtatttgctcattttgtcatcttatgtatatactgaaaatggagtcagtgtcaccagaaaggacacctaatactccttgcttttcttatggacctacgactatactataggtgctgaaggtacctatacctatactattggtattgaagggacacaaagatttgacctaaccttagagtcactttgtaggactactaccccttctctgttttcctccttcttcattaactcttcccttacctgacaagcacagctgactggaattgtgtacactaaatggtcctttacaatacggaatacttcagtaattacaatatgctggaattgctaaattctataatttcatttggatgaacttaatcacatcatagcattcaatttggcttattttcaaaatcagcttcgtttataaactaaaaagaactgaaggattcttttcattttcaagacttctcatctgtaagaggatttagattcttctatttacaagcattcttctgagaatctttcattctacacacaggtttctttgggggttctgttttatcttttttcatacactgcctaccagagagaacaagactggcaaaaggactctgtcctcataaagctcagagacgatgaacagataaacaagtaagtgaacaaaaatacttcagataatgctaaatcctccaaggagaatatgatacagtagatgtaatgggaagctcctttagactgagtggtcagagaggacctttctggggtggggtgtggcatttgaactgtgccctgaagaccgaagcagtacaagcacaggaattagcaactgcaagggctctgtttgataatgaacttggtaggttaaagggacagaaagaaagccagtgtggctgaggtgtggtcaaggggatgtatccaaagtatagcaatacatcagagaggaaacccaggggcagatatattagtactgaaatagcataagggattcacactgtattctaggtgtaatggaagtcgatggaaggttttaagggaaggtgcagggattacctaattcatattttaaaaggtcattgtgggcgccactgagaaagaatatagaggagcaggaaaggaaggaggaggaggaaggacagaaggaagactactatgattgctcaggcaagatatgatgttacgttagactatactggtggcaaagaaagcaggggaaacagactttagacatattttaaagaaaatgttaataggacttgctaatgaattcagtggtgatgggggtaagtgacagaaaaaaaattaagagtaatgactagatttttgtactgagcacttgactgggggtaattattgaggtgggaaaaacagaagcagaaaaaggaaggtggcagagggagccgaggaatcaagagttctgctctggctatgttgagtttgagatgcttttcaaatatccaagtgaggatgaaaccagtagatggctggacatacgaacgggagctcagtatagcaatcaaggctggagatacaattttttttttagtatattggcatcaaagagggtatttaaagtcatagaaataaattagaatcctttaaggagagggtttatttaacgagaaagaaaggagaagaaagctcaggactcagcctttcataattccagtatttaaaggttaaacagagcatcaacagccgtcaaaagatgttgaaaagaaatggctaaacagagggaaaaacaagaagagtgttgagtactaggagccaagataggggtcagttatgtggaagactgctgaaaagtcaaaaaaaaaaaaaaaaaaaaaaaaaaaaaaaaaaaacagaaaagacaccagatttggcaagactaaaggtctttggtaaccttattagaacaactgtaatgaagtgtcagaaaagaaagtcccattagaatgggctgaaaagagaatggaaggtgaggaacaggggagaaggaagagacaataactacatagcagtcttttcagaagttgtgcacaagtgtgtgagagagctagagcacaggagagcgagcccgcaccagcacacacttaacacaggtgacaacagaagttacggaaagacagtgtctctggagcatctgtaatcatctccttctttgttttcctcttcgagtcattctgctgaagttcctgaataaaccatacggatctacaacatacatacatctcagacctagtatctcttttgttcaatctctccatatttttctgccaaatctaatcagaggttttgcggagggattcgtaacaactatattcttcatttttaaaaatgtgtgcaaaatagtagcattcggtaaatattacaagattgcaaggctagatgtatctcaaagaacacaatacaaaagatgtaagatgctcttctaactggaaatggtggaaacttcattatgaatccaatttccaaattatttccaataatgaaggccaatgtatgatctagtcacctttgacaagatcggtttccataatatgtttacttgctttttttcacactgtctcccaatctgttctttgaagtttcttcttgcctaaaataaacttccacacacctgctctataaacccgaactcaaagtgtagcatttttacctccataaatgttttggacactatgctgacagaagaagaagaggaactaaatgacctgtgaaagcccctgttagttgcttcatactgataccgaatttctaaatgtattataaatgcatttcacagcattccattaacatgtcagaggactttcttttccactaagcacactttgcatgagttaaatatcattcttttaaatttacataaagacaagttaaagatgaggccatgtactacagatttatttaatctacatgagacctaagatatattttcatcaatggctgtgctagaataattataaattacagaaaataaaacattcagttagtggtatagtttgcctagaattgattttttgatgctgattatataacccattaactgactaaaacttcttcactcgagtcactgcagcgtctgccaccatttgtgttagtgtttacacataaagatcacacacatttgatgcgtccactttccttcaaatatgggttagagtggaactgggaaacagaaccatttctagtctttttacagctttgttattttgatttttaaatttacatttggaataaagagaaactctgctataagaatctcatactaacctctgaataaagtggagatatgcaagtactccaagaaggcaacagaattaaatatattttctatgaaagatattaaaaccaaaagtgtttaataatcttcattaatgaactttaaagctcaagaagaccttataaatcatctagttcatcttccttggtttcaaaatctactcttgaatttatttagcattatgagattattagatgaggttatttattctccctaattttaatattgataattaatctttaataaatgcttgtgatttttgacatattaaattctaaacctcaacatttcaaacagtcttagatcatgaagaatattaaccaagtccaacgtcccatatactttgtagtaaaatggtagaccctgaggtgaagtggggcaataatttcatgagaacacatcacagtacatggttagatgtactttccactttttcttctactagaaaactaagtttctgttttgggaagtgctggctttgtgttctgcccgtttatgctttaatttcagctcatgcactggggcgccctcaggaggattaaagaagacaactttggccgggtgcggcggctcacgcctgtaatcccagcactttgggaggccaaggcaggtgaatcaagaggtcaagagatcgagaccatcctggctaacatggtgaaaccctgtctctattaaaaatacaaaaaattaaccgggtgtggtggcgggcgcctgaagtcccaactactcaggaggctgaggcaggagaatcacttgaacgtgggaggcggaggttgcagtgagctgagattgcacaactgcactccagcctgggtgacagagtgagactccatctcaaaaaaaaagaagagaagaaagaagaagaaggaagaaggaagaagaagacaactttgagtggtggatgaaactccgtcctaaagattccaggctggagaactgggtccttttagccatcttattaacagtttgaacttgaagagatcacttaacctctccagccactctacctttatgcataaaatgaaaataatattagtttacacataagtattcaaataatttcctaaggtctcaccgatctctaaaaatctgtgataaatattttcataaaatagatttggcatcatatgctatgttatttatatttacctaacaccacatttccttatttttattccttttttttttttttttttttttggagacaaagtctcactccatcacccaaactccaaactacagagtgcagtggcagatctccactgactgcaacctccgcctcccgggttcaggcaattctcctgcctcagtctcccgagtagttgggattacaggcgcatgctaccatgaccggctaatttttgtatttttagtagagatgggttttcaccatgttggccaggctggtctgaaactcctgaccttgagtgatccacctgcctcagcctcccaaagtactgggattgcagacgtgagccactgcgcccggcctcacatttccttatttcaatgtttacttcagaaggccctaaagcagggcaattcaactggcttccatgtttacttatcattaaaagttatcttacaggactcttgggattgtgtcctttttaagacaacacaaagttcatagagtaatggactgtgtggtactcctacccgaggctccaacattttgaggcataagaaaatcaagtatctggttctgatttccactctactttgttgccatttttagcaacagttgatggcacttgacctgatctctttcctggtccattgcctataggtcaagctgacagcagcataaaaccctaaacagccataactttttagtatctattaatagatacattttatggtggctgaagtgacaatctaggttcctttggttaagaagttcaaaatctttattctactgctattcctttctgtataagtttctcagagaaaacaaggtgtttccagcagcaccatcactttatgaaaaaaattaaacctccatcatctaaatataatgttttttctaaaagaagccttcttttttttagtatgtatattatttttagatacttccattgctttaagaagttcccatgatctttgagacaaaaatcaaaacatctttgggatgacaaaactaaaaatgaataaatagataaagtggaatttttgagccaactttttttacattttcatacaaatttcgaagctacaattaacttcatttagaccatgaatagcaacctaatggggctgtaacaatttccacaaataaagctacactatttgtttcacattcactaaggatgactattactctaaatgttcaattagttcttcatttattttaaaattaaattcattataaaaataatgttagaatattatccaataaattttctttgctcaccttcaaaaattctacattaccgttctcttgagaaattctacatttggtttttgttcctcatcttatcatcctgcaataattctttgaaatccatttatcttactaattttaaaaaaaagggattagtgtctatttaaatcaaataattagtaataacctattgaataagtttgtgatagaaggtgttacattgtttcagtctacctgccattgaacaaaataatgccaataatttacttaatcctattgaaatttaaattttgcaactctctttatagaaggataaagtttacaattgccctttatccatcttatagagatgatgcaaagttaaattatgcactaccatagtctgttttcgcagttataatgaaatacctcagactgggtaatttaggataaacagttcacagttctggaggctgggaaggtgctaatatccagcaaaggacctctgactgcgtcatctcgtgacagaaggcaaggggcgagatacagcaagagggggccgaattcaccttttatattgacaccaatcccacccatgagggtggaactctcatagcctcatcacttcttaaagtttccacctgttaatactgatatagtggcaattaaatttcaacacgcattttggagggacaaacattcaaatcatagcacgtgcctttcaagcgttttgaggtattcagaaaatggcaagatactagaagtattttaatgtgttcctaaaacattaaacctaaaacagacttatatctaccttcagctctaaaaatctgggccttcaagatttttccaagtgttaagcaggtggaccccaaaagtgaggcacaaacttcacattatccaaacacatgacaacgtttaatatcacagtatttaaatgctactctaatgaatgtgtgaagattttctaatctggtaattcaccgaacttttaggaaccatgacttttcctaaagccatgacctggttttcttctgaactacatgctattctgtatataatgctccacatgtttacaattgctccaagtgatcaattcattaattctcaaacaaatgacatcaatctttttttcacatgtaaagaaacaaaggcagaaagagaaagaataggccatttccctttaatctgcaatcgctcaccagaaagatttagtttgcataaacacattcaagaaaataagcgaaaataaattttaaaagaagtacataggaaatgacaacgtaaggaaaatgggaaagggaagagagaaccaggagttaggctagaatgctgtcctatcttgtgcattgccaactctggagagatccaataatcagtccaaggtaccacacaggctagacctgaactcctgggctcaagctatcctcctgcctaagcctccaagtaactaggactacagtcgcacacagtcagaactagcttgttggacttatttttgtcaaagaatagtatcataatctttgtgcctctcttgattgagaagaaattctcccagagcagaactgtcctatagaactttctgcaatgatacaatcttttctatcagcaccatttaatatggtagccactggccacacgtggctgttgagcagttgaaatgtgtttagtgcaagagaaagacttaatttttaatttgattttaattacttaagtagtcaaatgtggctactggttaccatatttcatagtgcagttctgatacatatgtacagcaaatcacagcaaatcaatttctctcacagtagtatctctctcagttactcagtttcctaactttgacagaactatttatcatatgatgtatattttcacctgaatacttccatatgagtctctattttattccagagaatttttccgattacagacttagtgtacttttggccagtgagttgtgtgggttattgctaagcatggcattggacgtgctcggatgcttgtcttcattcattcctgaaagcagtcttattctctaaaactatccatcattcttactcttctctctcatcccagctgacatgccactttcaaataggtatattttctctggtttcctgcttttctgatatagctgtggatacatggagagtgtaataaacgggttgtccagaaaggagcttctgtagtcactgggcagtagatatcagcatcagcaatagatctatttaataaaataagtaaatatatatccccactatatggaagagtataatacataaaagcatgtaatataacaaattttatgcaccaataattttttacagtattcagaaaagtttctacatagtaactataaactacatattaaaaattgttttctggtcattgctataatgtacacacacattccaattgacacacagaaaaaagaagttactttctttaaactgcaagggaaatatcaaaataacatcacgaaacatttcataatatcctagagatagtatctcttacatttcaaaactgctttaactcatatggggctccagttcatcagaaacaggacttgatacaaaaaggcatggcatgaatgataattactgctttgggtacaaatctgcacacattacatgcaagatccaatataagtcaacttctcacagcaatcaatttttcaaaaggaagggtacaaccaatgtttattttatgttaaggagaggaaatcaaacaaaaggggaaaaagtgagatgaaaattcttatgctccagttgagtttttccttgggagcactgaacagattttaggaaatttagcctaattttgctatggcaacagttataacacttgagaccacagtccaggagaagcgcagcatttattctcttattgcagcactttgatcctttccgagtctaacttaaaagccatagtttttaatgcaaatgagaatacatacattgagattcgggaataattagaatatttatatttgtaataaatccaatggaagctcttttgtgacatgaagcttactcagtggttagggggttaatgaatgaaatggatcactggactgaaaataaaaatcactatttaaaacgaaggcgacaccaggagaattaggcactacataatactgtaaccacggagaattctcaacagtaaaataaagccctgtagtcccagcattttcattacttttccagtagtgctggatgcagtgtgaatttcaatgaggtgggaaacagtggctgctccctttaaagaacatataccacacagaggaaagaacatataccatataccacagagaggagaagcactccttcaattcacacagtgatgaacatattccacagagaggagaagcactccttcaatccacactgtgatgaacatataccacacagaggagaagcgctcctcaattcacactgtgatgaacatataccacacagaggagaagcactccttcaattcacacagtgatgaacatattccacacagaggagaagcactccttcaatccacactgtgatgaacatataccacacagaggagaagcactccttcaattcacacagtgatgaacatattccacacagaggagaagcactccttcaatccacactgtgatgaatatataccacacagagaagaagcgctccttcaattcacactgtgatgaacatataccacacaggggagaagcgctcctcaattcacactgtgatgaacatataccacacagaggagaagcactcctcaattcacactgtgatgaacatataccacacagaggagaagcactcctcaattcacactgtgatgaacatataccacgcagaggagaagcgctccttcaattcacactgtgatgaacatataccacacaggggagaagcactccttcaattcacactgtgatgaacatataccacacagaggagaagcactccttcaatccacactgtgatgaacatattccacacagaggagaaacgctccttcaattcacactgtgatgaacatataccacacagaggagaagcactccttcaattcacactgtgatgaacatataccacacagaggagaagcactccttcaatccacactgtgatgaatatataccacacagaggagaagcgctcctcaattcacactgtgatgaacatataccacacagaggagaagcgctccccaattcacactgtgatgaacatataccacacagaggagaagcactccccaattcacactgtgatgaacatataccacacagaggagaagcactccttcaatccacactgtgatgaacatataccacacagaggagaagcactcctcaattcacactgtgatgaacatataccacacagaggagaagcactccttcaatccacacagtgatgaacatataccacacagaggagaagcactcctcaattcacactgtgatgaacatataccacacagaggagaagcactcctcaattcacactgtgatgaacatataccacacagaggagaagcactccttcaattcacactgtgatgaacatataccacacagaggagaagcactcctcaattcacactgtgatgaacatataccacgcagaggagaaacgctccttcaattcacactgtgatgaacatataccacacagaggagaagcactccttcaatccacacagtgatgaacatataccacacagaggagaagcactcctcaattcacactgtgatgaacatataccacgcagaggagaaacgctccttcaattcacactgtgatgaacatataccacacagaggagaagcactccttcaattcacactgtgatgaacatataccacacagaggagaagcactccttcaatccacactgtgatgaacatataccacacagaggagaagcactccttcaattcacactgtgatgaacatataccacacagaggagaagcactccttcaatccacactgtgatgaatatataccacacagaggagaagcactcctcaattcacactgtgatgaacatataccacacagaggagaagcgctccttcaattcacactgtgatgaacatataccacacagaggagaagcactcctcaattcacactgtgatgaacatacaccagaggagaagtgctccttccactcacactgtgatgaacatgtaccacatggaggagaagcactccttcagttcatactgtgatgaacatataccacacagaggagaagcacttcttccattcacactgtgatgaacatataccatgcagagaagtactccttccgttaacaccatgatgactatatactgtacagagaagcactccttcagttcacactgtgatgaatatacaccgtatagaggagaagcactccttcaattcacactgtgatgaatatataccgtataggggagaagcactccttcaattcacactgtgatggctattggcctatccatgccactatgtagtttacattttagtatcttaaaatatttcatataatagaatattgcatttaacttgcaagaaaggctaaacacctagcataacaaaccatggtgcactgtaaatgttaatttaaaaataatatatacaaatcagttacagcttagacaagaaacctctttgactacacaatttggaactagaattatatattatatttaaatgtatctctttaaaccaattcaaaagcaacatagagagactaaaacctgtactgaagaaggaaaatcaggtcattacccatgagattgcttcagttcaaaaagagaaagcaggagtaggtgtgaaaatgcacagattactgaaaagtggaatgtggcgttaaatcaaatcttacaacatggaatcacgttttactttgcattaggttcctatgctcctagtatcaaaactaggaggtcctttgagctactaacttagtaaaaactaaaagtcaaacatttcactaatagacctgcctctaagtataaggttgaggcagaagatatacaatcatagaagaaaagacaggagttaataccgctttccccactgtaactggaaagtgtcataaatcctacattagtttctcacctaacctccctatatttagtcattccagtgccccaaaattgaagaattagtctcaatttctactggaatataaataacacatcagcttctagccagataattacgtccttcctgaatatgttgcaaaagtgttattcattgtggagaatgcagaattataaaatacaacccgactctcaaattacttataatctggttaggaatacctaactataaaaataaacacagttgtgggtctcagctgggcaacagtcaggctctgcaggatgtctagatagacaggtaggtagacagacaaaaagacatgtatggtgagccacctccagctcacaggcagtatcagactcacagtagtaccaactcaaaacagaccttcccctccgcagcattccgcatgccccacattatgctagaacctctatttgaatttttcttctagagcaaattcctagcctctcctctaggaaggggagggctggggaaagagcccttggggtcttttcaaggggttcactgaccctacaagctctaagctctctctacagctgtgctgtccaatatggaaatcatgagccactgagtggctactgggcacttgaaatatggctagtgcaactgagaaactgaattttttatttaatttaatgaacttaaacagccacatatggctaatgactacaatactagaaacaagatataaaacatttccatcatcacagaaagcactactctacagagtaaagacttattataattggatatatacattcctgaaaaatgtggtatataaaatattataacttgagggctcataaggcagaacactcaaactctatacagtattataaccaaatccctaaaaagtaagaatcccaacttttaaaactagcgtgatttttaaaagacatttaattcttaataaagaaatattatgataaataagtatacatttaattatttatttatggataaatgaatgaatgaaatgaatgacagggtctcacaatgttgccgaggctggcatgccgtggcgcaataatagctcactgcagcctcaacctcctgggctcaggcaatcctcccgcctcagcctcccagtagctgggattatagacacatcccaccacacctggctaactttttttatttaattaattaatttatttattttttgagatggagtctcactctgtcgcccaggctggagtgcagtggtgcgatctcggctcactgcaagctctgcctcctgggttcacgccattctcctgcctcagcctcctgagcagctgggactacagaggcctgccaccacgcctggttaattttttgtatttttagtagagacagggtttcactgtgttagccaggatggtctcgatctcctgacctcgtgatccacccacctcggcctcccaaagtttttttatttttctgcagaggcggcatctccctatgttgcccaggcttgtctcaaactctggggctaaagtgatctacccacctcagcctcccaaagtgctgggactacaggtgtgagccaccatgcccagccaaccatacatttaaaggttaaagtagcttgaaagaaggctgtaagaaaggtatctaaattctgaaaatgcacaaagactgggaatactatggccaaaccaagcgagagacaagaggtctcgggctcactgtttctccattcctccaccttgctgggctgtgctggcgtttactgcactttgggtttagctgctaccacttgatgaagaaaaccattaatacatcaagaaaaaccacttaataaaccaaagagacgaccacattaactcaatagcatccccccacttgtcaattctatgtgaattaattcttgtcatagaaacatgagtaggcgcagaaaggacttcatttggcagacaggttctctgtgtgtgttccctcatactccccgatataactggtcgcagctccattcccatctcagtctatcaaaaaaactatgcctgctgctcaaggcttttctcaactgataccttccctttattaagcctttcctgaccatcgcctccaaccaagatatgaggaacacagacttttttctcctaaagatatttttactcacacttcacattaaatttaacacatacttatggttgttgttctattactgttattactagaggtagcttaggagggctgctggaaattcaagggggaaagctaaaacttcccagggctttgtaacatctcttcagactggattttagtcctaattctgccaccagcttcctggttaatctcagtaagtcactccctccccgtttctgggctttaaacaaactcatttttcaaaatatctttattattgtaacttttgaatgacattttaaaagtccctgtaaacctctagtatgcacagaactttaaaaagctgaagtgagaatagccttctagactttttgccacatgaatatatacaaacataaaagcattttacactgaattagaccatgccatccgtatcgtactgtgacttagtttactgtattcacttaaaacttgatttcagtacacaaagaaatctcctgcagttgttttacctgctgcattattagaaaaaaatataatttaacaatcccccattgattaaattaccctttaaatgtttaagcttttcttaaaactaggaaagtaatacatgcatttttttaagtattgaaaattttcctttccctaatacactctatcttgggtgataaaattttctaaagagtatcttctgttttttcatttttctcatagataccactggggtttctttctctttttttaagacaaggtctggctctgttgaccaggatgaagtgcagtggcacgatctcggctcactgcagcctcaacctcccgggctcaagcaatcctcacacctcagcctcctgagtagttgttttttgttgatgttcttgagatgggtatcattgtgttacccaggctgcactcgaactcctgagctcaagcaatctgcccgcctgagcttccgaaagtgctgtgattacaggagtgtgccaccacacctggccaggtttcaacgatgcattcctatatttacttcttgacttttgttacagcattattttacactgtcagtgattatttttaattcattaaattctattccataaatagatcccagtcctctgtgctttctcagttgatttttggagacagatagtcaacaggcagcattcacaatattataattatatatctattactcactgtagaactaagtattgtggaacagctccacaggggaggaaatgcaatcttatgccattcaacttctcctgtttgaaacaaaatatcccaagagtcaagcagatttcattttcgtttttttgcttttctttactttacctgcaattctttcttacatctcagattatcttctttcttggattcttctaccatttcattgcagaaactccttacatatattatttcatataagaagcctagataattagataaaaaatagcttatatccatgcatatttgagtatctttctatcactgccttcttacttaacaaatagttttggctacatgagatttttggttcaaagttattttctttgtttggtttttttttttttttttgagggaaattactttttacttcagtgcaatttactggagagacgaactgtgcaagtagagatgcctgatgagcgtcacacaacgttttcggtggatagtcacgacacttgagcccaccacgaaagcaacgggaggcagctgcaatattccagcaggacagtgtgtactacagtgagttttaagcagttatgattttttaaattatactttaagttctaaggtacatgtgcacaacgtgcaggtttgttacatatgtatacatgtgccatgttggtgtgctgcacccattaactcatcatttacattaggtatatgtcctaatgctatccctcccctctacccccaccccatgacaggccctggtgtgtgatgttccccaccctgtgtccaagtgttctcattgttcaattcccacctatgagtgagaacatgtggtgtttgattttctgtccttgcggtagtttgctaagaatgatggtttccagcttcatccatgtccctacaaaggacatgaactcatcattttttatggctgcatagtattccatggcgtatatgtgccacattttcttaatccagtctatggacacttgggttgattccaagtctttgctattgtgaatactgccgcaataaacatacgtgtgcatgtgtctttatagcagcatgatttatactcctttgggtatatacccagtaatgggatggctgggtcaaatagtatttctagttctagatccttgaggaatagtcacactgtcttccacaatggttgaactagtttacagtcccaccaacagtgtaaaagtgttcgtatttctccacatcttctccagcacctgttgtttcctgactttttaatgatcgccattctaactggtgtgagatggtatctcattgtggttttgatttgcatttctctgatggccagtgatgatgagcactttttatgtgtctgttggctgcataaatgtcttcttttgagaagcgtctgttcatatcctttgccaactttttgatgaggttgtttgatttttttttgtaaatttgtttaagttctttatagtttctggatatcagccctttgtcagatgagtagattgtaaaaattttctcccattctgtaggttgcctgttcactctgatagtaggttcttttgctatgcagaagctctttagtttaattcgaacccatttgtctactttggcttttgtttccattgcttttgctgttttagtcatgaagtccttgcccctccctaggtcctgaatggtattgcctaggttttcttctagggtttttgtggttttaggtctaacatttaagtctttaatccatcttgaattaatttttgtataaggtgtaaggaaaggatccagttttagctttctacatgtggctagtcacttttgccagcaacatttattaaatagggaatctttcccccatttcttgtttttgtcaggtgtgtcaaagatcagatggttgtagatgtgtggtattctttctgagggctctgttctgttccattgatctatatctctgttttggtaccaggaccatgctgttttggttactgtagccttgtagtatagtttgaagtcaggtagcatgatgcctccagctttgttcttttggcttaggattgtcttggcaataagggctcttttttggttccatatgaactttaaagtagttttttccaattctgtgaagaaagtcattggtagcttgatggcaatagcattgaatctacaaattaccttgggctgtatggccattttcatgatattgattcttcctatccatgagcatggaatgttcttccacttgtttgtgtcctcttttatttcattgagcagtggtttgtggttcgccttgaacaggtccttcacattccttgtaagttggattcctaggtattttattctctttgaagcaattttgaatgggagatcactcatgatttggctctctgtttgtctgttattggagtataagaatgcttgtgatttttgcacatcgattttgtatcctgagactttgctgaagttgcttatgagcttaaggagattttggactgagacaatggggttttctaaatatacactcatgtcatctgctaacagggacaatttgacttcctcttttcctaactgaataccctttctttctttctcctgcctgattgccctggccagaatttccaacactatgttgaacaggagtggtgagagagggcatccctgtcttgtgccagttttcaaagggaatgcttccagtttttgcccattcagtatgatactggctgtgggtttgtcataaacagttcttattatttagagatacgtcacatcaatgcctagtttattgagaatttttagcatgaagggctgatgaattttgtcgaaggccttttctgcatctattgagataatcatatggcttttgcctttggttctgtttatatgatggattatgtttattgatttgcgtatgttgaaccagccttgcatcccagggatgaagccaacttgatcgtagtggataagctttttgatgtgctgctggattcggtttgccagtattttattgaggatttctgcatcaatattcatcatggatattggtctaaaattatcttttttttgttgtgtctctgccaggctttggtatcaggatgatgatggcctcataaaatgagttagggaggattccctctttttctattgattggaatagtttcagaaggaatggtaacagctcctctttgtacctctggtagaattcagctgtgaatccatctggtcctgaacttttttggttggtaagctattaattattgcctcaatttcagagcctgttattggtctattcagagattcaacttcttcctggtttagtcttgggagagtgtatctgtcgaggaatttatccattttttctagattttctagtttatttgcatagaggtgtttatagtattctctgatggtagtttgcatttctgtggggtcagtggtgataccccctttatcattttttattgcatctatttgattcttctctctattcttcattagtcttgctagcggtctatcaattttgttgatctttccaaaaaaccggctcctggattcattgatttttgaagggttttttttgtgtctctatttccttcagttcttctctgatcttagttatttcttgccttctgctagcttttgaatgtgtttgctcttgcttctctagttcttttaattgtgatgttagggtgtcaattttagatctttcctgctttctcttgtgggcacttaatgctctaaatttccctctacacactgctttaaatgtgtcccagagattctggcatgttgtgtcttcgttctcatcagtttcaaagaacatctttatttctgccttcatttcgttatgtacccagtagtcattcaggaacaggttgttcagtttccatgtagttgagcggttttgagtgagtttcttaatcctgagttctaatttgattgcactatggtctgagagacagtttgttataatttatgttcttttatatttgctgaggagtgctttactgagaccatcgatgctaggaagaaactgcatcaactaatgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtatttaggagacctatctcatgtacagagagacatacataggctcaaaataaagatatggaggaagatctaccaagcaaatggaaaacaaaaaaaaagcaggggttgcaatcctagtctctgataaaacagactttaaagcaacaaagatcaaaagagacaaagaaggccattacataatggtaaagggatcagttcaacaagaagagctaactatcctaaatatatatatgcacccaatacagaagcacccagattaataaagtaagtccttagagacctacaaagagacttagactcccacacaataataatgggagacattaacgccccactgtcaacattagacagatcaatgagacagaaagttaacaaacatatccaggacttgaactcagctctgcaccaagtggacctaatagacatctacagaactctgcaccccaaatcaacagaatatacattcttctcagcaccacatcgcacttattcaaagttatttatctttcagaactttgaaagtactgttccgtgatcttctagaattaaatgctgcatatgagaaatgtgattttagtccagttcctgcatgttttgtcacttattttttccctctaggggaatatgttggtatatatatattttctatggagttctaaaattttactaggaataattgagtttttgacttttttaaatcatgtgattcaacacatagtgagccctttctatctgaagaattataaggcttttttcagctttgtgaataatgtttttatcatttcattgactatttccacccctctatcttaactatcacctgcctctggaaatcctattagaaagacgttggtcttcacagatcttaacccccaagtttctaatttcccaaattatccattaatcagttatactgtacattatatatatgaatattctgggaggtttcctgaactttcctttcaaaaatcagtctttggctaaatctattctatttgttggcccatatatcaaatgttttgttatgaaatcattctaattcttggaaagagttttaactatttcaagattattttgaatcttactttgaaagtttggtgtagaaagaattcttacttgatggactaagaacacaagagattgagagttaagattagaaagaaataacattctacacgttttgtaaaaggtggggattttttccttatttttaaaaaatgaataaaagccaaccaatctttgttgggcatggtggcaaatgtctatagtcccagctacttgggagacatatatgtgtatatacatatatatacacgtatatatgtacatatatgtgtatatatatattttaacatgggactcatatatatatatgagttaaaaaaacattttatttcattaatatctcttgtacatgggaaactgtcacaaagcagtttcttctctttttactatactctaaacatagactatatataaaagaggttagctatagttcctgagtcagctactcatcactcatttcccacacctaaaagaggccaaggacacttaaatgtaaattcattgtacttttcacctttttgagtgaccccattttataggtatcttggggctagctatttgcacatcagacttttccattctgaaatgctgactcaattcactagagagaaggattctacttgtgagtgtggaaaaaaaaaatcctgactttctagatcattttccctattcactttggataataccactttataaataggatttgatgcatgcaaagcagcaatctgaaaggaccggcagtatatactataagcacttattatagtatttgtaaatgccttattaatggcaaaatagctttgaaaccatccatgatatgtaccacagctaactcaatttgacagtgaaagatgctatgtcagtctgttatggcagatataaaacatgtaccatatgagtagatccttggcatatgttataaaaattacttttgctttatattttctagttgtgtaaaaagggacaagaagcactcctaacactgttttcattggactcttccacactgccttctgttgcctactataaacagttaaatatatcttcttttactatctggctacagcagttttctgtatataaaaatttttccactctactatgaattgggtttatatggactccatctaaacattattcatgaactattctgaatacataccaaatgataccccagtgatcttcaaaacgctgaagtttcaattttctttaattctgctatcaggccaggcaaagcattcatctcagtgaggcagcctgcctcttaggcatcattaatgttttagattttcataaattccactacggctaaatagaccaagaacctgaactccatagagttcctaaaagaattcagcagctactgcctttttttttttttttttttttagttttatttccaagatgaagtttaaaaataagaataaaaactggcaacaggccagacatggtggctgaggcgagcggatcacttgagcccaggagttgcagaccagcctggacaacatggcaagaccctgtctctagtaaaaacacaaacattagctaagtgtggtggcacatgcctgtaatcccagctattcaggaggctgaggcacgagaatctcttgaacctgggaagcagaggctgcagtcagccaagatcgtgccactgtactctagcctgggtgacagaacgagactctgtctccaaaaacaaacaaacaaaaaacagaaatactgggaataaaagtatttttgaaacatgtagatcctcttttattaagaaagaggcagacatctcacacttaggaaaatctcaacccttaaagagagaaatgaaatagaaattttacaaatcaaaacaaaagtaaaaaaaaatcaaaaataacagatttttatctaagaaattaaaatttcagatttaacgtggaaaatatctgaaaaatgttgtgattatgaataagccttatgacatttctgcatcacttcctgacttatagacctatttctctaaattgatattcattctacaccaatgaaccactaaaggccttgttcatcaagattccagaggtgatttctattcatattttgctatgaatacaccaaactgtatgaaaagttagtttttttccatttctgtaaatataagtttaataaaatacaaccacagataacacaccaggccaatgtctcagtcaattaccaacttagccatgttttcctatccaaaaaattcatttgtttttggtgacagtggtgatgaaatcatttatttacttatttttcatttggttttcatgaaatacttgttccagtttgttccatgtaggttttgagaaagattacagtattttgttgttctaataaactgagacattcagttctatcagacaacgatcttacttttattctagctgccagaaaagtcacagctaaagttgacattcaattatggtggctttctttagttaaaaaaattaataaaacgttcttctcttcccctttactacctaacttttgcctttgttcttacggtatgatccttgatcttactgtatctgtagttttattttaagtaagaagtgaggactctggacattgctctagttgttcaaatgagattctatgtggattgtaaaaatatatttttctactggaaagtaagtctatttgagtagctagggctcctgttgtaatagaaagggtaccaatcccaagtaatatgatttctaaaatgaagtcattatcataagtggagtatattatttcaagtgagtaaaacttttgaagagtgaattgttcatattctgggttatgtatgcatttgttacggtcaaggaagcttgaagcttcaaattcataaataaattacatcaaatgcaataagaataccacctactggacactttataatatgcattaatagtatatttatgactttatttaatttctaaaatggccctatgaagttatttttagaattttcattttacctatgtggaaactgagccacatagaagatgcccaaataacagtatttctgcagaaatcaaaacccaatttgcctgactctaacatttacactatatatattttatacatatatactatatatatatgtaacacatatattacactgtttaatataattacagtctcacatagggatgaattcgattattcagataattaaaatgttttttaaaagaaaataatattcagcatatttcttcgttagttatatgttaaaatacgaagatacacatcaaactactaaatcaactaagactaaatgctcttttgtatataactcccttattagacctgaatgttacagaattgtaaacttaatttggcagctgatctgaatccaggtcgctactctgtagtcagctgtgttgtatgactctgcactgagacccagaggaaccacaatgaaaaattagctgctcagtataacgaattgccagatgctggactcaagtaggtaatgacatttgaaagcatgtgtgcaagtacagaagaaaattctgaggtcccagatctcaaattttatgtgttataagcaaaatgctaaaatctcaagttccatttttaaaaattaattaaataattatttataacgtgtgtctaggcaaccacacattcaacagactaccaggacagattttgcctctagcactgtggtttaagaaagagaaggataactctctctctctctctctctctatatatatatatatatatattttttaacatgggactcatatatatatatatacacacgagttaaaaacattttatttcattaatatctcttgtgcgtgggaaactgtcacaaagcagtttcttctcttttttccgcactctgaacatagactatatataagagaggctagctgcggctcctgagtcagctactcatcactcatttcccacacctaaaagaggcctttttgtttggcaaaatgcttcccaaagtaaatagaaacgacagttaacactttttattttctagctaagagtcacctattgccttcaaaaaaataaattcttctagtagattacagaatttgctttgaaaaattttggtagacttttatccttaaaaaatccaggtagcaagagaacctggataagtactgcctggattagcgagcggttatgagcaaacgctatctgagaagtaagttttcatgagtgatgagaacataccctttcctgcttcgctgtccctcaccatcaaaatccctctcaccaccttgctgaaaccaaccgttgcagagattcattctattgatgtaaggttgggtctcaactgaaatagttaacaggcagagagcatatctcttttgaaactgtatttggagtaaaaggttcggatactgagccactgataaggtgtttggaggaaattgtttcataaaactgaaaagcaaccgtaagaaaataaggttggagccaatatgacaagaactgatgatgtaacgattctgcccagaatgttctgaccatgtcatcaaatcatgccctctaagcaatacaagacacacaagagaagtcttcacaaaacacacgctgggctctcacacactcattttcggattttgaagggatttcacaagatttcaaatctgcccagatcatctcaaaattgttcatttctaaacttgaaatgtctcccaacagagactttttggaaagtaatttgggcaggtcgtttgttcccattatcaattaccggtcagtatgtaagtagctctcttcccatgtcaaagctgcccctggccttcctcttgctcatgctctaattgtgttattagtcaggctccaaagtctgagtgtagctccatctaccacaccctctgggccagttatgcaaaagctctctgactttcctttttttttttttttttttttttgagatggagtctcgctctgtcgcccaggctggagtgcagtggtgcaatcttggctcactgcaagctctgtctcccgggttcacgccattgtcctgcctcagcctcccgagtagctgggaccacaggcgcccgccaccatgcccggctaatttttttttttttttttttttgtatttttactagagatggggtttcatcgtgttagccaggatggtctcaatctcctgacctcgtgacccgcgcgcctcagcctcccaaagtgctgggattacaggcatgagccaccgtgcccagccgctctctgacttcttttacctaattcacagtatttctctgagggtcaaataagatcaagaacaagatgcgaaaactacaaagtgcattttaaaataggtgattactgggatttttttttagtatttgatttttttatagtatgatcattgctttttgtttcttcatttgtttttgagacacagtctcactctgtcacccaggctggagcaaagtggtgcgatctctggctcattgcctcccaggtttaagtgattctcccgcctcagccttccaagtagctgggagtacaggcgcctgccaccacacctggctaatttttgtatttttagtagagacagggtttcaccatgttggccaggctggtcttgaactcctgaccttaagtgatccgcccacctcagcctcccaaagtgctgggattacaggcatgagccaccgtacctggcctgattattgatactccacacaaaacacagaaaatacaacacaaatatggaaactattaaacaattatttcaggttttaattcacaaaaatgcacccagtatggatcctagttttttgttttttttgtatttttttttgtaatttcctaaatgtactgggataaaatatttctgaaaaaataagctctataaaaattttcaattaaggttatatttgatcatcatagtagtacagcccaacaaaacagttttacctaaagtaacatgaaaaatataatttctgtttcacccttaaaaaatgtgtgtttgtatttatgtacttccaaaactttttcttatcaactaataagatcaggtcacgttaagtctattgatctcacctttcactgtaatatctgctttggcaactgttccttagatacaatgttctccaaactcaaaagttatttccccactggataggtgattttgtactgtttatattaaactttatctcttttcttctaagagcagctcccccaggtagtcaagtctgttccatgttagcttactttcaaattaagtcaccttctggcatgacacaattatagagcacattaataactgcaggcacctgcagaataaattcaaacgcattcctttccctccccctctcttgatatatacctgcaaaactgtctaaaaattctataaaatctaaaactcaaaaatggtcttctctatattcctgtgttcctccttactgatactaggttctaatactctgtcttctaaaacctggcaacactatctaatctattctcaccctgtgatgactgtgactgctgaaacctcattttcatagtccaacattcaaatcttcaattgttgcttgacaaactcagttatcatggaatagctacctgaagaaaacagctgaattcagtacactattttcagtgactgcaaaactataatacacaatacagatatttttcacataaactaggtgtaaaaatacaatgttcacacttcatatgagaatattttatttctagaaataaatcttcaccagtccaaacacgtaagtttacagaaagtcagtaagaaatcattatatttatatagcaccttgaccactacaaaagctgctcactgataatatcagaaataatcaataggcttataacactgccaaaatggtagcagagtatcgtgtgtctattgagtctgaaattaaattgcaatttaaggtccatctcttaaagctatattcatgtatttagaactctatcaaacaaaacaagaaaaaaattactttgacgtacatcttttaaagatgaatatgaaactttggacaataaatactactctcccgaatcaacttttaaagtgcaaccatcttttaatgatagttaactgctttaagaaagcaataaactaaaatgtaaacctgaaagcccactatcttaagctcttttaaaaattaaatacaccagcaacattttgagactcaaaattaatttacttcactcaatcctatgcataagtttggcaatttgtttcagatgctattttttctgtaatttttgtgggtacatagtaggtgtatatatttatgggctatataagatgttttgatacaggcatgtaatgtgaaacaagcacatcaacaagaatggggtatccatcccctaaaacatttgtcctttgggctacatgtcatttcctaatgtaaagaaaatggacagacagaaccaacattgatttgactgggtgaaaaagtccatttgagttgggagcaggggttgtgttcctggatttgggttgttaggacagtataaaaaggcttcacaggggaacattcttttctgataaaggaaagcagctgggttggcttcaaatagcagtgactttacttggaatattcacaggtaagctgcaaatataaaacaccttccacagagtgttattttgtaatcggggcttatctcaagtgcaagaacctccagcctacagctttagtaggtgcctcagacactgtgcccggctttagtaggtgcctcggacactgtgcccggctttagtaggtgcctcggacactgtgcccggctttagtaggtgccgcggacactgcgcccggctttagtaggtgccgcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtaggtgccgcggacactgtgcccggctttagtaggtgcctcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtacgtgcctcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgccgcggacactgcgcccggctttagtaggtgcctcggacactgtgcccggctttagtaggtgcctcaaacactgtgcccacgtactctgaatggcgtatacacaatgataataaaagataacacagtgtttgctaagtgccaggtacaactacaggtaccgtaccagatagaaactgttattataaccatttgacagataaaaacactaaagcacacggagatgagtgaatttgcccaaggtcacatagacagtaagcagtatgaagaaacatatgtataactgcactgactctaaaatattataaatttattctgttaaaggtttctgtttaaaaaaaaatccatgtatttattaaaagtagcttttttctcagattcacttatagcaagactttattacatattaacttatcactgggtacaaaccacctggttctaaagacgtctgtcctgattactgtagggactgttatatatgaggcagaggcatcttttcattattattatttcccaaaacctatagaatttgtgtatagcagttatagactatgtctgaaatagttatattcacataacacttaataatcacatttaagtattcactaacagaacaaagcctgttactatggtaaataaatacacacagttctatcacagagcacagaagtcatcaaacagataatattttcttcattacacactgaaacttgtgacccgctaacagcataaaataatgtttaatatttaataccatgtgatggcaatactcaaccaaacatgtatttcaaatgatatgttatttgacatttcaatttcagctcaaaagtacttctaaaaaggatgaaaatatgtgcctgaaactgatagtttgaatttaataaatttttctgggattgttgtgttttgaactttaattttagaaccaagggggtacatgcgcaggtttgttaccagggtatattacatgatgctgaggtttggggtacaaatgagcccatcacccaggtagtgaacacagtttccaccagttaggttttcaacccttgctccctccctccaacctcgagcagtcctcagtttctgctgttgccatctttatgtccatgagtacccaatgtttagctcccacttctaagtgagaacatgcggtattggttttttgttcccgtattaattcacttagaataatgacctccagctgcatccaggttgctgcaaaggacatgattttgttctttcttaaggccacattgtattctgtggtgtatatgtaccacattttcttcatccagtctactgttgctaggcacctaggatgataccacatctctgctattgtgaatagtgcagcaatgattcttccaatccatgagcatggaatgtctttctacttgtttgcgtcatttctgatttctttcagcagtgttttctagttcttgtaaaaatgttttacttccttggttggatgtattcctaggtgttgtaggtgtgtatatctactgcaaatgagactggattcattatttggctctcagcttgaacgttattggtgcatagaaacgctattgatttctgcacacagcgatgaacatgcaactatatgtctttttggtagaattatttgttctcttttggatatgtatccattaatgggactgctggatcgaatggtagttctgctttaagctccttgagaaacctccaatggcgttccacagtggctgaactaggtttatattcccatccacataagtactcccttttctctttttctctgctgcctcaccaaaatctgttgttttttacttcttaataataggcattctattaaaaaaactttgtcagatgtgtagtttgccaacattttctctcattctgtagactgtacactctgttgatagtttcttttgatgtgcagaagttctttggtttaattaggtcccaccagtcaatttttacttttgttgcaactgcttttaaggacttagccataaattatttgccaaagtctatgtccagaatggtgtttcctagcttcttatagtttcagatcttaaacttaaatcttttccccatcttgagttaatttttatataagatgaaaggtaagggtccagttccattcttctgcctatggctggcaagttgccccagcaccatttattgacagggagtcctttcctcattgcttatttttgtctactttatcaaagatcagatggctgtaggtgtatggctttattttggggttctccactctgttccactggtctatgtgtctgtttttgtaccaggaccatgctgttttggttattgtacccttatagtatagtttgaagtcaggtaatgtgatgcctctggctttgggctttttgcttaggattgctttggctacttggactcttttttggttctatgttaattttagcatacttccaattctgtgaaaaatgacactggtagtttcataggaatagtgttgaatctgtagactgctatgggcagaatggccattttagtgatattgattcttccaatccatgagcatggaatgtctttccacttgtttgtgtcatttctgatttctttcagcagtgttttctaatccttgtaaaaatgttttacttccttggttagatgtattcctaggtgttgtgcatgtgtatctctactgcaaatgagactggattcattatttggctctcagtttgaacgttattggtgtataaaaacgttactgatttctgcacacttattttgcatctgaaactttactgaagtcattgatcagtttcaggagccttttggtggagtctttgggactttacaggtatataatcatatcacttgcaaagagaaatagtttcacttcttcttttcctaattggatgccttttctttttttcacttgactgactgctccagctagcacttccaggactatgttgaataggagtggtaagagtgggcttccttgtcttgttccagttctcagggagaatgctcccagtttttgtccattcaggataatgttggctatgggtttgtcatagatggatcttattattttgatggatcttattatttgatggatcttattataataataattattattattattattttccttcaatgcctggtttcttgagggtttttatcatgaggggatttggggttttgtgaaaagctttctctgcatccattggggatgatcatatggtctttatttttaatactgtttatgtggtgaatcacacgttttgatttgcatatattgaatcaactttcatcccaggaatcaagcctacttgatcatggtaataaagtttttgatgtgctgttttatttggtttactagcatgttgttgtagatttttgggtttatactcatgagggatattggcttgtcattttcttttttgttattgtgtcttcaccaggttttggtatggaggtaacactggcttggtatagtttcaaaattggtagcagctcctatttgtacaatacatctggcagaatctggcagcgaatccatttgtctggggcattttttttttttttttctagttggtaggttttaaattactgattcaatgtcagaactcaatactgttctcttcagggtttcaatttcttcctgactcaatcttaagagattgtgtgtgtattagtcagggttctcttagagggacataactaataagatagatagatagatagatagatagatagatagatagatagatagatagatagatagatacacacacacatacatacatacatagatacatagatagatacatagatataaacgggagtttgttaagtattaacttacatgattacaaggtcccacaataggctgcaagctgaggagcaaggagagccagttcaagttccaaaattgaagaatttggagtctgatggtcgagggcaggaagcatccagcatgggagaaagatgtgggctgggaggctaggcctgtctccctttttcatgattttctgcctgttttatattccctgagagctgattagatggtgcccaccagataagggtggatctgccttccccagcccactgactcaaatgttaatctcttttggcaacaccctcacagacacacccaggattaatgctttgtatccttcaatccaatcaagttcacacttagtattaaccatcacagtgtgtttccaggaattcatccatttcctctagattttctagtttgtgtgcatagaggtgttcataatagtctctgaggatcttttgtgtttctgtgggatcggttgtaatgtcacttttgtcacttctaattgtgcttatttgaacttcttttttgttaatctagctaatggtctatcaatcttgtgtatcctttcaaataaccaatttttagttttgttgattatattaatttctgggtctcaatttcattcagctctgctcttattttagttatttctctttttctgctagctttgaaatgtttgttcttgtttttctagttcctttaggtgtagtattaaatcattaaattgggatctttctaacttcctgcggtaggtatttagcactataaaatttcctcttaacactacttttgctgcatcccagaggttttggtacctgtgcctctgttttcatttatttaaattttttttatttctgccttaatttcattgtttacacaaaagtcattcaggagcaagttgtataatttccatgtaactgtggttttgagtcctttaaggtactgatttctatttttattccactgtggtcttagaatatggttgctatgatttagattttttcaaatttattgaaacttgctttatggctgaacatgtggtcaatcctggagtatgttccaggtgcagatgagaagaatgtatgttctgtggttgatgagtgaagtgttctgtagatgcctattaagtccaattggtcaagtgtttactttaagtccagaatttctttgttcgttttctgcctcagtgatctaatagtgacagtggggtgttgaatttccccactattattgtgtggttgtctaagtcttttcctaggtcttgttttatcaatgtggctactccaatattgggtacatatatatttaggacaattaaatcctcttgttgaattgaatcctctatcattatgtaatgcctttctttgtccttttttactgttgttggtttaaagtttgttttatctgatgtaagaatagcaagccctgctcttttttgttattcattactttgagcctgtaggtgttgttacctgtgagatgggtcacttgaagacagcagatgactgggtcttgttgttttatcaaacttgctactctgtgccctttaagtagactgtttagaccatttacaatcaaggttaatattcacatttgaggttttgaccctatcatgaaattgttagctggtggctttgtagtttctattatgcggttgctttatagggtctgtgggctatgtgcttaaggtgcttttgtggcagcagctgtttccatatttagaacttgatatggtttggatctgtgtccccaaaaactctcatgttaaattgtaatctccagtgttggaagtgggactgggtgggagggaggtgtcacaccacccttccctctcctgcttctgccttgtaagacggctgcccctcctttacctactggcatgagtaaaagttccttgaggcctctccaaaagtagatgctgccatgcttcctgtatagcttgcagaaccataagtcaattgaacttttcttataaattacccagtctcaggtatttcttttcttttttcgagacagagtctcactttgtcacccaggctagagtgcagtggtgcgatcttggctcactgcaacctctgcctcctgggttcaagcaattctcctgcctcagcctcccgagtagctgggattacaggtgtgcaccaccacgcctggctaatttttgtatttttagtagagatggggttttaccatgttggtcaggctggtctcaaactcctgacctcgtgatccgcccacctcggcctcccaaagtgctgggattacaggagtgagccaccatgcctggcctcacgtatttctttacagcaatgcaagagcacactaatacagaacacctttaaggaactcttgtgaggctggtctagtggtaacaaattcccttagtgcttgcttgtctggaaaaaaattttatttcttcttcatttatgaagcttcatttgacaggacatgaaactcttggttgcaatttcttttctttaaaaatgctgaaaatagcccccccaactcactttgcttgtaaagtttctgctgataagtctgctgttggcctgatagggctcctgttgtacaaaatctgacctttttctctagctgcctttaagatatttttctttagcaccgaccttgaacagtttggtgactatatgacttagtgatgttcattttgtatagtatctcacaggtgttctcaggatttcttgtaactggatgtctacctctctagcaagcttagggaaattttctttaattcctcaaatttgttttccaggttgcttatttttttccttctctctcagtaatgccaataatttgtagttttggtcactttacataatcccatatttctcaaagactgtttattttattaaattattttttcttcctttttgtctgactgggttaattcaaaagactgatcttcaagttctgaaattctttcttctacttggtccaaaccattaataaaactttgaattgtatttttaaatttcttaagtgagtttttcaattccagaactggttgatttctttttaagatatttatctcttccttcattccctggatagctttagaagcttctttgtgctgattttcagtcttgtcttggatctcattgagcttccttgcaattcatgctttgaattacttatctgtcatatctgagtttccattttggttaggaaccatttctggaaagcttgtgcaatcctttggtggtgttactacattcagatttttaatggtgccagtaatcttgtgctgattctttctcagctgaagatgctagcacttctaatttttgtaattattttcatgtaggtaggatgtttctttctcttttcttcctctataatgttactgggttttttttccttctctttccctttcccctgcttcctatgggtatgactacagattattttgggtaagatctatttgttttgcttctatctttgctctgcctttggttttgtttctaccagttcttctggtaggttttgtatcaggctgtgcagttcaatctacatgccagtagatgatgcttataggtaagagccagttgcagccaatgtagctggatacttgatccttgtttactggcagaagttctctgttgcctcagacaatgggctgatacatagaatgcatagtggtctgagctccctgctcagccccaagggcatggggccagactggtcaggtccacctaaaggtcccctgatacaggcacaagcaccagcactgacagagaatccaatgggtggctaccaagcacccagaggtatgcctaggcatggagctcctcagtatcaagttctctgcacaggaatgggaaacctcttcagcatcaacttctctacacaggaatgggggatgccctaaactccaaatccagaagagctctgcctaggtgtgtagtatagtgggctccccctgaaccaagatctctgcataaaaggggtagggtgactcgaactgctgaaccaggcaagcaggtgttctgaatacctggagatctgtctgggcatggagcagagagagtccccctatatgaggatctctgcacgggaaggatggagcagctcgggctactgacccaagtaagcttgtgctccaaatgcctgcagacctgcctgggcttagagcagagagggtcccactgtcccacaggaagagttgcgtggctcaggctgctgaaccagataagcaggtgctccaaatgcctggagatctgcctaggtgtaaagcagaaagggcctccctacaccaggatcttttttatccaccagacactgtcgcagaggttgtttgccagtgttctgctcaccaggatctgggtgtccctcacgattccagtggattcccattttccttttgttgttgttgttgttgttgttttttgtttgtttgtttcttttttgagacagagtcttgttctatcaccaggctggagtgcaatggcccgaccttggctcactgcaacctctgcctcccaagttcaagcgattctcctgcctcagcctcctgagtagctgggcctacagagctaatttttctatttttagtagagatggggtttcaccatgttggccaggatggtctcgatctcttgacctcgtgatccacccgcctcagcctcccaaagtgctagattaccaggcgtgagccactgcgcccagccccattttccttcttgaaaaaaagctcatacagtttatcttcatgcactatctagccatttccaagtggctgaggcatgctacaagcctcttatctgccatcttagagaaacaatctgcactttataaatggacaggtaaatctttgttgagagagaaaaaataaaggaaacagcttgtagagtgacccaagtacagtcctgaagctgctctcaaggaaagtaagaaaaatagcagcccaaaccctccccttagaaggaaggcttttcccacagagtctcgccttctggctggaagtcatctctttctgggttttgttgttgttgttgttgttgttgttgtttatttgagacggcgtctcactctgtcacccaggctggagtgcagtggcaccatctcagctcactgcaagctccgcctcctgggttcacaccattctccggcctcagcctcccaagtagctgggactacaggcgcccgccaccacgcctggctaattttttgtatttttagtagagctgggtttcaccgtgttagccaggatggtctcgatctcctgacctcaggatccaccctcctcagcctcccaaagtgctgggattacaagcatgagccaccgcacccagctctctttgttttttttttttaatgttaccttatagtcacagcattttatgctttaatgataattcacatttaattttagaaaacttttattttcttaaagatataatcgtttattatatttacatattgaatgttttcaatgacaataaatataggaaggtcatcaacaagacccatagaatttaaacaatcacacataaaataattggtgtagaagtcaaaattttttaaatggttagctcagaaaatacagaaagctcaagacacattactaaaacatgaactgaccttaacaaagaaaaacactgctttgtttctattatacttcaaaaaaaaacagtaataagaatttaaaaaaaaaatcagttctctgttgcatagaaggagaaatataccattttctctttctgtgaggaaaaagaggaaaatcatatttaaaacgaatgacattctgtacagatgggcataaacagcgccctctgtctcatgtacacacatccttttcttgtcactcagctttatttctggcaattcttaaatcggagaaaaaagttacaataaatctgtaagatccatattgtgtatagaagtaagtgaaaaataagctgttcaaattccaatacctactgatctccttctgtggccaaagtttctctgacatcattctgctgcttgtttattcttccatgctctcctattgttacagagggcaactaattttaaaaagtatttgacagtattaagcaataactttgtgccgattttctttttcacagaacagaattaaatttgagtgcagatgtgagtagatatagaagagtgtatgatatttttgtgtgtgtgttttctttgtagagtccaaaagccctgtggattgttagtgaagctcaggcagaataaagcaaatagaagaacaaggcaactgaagtctaacgatatggtggataagaatccgattttaaatcttgacattgcttgagaatgggaataatgtgttacttatttttcgcactatgactaacaattattaaacatctaatatgtaccaaacacagttctggacatattcccatatcttaactcgtttaatcttgacaacaatccttctgaggtaggttttattacccttcatttcagatgaggaaataaactcacagacattactaatttgggtgactcagacagacacagtttccattttgttcttcctttcagttaacatatatttcttatggactttctgcttgttccaggcactatgcttggcacagcgtctaccatttctctttctactaaaccatatagccggtctctgacacctagcacagtacctaggtcatattaggttctcaatgaagattcactgaattatttggttaatttacttgtctctataaaataaacatttacatagaaatttgggtccaggtttatattatcttaaaacatcttgtaattcaacactgttaaaacatgtattttaaaaatagtttttcaaaagagaaaatatttcattgattatagacatctaggaaacccaagtcaggtggcaaatacctgcactgaaaactaacagaatcatggaaaggaagcctgacacagcatgatgcacattctctcaactttgtatgtaaataaatcctacattctttaattgtctcaagaatgcgtgatttgaatacctaattctattacaaatatcacatgggaatggtcttccaatgttggtacatgtactcaaggcacaatgcatagtgttgaccaaaaagcaaaagcttaccatgaaaaaaggtaagtaatggatggattactttgtagtcagacatggataaggttgaatgttagctctgccatttactagctaccttattttgagggaagttatttcacttttctgaggctgtttctgtactataaaatacagataattctaacagcatctactgtgcactcagagattatggtgaggactaaatgacaggatgtatgtgacctgggcacatacccaggtcagagttagggctcattaacagttagctgtatattgaagtagaaaagttagggaggctgggaaataaattttctggtaggcatgaggtggagcagactacataatgatcaccttctttttactgtctaacctttaaagctccttagtatgcaggaaaatgcctgctcctgaatgagctgatcttcataccagcgtatttatctttcctaattcaaaaacagcctccttaaaacacaaacatactttttcatactgtcattcaaaatagctgcttatgatataacttaatagtaaaaatgggaaaattactgatttctttttgtacaattctatgtaccttcaacaaattatgccttttcattttcaaaggataataccaattccttccaaaggcatgatcaaacctaaatagtggttaatttgaacatttcttttaagtcccagaagaagaaattacgttaaccacttcttcatatcttaagtgaaaaatgtgtaagacagtaactgtcttaaataattacatttctgcttattaggtgtaattaatattttatccccaaattaagccaaaataattccttagatataagatgcctacacaaccaacaaatcaagcttttaatttctgagttctagccaaaaggccatattgcctaagaagagcagaaataaatgtttttttttttgttgcctttttaaaaactttgtaacctacatataaatagaaggaaactcagatttcgaatacagacttctgagggaaatcaaatgaatacaaaatttattgtatactaagcagtaactcttgtttattctatcacttgggactgtatattctttttaaattagtatatcaattgttctgaatataataattcaatacagtcatcttcctaagggtccattttaagcatcattcaaagcaagtagtagtaaaaaggaacaaagcataagccacagcagtgctaaaaatatggtaattgattaaaacaaaaacaattagctgggtgcaatggctcatacctataatcccagcattttgggaagccaaggtaggaggatggcttcagcccagaagttcacgaccagcctgggcaagatggtgagaccctgcatcttagaactgatgaaagacggtaacttttctatattttttcaatatgattttattctcacacatcaacaacattctaagatgtcttacaaagaatagcttttgtaatcccatggcctctaatgcaatacagtgctttatacacattctatgggaattgcaggtaccatctccatagcctaagagtatgcaatctgaaccaaatccttttctgtccacatcttgaagtgcttcttaaattcctaagatctaactagttacttctctattacctgttagtggctctgctatagaagaaaaggtgaaagtaaatatctacaaagaaagacagtggggatagtgacaacaataataaccactatttactaagtgctatgttctaaacactttacatggactttgttacttaatgtttgcaattctatgatgcatacagaatcagtcttattacgagatgaacaaatttagtttccaactgataattgtgaagaaataaaaaactacaggagagtgatttttaaatcaaaggtgcatatgaagagaagcatgctaatgaaataatcctgctagcttttcttttttgattttgtaaaatattaattgctcttgcactgttctttattgacaatggatcagactgaagcttctggtcagtgtatctttattatttttcgagacagggtctttctctgttgaccaggctggagtaccagggtgtgagcatagctcactgtaacctcaaacacctgggctcaagtgatcccacctcagcctcccaagtagctaggatgtgggagtatgccaacatacccagctaatttttgtattttttttttttgtaatagacagggtctcactttcttgtccatgcttgtcttgaactcctgacctcaagcaaacctccctccttggcctctcaaagtgctaggattataggcatgagccactatatccagttctgcttcgttttttttgttgttgttgtttgtttgtcttaagaaaaaattctcattttgtgaagtgtgagccaggagaaagagacaagaggctgactccagaaaaactgcagtcttcattcttaaaaagcacatctttcagggatgatagctattgggatattcacatgtcagcagctctcagtataaacaaaacaacaataaaaagtcagaaaatcagcaagaggaataaacatgtcagaaatattgtgggatccagtgaccatcacatgtcttaataatgagctcatcatccagcctgtatgagccttctcctgtgagagcatctttttgaaccaacggatcaacagaaaatactcccgcagtgcttgctttttaaagtaggattatatgaaagtaactgagaattactcccatctccttatattgacaatcttccagttaatgagaagatggattttctcctcaagctattgggtttgagaatcttctgttctgtgttagctaatctctcatgaatgtttttaacactgaaggtccttgtatttgctattacaaaaaagcaggtgcaactgagttccttccttagaattttgagctcgcaatcatttgttcaagatcccactaatctttttagttcttgtttgctgaacacctgattttaaaagggaaccccacaaatcccctttaaccactcttccatttgagtccatccttcatagtcatctactaaacattttgtttacaatgtatcaaaggttatgattcctaggaagtttggctttctttttttgtaaaaaacagggaaagaactctattgggaatgtcatgccctgtccatccatcccatctttttttaatcgggcaactttatattcatcctaccaggaccaactctaatgtccaaactgcgtgacagaattaacagttccttcctctgtattcctaaagtattttgttcacattattattattagagtattaatatattgagtatagaatgttttggtatgccgatagtgaagtcttattcatctttatatgttccaacggtacctggtacagagtagttactcagtaaaagtatgttgaataattttattaacgtgattccaaatccctaagtgataatcttatttaaggaaaatactataacactgaatactctctgaatagtctctgaaacagtaatgagaaatacaaaaatcagctgggcatggtggtgcacacctgtaatcccagctgctagggaggctgaggcaggagaattgcttaactgggacccgggaggtggaggttgcagtgagccgagattgcaccagtgcactccagccgaaagaaagacagaaagaaagagagaaagagagagagagaagagaaagatagagagagaaagaaagtaatgacagagaaaatactttttcgagtaaaacctcagaaaagaatatgatcccaagtaaaaaaaaaagtaaactgcgaaaataatatttttttccttttcttattcattttccacagcttcttaattctcttccattaaatcttattgaggcaattttatttatggatagttatatctagttttataagcctggcaaatatcttgccccaaagttacagaatatgtatctagtactggataatgcaaaattcactttgaaactttttattagaatatttgcttgcctaattaaagatggaatagagcaatattataataaatgtgcatagcctgaatacaaaggagctaagagataacggaatacatacatacttggccaaagaagacagaccacaattataaatatagcctagatatatacaaagcaaatggtcatgcattaacatattaattgaaggtgatgaactgaagttttatcaattaagaaaacactgcaagctatattctgggcccaattttaaaagtagaaaaaaaatggtattattttatggtttatgttatttatgtttattttatgttatttgattattcccagtccataggcacatccttaaaatttcatatgaacactttggggaaacattttaaagttttcatttgaacttactcctcgtcctcaaatgccagcaaactgttcctggtatatagaaaacagatcttatctaagaattcaccgtttacatgtgaaagcctttgcttagaattcctcctcctctcctgtctgcctgttgaaatcctgtcattctttaagggtcagacattgtgcttatatattgtcagaccacatcttctgagtctctcttgcagccccttcctggattacaactctaaggcagagactgcaccttaggtacgggagcatactgttgcatgctcaacaatatttgatgaattgaaagtaggcttttatcaattcataaacaaaatcaattattttaccaattccagctcatttcaacagatttctattcccaaagtctagggtcctttgtctttgttctgtcaatccctaaagaagcaagatcatttctgtcttttcctatgagcctgagagaggacaggcctcacacattcaccattcccaggtgtgcagtagtgtaaaaataattcacactgattccaaggtatcacttatcaattgggaattgtattgtcagaggcgtgtgaaccagaacaactccatcttgaacaggagctgggtaaaatgaagctgaggcctactgggctgcattcccagacaattaacgcattctaagtcacagcatgagatgggaggtcggcacaagataaaggtcataaagaccttgctgataaaacaggttgtaaagaagccggacaaatcagaccaaaagcaagatgtccatgagagtgacctctggtcgtcctcactgctacactcccaccagccccatgacagtttacaaatgccatggcaacatcaggaagttaccctatatgatctaaaaaggggaggcatgaataatccaccccttgtttagcatatcattaggaaataaccggccaggcgcagtggctcacgcctgtaaacccagcactttgggaggccaaggcaggcagatcacaaggtcaggagatccagaccatcctgaccaatatggtgaccccgtctctactaaaatacacaaaaaaaagacattagccgggcatggtggcacacacctgtagtcccagctacccgggaggctgaggcaggggaatagcttgaacctgggaggcggaggttgcagtcagccaagatctcgccactgcacaccagcctgagtgacagaacgagacaccatcaaaaaaagaaagaaaagagaagaggaaagaaaagaaaagaaaagaaagaaatgggcaaccagcagcccctagggctgctctgtctatggagtagccgttcttttattcctttactttcttaataaacttgctttcactgtgcaccatggactcgccctgaattctttctcgcgccagatccaagagccctcccttggggtcctgcaacactatcactgttaataaaatgatccaaacttcatcaccgttaacccaattaaccctaaagtagctgaagagtaaaaagttacaggttcccattactaaattagaatcagtaaagaataataagcacgtaactgaatctaattaataaataaaatctctcccttttccatcccactaaatgccagtaatcccactgtaatcccaccataccatctaaaatgtatgcttcaaggcccagggttaaggcccaactacatgaagcctcccagtttcctttgttttctctgaaactggctgataccaccctttccagatctcacactttagttagtagatcgactaacaacacagcaagagcctgtgttagtaactcaataaatactgaattgaacggcttctaagttatcactttataagaatgaatataatcttcttaacattatgacactgatattatgttctcatttttgacgttaggaaatggagggtcagaagattagctggtggtgatagaaccacgattagaatccttatctgtccaattcatactttcatactcttcccccatattccagtatgaccctggaatttattctgtcaaatattattgttttctttctgtttctttttttttcttttttttttttgtttttgttgttttgttttgttttgttttttgaggcaggctcttgttctgttgcccaggctacagtgcagtggtgcaatcacagctcaccgcaacctcaacctcccgagcccaagcaatcctcccacctcagccgtaagcagccgggactacaggcacatgccatcttgcctggctcattttaaaaaaaatcttttttgtagagaagctgtcttcctacgttgcccaggctggtctcaaactcttggactcaagtgatattcctgcctcagcctcccaaagtgctgggattccgggcgtgtaccaccacacccagcggtcaagtattattcctgagtgactttgtacatgaggtttaccttcccaagaaccatgttggttcctgaagaatgacctccaacaccagagacagagttttcaaattgaaatggtactcaagttggttaatttgaacagattgtctcttttgctaggtcattctcaattaagtcttggttgaataaattaataacattacgacaaacaaggattaacttcagaccctaccctcttaatccctgaaagaactggacattatagccctacccataggaagacagtgatagaattttctttaaaactatatataacatattatatgaattaacataattatttattcttgctaccatgcatttacatcaaaccattcatttctcaaggcatagatgcatccaaaatcctcctagattgaaactgttttcattttttattgcaataaaatatgcataaaaaatttactatcttaaccatagttaagtatacactttagtgttactaaatccattcataatgttgtgcaccatcaccaccatccatctctgtaactcttttcatcttgcagaactgaaactctaaattcattaaacagtaactccagttccctccttctttctagcctctggcaatcaccattctactttctggctctaagattttgactcctctaagtatctcataaaagtggagtcatatagtatttgtctttaatgtggctggcttatttcacttagcataatgtcctcaaggttcaaccatgttgtagcatgtgtcttcatttccctcctttttaatgctgaatgacattttatgatatgtatgtatgtaccacattttgttttcagataaatgacatgagggttgcttctacattttagtcattgtgaatagtgctgctatgaacactggcatacaaacatctctttgagatcctgctttcaattcttttgggtacatacacataaatggaattgctggatcatacagtaattctatttttaaatttttgagttgccgccatactgtttgccacagtggctatacagttttacacgtccacgcagtgcacaaggcttccaatttccccacatcctccccaacacttattttctggggttttttaaatagcagtcatcctaatttgtgtgaagtggtatctcactgtagttttgatttgcatttccgtcatgattagtgatgctaagcatcttttcatgtgcttattggcgtatcttctttggaaaaatgtctacttaagtcctttgcccattttaaaatcatgttgcttttctattgttgagttcttaattatatattttgatattgatccattatcagatataaggtttgcaaatatcttctcccatactctgggttaccttttaactgttgatactgtcttttgatgcaccaaattttttaaattttcataaagaacaatttgtttattttttttctttagctgcctgttcctttggtgtcattcccaagataccactgacaaatccaatgtcatgaagcttctgccctatgttttctaggagttttatagtttggggtcttacatttaggtctttgatccattttgagttgatttttgtatacaaacttagataaaggtccaacttcattcttttgcatatggatacccagttgtcctggcaccatttgttgaattgactgtgctttctccattgaagggtcttggcacccccatcgaaaatcatttgaccatataggtgaggttttacttctggactttcccgttgattccattggtctatatgtctgtctttatgccagtaacacactgttttggtcacagtagcttcttagcaaattttgaaatcagcacattgagtcatccagctatgttatttttcaagataactttagctatttggagtccctcaagattccatataaattttagatttttttttccttttctgcaaaaaaacatcattgcgattttgatagggaacgcattgaatctgtagaggcctttgggtaggtaatgacatcttaacaatattaaatcttccagttcacaaacatgggatatgtttccacttatttatgttgcctttaatttctttcagcaatgtttttctgcttttcattgttaagtttttaacctccttgttaattcctaagtattttattcttttggatggaattgtttttgtaatttccttttcagattgttcactgtttgtttgtgtataaaaatgcaacggatttttgtgtattcacgttgtgccccaatactttgtttaattcagttattagcattgatagttttttgtgggatctttaggattttctatctacaaggtcatatcatctatgaacagagataattttacctcttcctttccaatttgtgtgccttttatttctttttcttgcctaaatggtctagctagaacttcagtagtatgttgaatagaagtggtgaaaagcaggcatccttatctcatcctcaatcttaaaggaaaagcttttggtctttcaccagtaagatgttagctatgggtttttcatatatggcttttactatgttgaagtagtttctttttattccttatgtgttcagtgatttttgtcatgaaagggtattgaattttgtcaaaatgatttttctgcttcgattcagatgatcacgtggggtttttttccccctacaatctgtttatatgatatattacactgattgattttcacattttgaaccattcttgcagtctgggaataaatgccatttggtcatggtgtataatccttttaatatgctgctaaatttggtttgctagtattctgttgaaaatttttacatcagtgttcataagggatactggtttgtagttttcttttctcataatatctttgtctggctttggtaacagggtaatgttggcctcataataaaagcattaggaagtatttcttcctcttcaatactttggaaaagtttgagaaagattagtatcagcttctctataaatgtttggtagaattcacctgtgaagccctccaagtcagcttttctctgttgagagattattgattactgattcaatctcctaactaggtataggtccattcagattttcataatttttgtctttcacagttttttatatttccagaagtttgtccctttcatctagggtattcaatttgttgtcatacaactcttcctaatgccctcctataatcctttttcattctgtatgattcataataatgtccctgttttctttttttttttttttttcttttttttgggggggggacagagtcttgctctgtttcccaggctggagtgcagaggcacaacctcggctcactacagcctccgcctcccgggttcaagtgattctcctgcctcggcctcctgagcagctgggattacaggtgcccgccaccgtgcccagctaatttttgtatttttggtaaagacggggtttcaccatgttggccagactgatctgaaactcctgacctcaagtgacccacccacctcggcctcccaaagtgctgggattacaggcatgagccaccacgcccggcccagtaatgtccccattgtcattttttattttagcaattggaatcttcttttttcttagtccatctatctacaagtttgacaattttgttaatcttttcaagaacgcagcttttggtttcactaatctttttttttttttttttttttttttaaagacagagtgttggtcttgtcgcccaggtgggagtgcagtggcacgatctcggctcactgcaacctctgcctcccaggttcaagcgattctcctgcctcagcctcctgagtagctggaattactggtgcccactatcacaccctgctaatttttgtatttttagtagagacagggtttcaccatgttggccaggctggtctcgaactcctggcctcgtggtccaccggcctccttaagtgctgggattacaggcgtgaaccactgcgcccggccactaatctctcctattgctttcctattctctatttcagttaacactgttctaatctttattatttccttccttctgctagctttgcatttagttcttctttatctagttatttcactttaaagttaggaaactcactaattttggtattaacttctttatcagatattttagaattagacctatcgatcatgtcatactttcctcagattcataactgcatgatataataatcctgtgtattcgagtcaaaagacacagggactctaaagcaagttcttcatgctctgaaagcatattattctttccttttgtctttatgtgtcctagaagtcattagacacaaaacatggagtttcaaggttactgttagagaacatatcgtgagtctaatggttaattacttccatattatctaagttttacaaacctctgatgtattcttcctttggttttattgttccaagcttcacatctgggcttctcacaatgcctgatttttatagaaagaacacagtcatataataaaaaacactgatgtcagcacactgacattcaacccagtgttttatctggggctctgcttcaggccactgttgctgaatgctgtggactccattctccaagtgcacgtatttgttttgtgctttaaaatagctaaattattatatataactacaacatagaacttttaaaaattctgtaactcaggattttcacaattcaggttgagtccctctatccagtccaaattcatccaaattttactgactagccctcaaacctgagaaatagaaatgcctcctaacagacacaggccgtccgaaggtcaatcaaatcccatgggaatatgacaaaaagcacctttctctgacaagagagagccagtaattaaggtctcagccttgttcccctcatctctgcttggatcagaattcagtttttcaaataatgccctataaatgttaagccaaaaacataggcaacactctaccggggtcagtaccaggacaaagaacatcacattttatggaatctatctttacaatcgtatttttatgcaaaaaaactcaatgactactgtagctgggacacctcacagttgttcctgctacattcattttcatccttttgacttttataggcagattttttttgagaatttttaaaaattatatataaagacatttttaggaaatctgagctggtgtcctcctttcattccttagaaccagacaagaaggcaggaacagtgaagacaaaatacaatgcgcaagagcaggggcaggcaactgttttctgtaaagggcagccttcacaggccaaaccatctctaccgaaactactcagctctgctgctgtaacaatagacaagacatgatacatacaagaacggcatggctcattctggcacccaggcttatagtttgcctgctcctggccaacaacaaagatatggagtctgatgcccaagtttgaatactaactctgttttttactagctgtattaacactggcaagttatttaatgtttctagtggagtctgatgcccatgtttgaatactaactccgttttttactagctgtattaacactggcaggttatttaatgtctctagtggagtctgatgcccatgtttgaatactaactctgtttttcactagccgtgttaacactggcaagttatttaatgtttctagtggagtctgatgcccatgtttgaatactaactgttttttcactagccgtattaacactggcaagttatttaatgcctctagtggagtctgatgcccatgtttgaatactaactctgttttttactagctgtattaacactggcaagttatttaatgtctctagtggagtctgatgcccatgtttgaatactaactctgttttttcactagccgtattaacactggcaagttatttaatgcctctagtggagtctgatgcccatgtttgaatactaactctgttttttactagccgtattaacactggcaagttatttaatgtttctagtggagtctgatgcccatgtttgaatactaactctgtttttcactagtcgtattaacactggcaggttatttaatgtctgtagtggagtctgatgcccatgtttgaatactaactctgtttttcactagtcgtattaacactggcaggttatttaatgtctgtagtggagtctgatgcccaagtttgaatactaactctgtttttcactagtcgtattaacactggcaggttatttaatgtctgtagtggagtctgatgcccatgtttgaatactaactctgttttttactaaccgtattaacactggcaagttatttaatgtttctagtggagtctgatgcccatgtttgaatactaactctgttttttcactagccgtattaacactggcaagttatttaatgcctctagtggagtctgatgcccatgtttgaatactaactccattttttcactacccgtattaacactggcaggttatttaatgtttctagtggagtctgatgcccatgtttgaatactaactctgttttttcactagctgtattaacactggcaggttatttaatgtctgtagtggagtctgatgcccatgtttgaatactaactctgttttttactagccgtattaacactggcaagttatttaatgtttctagtggagtctgatgcccatgtttgaacactaactccattttttcactacccgtattaacactggcaggttatttaatgtttctagtggagtctgatgcccacgtttgaatactaactctgtttttcactagccgtattaacactggcaggttatttaatgtctgtagtggagtctgatgcccatgtttgaatactaactctgttttttcactagccgtattaacactggcaagttacttaatgtttctagtggagtctgatgcccatgtttgaatactaactccgttttttcactagccgtattaacactggcaggttatttaatgtttctagtggagtctgatgcccatgtttgaatactaactccgttttttcactagccgtattaacactggcaggttatttaatgtctctaggtctcagtttcccatctgcaaaatgggggtaatgaaagtactaatctcatatgtctaatatggagatgtacatataagccagtatgtgtaaagtgattagcacatggtaaataatatgtttactacattaatatgtgagcaaatatacattaaaaaggtgttattttgtgaacttgtaaatagttgaaataatgcattcagcttaggcaaccttgtttcaaaaaaaaaaagtgcaaggtttcagaaaagaagatgtacaaatgaccaataagcctatatataaaacgctcaacatcatttatcaaggaaatgccaactaaaaccacaatataacgtccttgcacactgttacaatggctaaaattaaaaagagactacatcaaatgctggtgaaggtgcggagcaactgctgactggaatgcatcatcactttggaaaatagtttggctgtatcttattttaacatgtaaaaacaagcaaacaccaccaccaccaccaccaacaacaacaacaaaaatgctcttatatgacccagcaatctcactactggtatttatccaagggaaataaaccacatgtccacccaaagactcatacatgaatattcacagcagctttattcacaatacctaatcaggggagacaacacagatgttcatcagcaggtgaatggataaacaaattgtgttatcccaatacagaccaccgctcagtaataaagaggaacaaactactgacacaaacgacatggatgaacctcagaatcattatgctaagtgaaaagagtcagaccacagtctataacgtacagttccatttcttcaaaattcaaaacagacaaaagtcatctatagatacaaagcagatcagtggttgctgcagccagacgtgtaggaggattgataccaaagggacatatggcaacttttggggtcacggaaagttctgtatcttcattgccatgataatcatcgtatattatattcatggcatacatatttgttaatacccaaagtatatacttaaagtttatttaaataaaaaggtacaaagaaaacagaaatgaggaagggagtacaactgcaaacagccaactttaaaaggtgagtaaggagctcagcacagaccaaaccaacaactgggattttcaatgcctcaggtcggcctggaggcccacaagtgctgtgaatgtgaaacccaggaacaaatctcctgggttactctcatgtatgtcgatgtccctttccgtctcccctctgtttaagaaaaaaaaaaaagctgagaagacaaactttaagttggcccctcccctaagacacctagctacctccttggggtgtgcaggcctttgtacaatcccctcgccttgccccttatgtatgggcatgatctgtgacttgcttctaacagaatatggcaaaggtatatgtcactcctgccaattacatttcataaaactccatcttgccatcagatcttcactagaagctcttcttgctgacttaataaagtacatggtcatgtggggaaagccctacctgagaaggaactgtgggtggtctccaggaactgtgggtagacttcagccaagagccggcaagaagccagggccctgagtcctactgatgcaaggagataaattctttcagtggcccaagcgagctgggaagtggcttcttccccggatttccatacgagaacacagcccagctgacaccttgacgagagctttatgagaccctacatggaggatccaggtgtgtgtggacacctgacccacagaaaccatacgattaaaaaatatatgctgctttaggccacaaagtatgtgataattcattatacaaaataaaaaatataaacagaggagaagatacctaaatggttaaaaagaaaaaacaatacacccaataaagtcggcattttcagaacacaagcgctaggcagagctgcctgactgttgtcaggatcatgcagcaacttctttaacaagtcatgctgccctgtgttccttcctgacaccatgacaggagcaaccactcaagtccagcatcctctaggccctaaagtgctactacatgtgactcacagacttcacaacagttctaagagcactggagaacagtacctactgtcctttaaagccagggccttactcccttctgtggagacacacaccccttggctctaagtggccccagtggacatgacacaacaatcccaaagagccacttaagctacaatgtaagattgttgagaccagccgggcgcggtggctcacacctgtaatcccagcactctgggaggctgaggcgggtggatcacctgaggtcaggagttccagaccagcctggccaacatggcgaaaccccatctctactaaaaacacaaaaattagctgggcatggtggcgcgtgcctgtaatcccagctacttgggaggctgaggcaggagaatcacttgaacccgggaggcggaggttgcaatgagccaagatcatgtcattgcactccagcctggcgacagagtaagactccttctcaaaacaaaaacaaaaacaaaaaaaaagattgttgagaccaatggttatgtgcatggggttctactctacagctaaagaggaagtgggatgcaagacaaaggcagttatttaacctctataacatatttagcaggaagctcaaatatgcagactattgaacagggaagaatagagtagggagagaaaagacgatagtgtagtaccatggggaagaacagtccaagaagtgtgaattgctctgccagggacagccctgcctgtgacgcatcacacaacttctctataaaacaaggctttatgatccttaaggcgtcttccaggtctaagagtctatcattctacattatataaaaatctttagttgaacaattatagtatcttggggggaaagtgtactaaggcatcaagaaaacaattttatctgctaagagtacttactcgtagtaagtaagattagtatgcagaattctgagtttagcacacacgatgttcttaggatttgggagcctagtcttataaatgtgaatgccatacattaggttgcaaagaaaaggccattcatatccacgaagataacaaaggaatatatatagtagcatgaggtgattttatttaaagtttaatgtcctcaagtaatcattccatgctcagtttcttataactgtaacttggaaatattgacatttcatatgcaagctataactaaaactaacttttctttataaccagctaggaaaaaaataggcacaaagtattattttataaagtctaccaagtaacgaacatcaaagaaatgcacatgatatagtcaggctttttctagcacttgtcagtacaagccagttagtggagtaaatcggtttggctgaaagtcctatgctgccatgcgacagaaaagagagctaaactatccacattccatagtttaccttctgtcactaataatctccatcatctacttaaaaatcttagagaagctgggcacagtagctacttgggaggctgaggcaggaggattgcttgagcccaggcgttcgagtccagccagtgcaacacagtgaaatctccatttctctctttaaaagaatgttaaagacatctacctcaatttttggcaatctcctactgtagcttgaaatgttaaagcttacatttagactgtgcatgtcagtttctattatcattccactttacagagaattaaaaaaacactgtgcttgcaacttaaactggtattaaactgacccctgctggcctcatcttttctgtttctgcatttatcagatgcttcaagagctaactgcattctatagttcaacctatatttgatcaggctgccacctcaaaaacaaaacgtgggacaaagatggctagttgtaccaaattccaaatggaaggatgccttcctcagacctttgtctattttatttgcaaaaacctagcaattaaaatcacactaatattccaaagaagtatctcctatagcctatgaatttattctaaaacctaatgcactcaatagacatttacagatttctcaaagactgccgggaaataaagatttttctaatcacagcacctgccctccaggtacttacaggcatttatgagtcattgaaaagatacatctgagaattcaattctagcatatcattggacaccacacaggtgagaaggaagtggggtccccattcagcccgtggtagagcctgcctcactggtgccaggtcacttgagattcgttactgaaatggcccaggacaatgtgttctcttccttctttgtgaactcactgtgctttatgaattataatggctgccattgattggcaacctactatgtgccagagactactacagttaggtgctttccacacactatcacatttaccctactcagtaactctgtgagataggtgattttatgctcaagcttgtatcatgggtgagtaaagctctgtgagaatactgatcatatcataccgcaatgtttttcctttaaagagatgtttctcctctaaacaacagcaaacaccttaagcacaggaaattacgttattgtcatctctgtatcctcagaacctcatatacctcagtaaaggcacatagtaggcactctaaaaacatctgcaaaacatacaaatgaaaatattattgaaagaatgtagctactaaatacatactatgggcataacctatgcttaggcactgagaaaacagtggaggaaaagaaagaagaggcaaaggctttgattcctgagcacagacacccatacgtgactatggaaagaaaaggagaagttccaagacataagtaaacagaatgctatgtcaatacagctcatactaccagtcagctcaaaatcaaacagaaaaaggactcctaaatcagaggacaatgacacactggtgctgggctattggaaatgaaacctattaaagaggaaaaaagagagaggaggtagaatgtcattaaattcctttctgtttttgtaacatatctacaagaccaaatgatgtgaaaaatagttctgcaagacggggactatgtgaatccagttttaaaggtccaaatatgtatactttacttatatagatcatggcatagtaggaaagacagaagatcataaaaacaaatataatgtagaggtctaaaaattgtttcctggtcaggtgcagtggttcatgcccgtaatcctagcactttgggaggccaagccaggaggactgcttgagcccaggagtttgagaccagcctgggcaacatggcaagaccctcatctctacaaaaaaaaaaaaaaaaaaaaaaaaaaaaaaaaaaagcaaaaaaattagctgggggtggtgttgcccacctgtaggcccagctactcaaaaggctgagatggaaggatcgcttgatcccaggaggtcggggctgcagtgagctgtgggccaaggtggcgtcactgtgctgcagcctaggcaacagggcaagaccctgtctcaaaaaaattaataataattttaaaaaataaaattatttgttccaaaaaaaaaaagctgcatgtatttttcttttcttttgcttacctatcattatttttccacatctcttttcttggtacttcagacagatgaagataaatgaagcacagtagttaacttctttgtttggatacaaaaaatcttctgtatcaacaatattgttatgcaagcactttaaatgttgcttctagcagatgagacttctgcttcaacatatgttatggggaaaaatgataaaaatttattcatgactagaataactgaacagtcaacaaaatctaactagaaaatgtaataaatcaacctggtttgttgcagttgttaattatctaaagtaaactgaagatccagtctctcactccaaacaagaataaataatcccagattctcagcactgtcaatactttctatatcatcctaccactgctgcaaacttcttccttcagagtgatcggaatttaacttcctctgcctgcaccttccctgagacaggaaaagccacaaaagaaataaggagctctaaaggttcttctgctcaacaatggcaccttaaaaatctaaaacttactgagggagcatgtaaccccccatagaaaataaaacagtggtcaagcttttgggatctggactcagggtggcttgggttcacaccacagttctacaaatgtaatcttgggcatgtcatctactttcctaagccagagataataacattgccaagagtgtaacagtgagtgatcatatgcacagagcttagcattttacctggaacctatgtgtttcatgagcatgagctattgccattattacatcccctttgctacatccctcccaaagtcctaccatcgactcgcaatctgaacaaagagaaaggacctcaaaatccttactctggctaaactgggctttaaatgtgtcagatgtgtccatcttgctttccttcctcaccacccctgcctgccaataatcagagccatggaaaagcttcccttgctcatgcataaataacgtcctcattcatatatacctgtgtatgtttaattacagtaactagaggtctcaaaataactcatatggttctaatttcaaatatttaaagctcttaatgacacttgcttctgtgagaccagaagaaatataattgccacagcgataacatctaaagcccaagatcatttctcccagaacttatagcactcacagaaatcgaccaggatctgcttgcagtatcttttagaatttctgtctcccactgacacaaccgagtcataaacaaaaactgcagcacttgccagctttcacagcccatgacaactgtgagttacacacaaccttcaggtacaccattcaccctaataactgatttcaaaataacaaaaggaagtcaagcatttaaatgtagcacattaatatttgactaaaatagcatatcaaccagtagaaaaatcaaacaaggtaaattactcatgaaagaagaactacatgaatttctcagaaacgaagtcttgctggagaggtacatgccatgtcacttgcaaccaaaagtacttcctcagagccaatatcaaaagcaccggtgagtatgctgcaaaacggcatagcaggctgtcagatgctgcatatcagctacttgagcagttagattaagctttcccaacaggcaagtgctgcagtacttctgcatctagcatctggtaatgtgttgcaaacgcagaacaaagaaagcagcaggctccgaaatctttcagctttcctttgaccatctgcagcacttaaacacttcagggttaccaggtcagcaacgtgaattctctcaataccatgaaacatgagcaaaatttccattctctgaggtttctaattcttttctttttcttttttttttttttgagacggagtctcactctttcgcccagaccagactgcagtggcttgatctcggctcactgcaagctccgcctcctgggttcacgccattctcctgcctcagcctcctgagtagctgggactacaggcacccgccaccacacccggctaattttttgtatttttagtagagacggggtttcaccatgttagccaagatggtctcgatctcctgacctcgtgatccgcccacctcagcctcccaaagtgctgggattacaggcatgagccaccgcgcccagcctctaattcttttatttttctttactttttctgattgtattgagataatcaaatgatttttctccttaagggagtatggtaaattgtattaataggtttctaatgtgaaaccagccttacattattggaagaaaacacaatctggtcatgttgcttttaaattatttgctggattcaggttgctaatattttatttaggattttaaaaactcatgtttactagtgatattgactagtaactgcctttccttttttttttttatttccataggtttttggggaacaggtggtatttggttacatgagtaagttctttagcggtgatttgcgagattttgatgcacccatcacccgagcaatatacactgaaccgaatttgtggtcttttatccctcacctccctccaccctgtcccccaggtccccaaagtccattgtattattcttatgcctttgcaccctcatagcttagctctcacttatgagtgagaacacacaatgtttggttttccattcctcagttacttcacttagaacaacagtctccagttgcatccaggttgctgcaaatgccattaattcattcctttctatggctgagtaatattccatcatgtatatataccacaatttctttatccactcattgactgatgggcatttgggctggttccatatttttgcaattgtgaactctgctggtacaaacatgcgagtgcaagccacatgcaggagaataactggatcctcacctctcaccttatacaaaaatcaactcaagatggattaaggacttaaatctaagacctgaaactataaaaatgctacaaaaaaaaaaattggaaaaacccttctagacactggcttaggcaaagacttcatgaccaagaacccaaaagcaaatgcaacaaaaacaaagataaatagatgggacttaattaaattaaagagttttggcatggcaaaaggaacagtcagcagagtaaacagacaacccacagaatgggagaaaatcttcacaatctatacatccaacaaaggactaatatccagaatctacaagaaactcaaacaaattagcaagaaaaaaacaatctcaccaaaaagtgggctaaggatacgaatagacaattctcaaaagaagatataaatggccagcaaacatatgaaaaaatgcacaacctcactaatgatcagggaaacaaaaatcaaaatcacaatgcaataccacctttctcccgcaagaatggccataaccaaaaaaatttaaaaaaaatagaagttggcatggatgctgtgaaaagggaacacttctacactgctggtgggaatgtaaaccagtacaaccactatggaaaacagtgtggagattccttaaagaactaaagtagaactaccatccagcaatcccactactcggtatctacccagaggaaaagaagtcattatatgagaaagacacttgaggtttctgattctaaagtaaaacctccatcccacaaaaagcttaataaaggataataacaaaaccttgctttgccagcacttttgtttaaatttttgtttttaagttccaggatacatgcgcaggatgtgcagatttgttacataggtaaacacagcactttttttttaatctgacaaatcacaaatcaccacacagctcccatcaatgcctcttaaaaacaaatattttccactgtcttagggaagtcccaatttctttaaaattcatcatacaaattatttcctcaagttttcactcaatgaaaattcctgagtataacacaagactgacattagttctgtactcaaactctcagaaaattagtgctagttttctacagactccctgaaggtctttttaaaaatttttagaaatttgtatgtagtaatgacttgccaatataaatgtaatacagagacactgtttttgttcatctttgtatatccacctagtatagggcatggcacataccagacactcaatatttattaactaaagagtacgtaggtctgctgcctctcaaatatttgataatcagacttttgaattctaaatttcaagtggagaaattttctccattgaccatcattataaaactgtagtggtatatctttggaaaatatatgacctcaagatataataaaaaaatctttttttttgtttttttttttgagacagtcttgctctatcatccatgttggagtgcagtgacggaatctcggctattgcaacctccgccccctaggttcaagcagttctcatgtctcagcctcccgagtagctgggattacagttgtgcgccaccaggaccggctaattttttgtatttttagtaaagacagggtttcaccatgttggccaggctggtcttgatcccctggcatcaaatgatccacttgcctcggcctcccaaagtgcaaggattataggcgtgagccacagtgcccagcctaaaataacattttaaaaaacaacaatcattttagaatttcatgaatatcaattgatcagaaaacattagtgaaagtccagagttgttttaaacttagaaaatattttctaatatatatagttttcggaataataattaggtcaatgagctaaagatttccttttacagtttcattacaaatttaaaaagcttttgtagtaaaaacccatgaatgtaatcactatttaatagtttatgttttctaaaaatgtgtttggcattccatctgttaagttaggactccagaagaacttaccgctatgtccaaactgggttggagggggacaagctgggtttaaattgcgtttctttcacttgctaggtgaccttgggcaagtcatactaaacctcactttgcctattaccacatctctaagatggacatagaaataccaagttttgggaatactattcttgaagtatagtaattagatttgggggggttttgtgtggttccttacacctgaccctgtctctgttttggccaggggcatccatctgcctacgggatattcaggtttatggaaacaggaatacaaagagaaagactcagtgttcaattatgacacctataaatcaatattttcagtcaacaagcaaaattcttgacagccaagctttgtcaagagaaaatgtgctttctaaattcctaaaacactaatttttaaaatgagggctgaaaacggaatgagaagctcaccttgcttccatgagcacagctgcagggtagaaccacctaggaaggccttggaacgttacacggcctggggcccccacccccagacacttagattggtctgggctcaggaactcaagcattggcaagtttttgaaatgccatcaggtaattctttttttttttttttttttttttttttttgagatggagtttcactctgtcacccaggctggagtacagtggtgcaatctcagctcactgcaacctccacctcccaagttcaagcgattcttctgcctcagcctcctaagtagctggaattacaggtgtgtaccaccacgcctggctaattgttgtattttcagtagagacggggtttcaccatgttggtcaggctggtcttgaactccgccatcaggtaattcaaatgtgcagcctggatttagaaccgtagctccacagagaagcttctggtttggttcaaaactacgatccacacacaacaggagggaaaacccagaagtggcctcctggtcccctacagccccatgcgtatgttatgcagtggatcctgagctttcctgtgacccagtgggggtaatgcagagactaagactccccagagtggagagatggcaagaataaaagctaaggctagtccaggcacaagactagataaaccaaccacctggggcagaagagaatcaggaccagtctgcagtcttgctcccattgccatggaaggacaaggaggggaaaatgcaaagaattgagcatttatctgaaaaaaagacaagctacccaaggactttaaactacaagaaacagaagcaccattaaggggtaagtttgtccaatcatgtacattccttacttaactgcttccccagatgggctgaggtaagaaaatgtagttcaattataaaatatttaaaagcctggccaggcacggtgactcacgcctgtaatcccagcactttgggagactgagttgtgtggatcacctgaaggtcaggaacttgagaccagcttggccaacatggtgaaaccctgtctctactaaaaatacaaaaaattagctgggtgtggtggcgggcacctgtaatcccagctacttgggagggtgaggcaggagaatcgcttgaacccaggaggcggaggttgcagtgagccaagattgcgccactgcactccagcctgggcaacaaaagcaaaacttcgtctcaaaagaaaataataatcttaaaaagcgattgttaattaaaattatccaaaacatgaaaaaagaaaaagattagggagctgtgtggccttctcatattactctagagcactgtttcacagcttcacccaaggattatttaattccctagaagaatgccaatgcatttgactttgttacttgctgttagagcacagatagtgtgaaactacaacgttagcttatagatttctgtccagcagaaaggataactctaaaaactgtggttttagtgcatgcagaacgtcaccagttttgtctccaatctagcaatcttattctaatgcctaaagatcagttccttcagtactctggacctgcattaactctgcctggtttcctcattaataagttaatacatctttggcatttcgttttgtatttctgtgagagtcaggttttaacttttcaaaaaatttactttgatagtatattttctttgcatgactggtagtgtatgtaaatctaccactcactgacactgatctcagtggacattttataagataattcgactgcttggtgcagtgcatggcacttggtaaatgctcagtaaatgttactgttcgtgggtgctagtggctagaggagattttacctgcatctaacagtaaccatgaactcaccaatggaggtccacaaccataatccagggcaaccccgggtaagtggatacacagacttcctcagtagggactattcccatatatcataaatatagggagccactctgctcaaaataattcccaaactatcaacacagacagtacgactcacttgtatatatttatcacgagtgtgtgggcctgtgaggaaaaaactatcataacttagcaaaatcagaaagtacacagatctaaaagaagccatctccttggcgaccaaaagtatgctgctccatacttaaaggaatcttcaaatgatgttcaaatatatgatgacaggagaaacagcaacacagcaaaataactacattagcatatgaagagaggaaattggactggggaagacctgagagttttccagcaaaaactggagaaaagggaactaaaccatctacattccatagttcatcttctgtcactaatagtgattattatccactaaactatctaaacttttggccaatttctactgtcgcttgaaattttaaaagcttctttttggactgttcatttcagttactgttctcatttcactagacaagagaagccctgaaaaccctagtaaagctatcagggaagagatatatggttaatttcttaaattatgaactccttaagtatgacttctctacaaaaagtttcttcatcaatgaagtgcacctgtaaaaaccattccttgtctaaccttgaaattggcctgtaacttcaaggcttaactttcgagtgtgagagtttcagacacatcaacatattttcaaggccataaacactgggtaatttttcatgctcaagtgtctggagtttcgttttcctaatatcaataagcaatatcacaactagcaaggcagaaggaataaaagcacctcagcctctcacaatgaactgaaaaaccctatattctttccttttttttccttcacatcccatttcttttaccttgcccagctggtggaaaaaaatctagcttccttctgaactaaacacacataattaaatacacacaatcttaatttaccacactgatgtcttcatcatcagctaccctagcaccatttcaaagcagcagaaagaaatataataatttataagccagctcctgaggttatatatttattttaaaacatgccagtttcaacaatataaaatgctttcccatgtttaaaaaacaagactatttgttaccttgtgatgggacaattaaacaagcttttaagcgtgataaaaaaaaaaatacataggttaataaagtagtcttgataaaaacaaagcaaagatttgaaaacattggtatttccataacctacagaatactgatgactagatggtcaagacaagcatcagttacaaattatgtatacagcttgctaacaaattagggaaacgttcccctctggtttctttcccgactacttgtaaaataatattcgcatacaaatttgcaattcaaatttgatgtcttatgagtgcattttgcagatcatgctctgagaaggaagagagtgagctaagagttgcatggaaagtataatttgctgctggcttttagccagaaacactagaccaaatgtttatggagaccacgaggcacctaagcaagcccagtgcatctggacttctcaatactagttgttgctatttatttatatgttaacctccaaataaaaggtcaaatagagtaatatctacattacacattcatacattttaaaatatatttattttacttacacagtacaggaaaggaagtgatttgccgtcactttgagaacacttgcaatagcaatgacaagaaaaaccagtaatttaagcaacactaataaccatatgtctggacctatgttcaactgtaatttacacattaagtataagcttttattttcatacttgagaaaacatgccaggtattcagtatttataatcatagttaacttgcagaatgaggaagctaattacagtagaaagaagaaaatattagccttgggaaaatatgaatttgacgatcacacaggtaggtagtaaaggagccatttctacctcccatgaccaatgcaatacaccagcatcttagacttactatccaacacaccagcatcttagacttactatccaatacaccagcatcttagacttactatccaacacaccagcatcttagacttactatccaacacaccagcatcttagacttactatccaacacaccagtaccttagacttactatccaacacaccagtacattagacttactatccaacacaccagcatcttagacttactatccaacacacaagcatcttagacttactatccaacacaccagcatcttagacttactatccaacacaccagcatcttagacttactatccaacacaccagcatcttagacttactatccaacacaccagcatcttagacttactatccaaaacaccagtgccttagacttactatccaacacaccagtaccttagacttactatccaacacaccagcatcttagacttactatccaatacaccagtacattagacttactatccaacacaccagcatcttagacttactatcctacacaccagcatcttagacttactatccaacacaccagtaccttagacttactatccaacacaccagcatcttagacttactatccaatacaccagtaccttagacttactatccaatacaccagtatcttagacttactatcactgtcaagtattaaagcagatatgatcactatatggataaatatattgctaataaaaatccactccaacataccagtcactccagcacagcacaatataaattttgtagggatatgctgcagtaaaccatgtgacacagtaaaaggaatgacacattacaagcttcccttaaacagaagaccatgaacacgtattgccaacctattacttgagagcatttgggggcaaaagagtcatgctgaaattggagtctctgcaaaaggaacacaaagggctgagcaaacaacaggaagcttaggcagggagcatggcagacactgaaaaaacataaggaaagggtcaacatatagccatgttcaagaacataattttagttaatgctaagtattaagactgaaaactgaaacatgggttgggaaaaattgctgatgaaatcaaggaagatcacaaagaatcattccaaaccaccatatttggtgggtaaatgtatctgtactgtaaaaacactgtaccataaaaaacaacaactagatcatgtatgatgctattccatacatggtggtaattatgaggccaatttgcatctcctcaccgagaaaggattgtgaatccccaaactacatcatatcaccccctaaagaatgttatgggtccctgacctagtggatgatctctccctctctccatgaggccccagcactgacagatatcttctgaactatatttggtcatgtagtctgaacaacaaatcattcgcttgctacctcatctacatgtattatgtacttggatgttttgctggcaccctagagatctggagcttttagaaggctactttaccataggtgtggtaagtgtgatcaatatatacctttaattaaactgtaacttattttaagccagtatcagaaggcaagttaaaaaattagaggactgtaacttctaagtagtataacacgcacattagcattcacccacgtgcttccacttttgcagacatggagcaaaagcagccctcctgctagtgagactactccaagaaaacccctcccccggcacagtggaaaaacccacgacagtctcagaagaagagcgtctatcccaggattcaaggttaattcctttgctctcaccttctcagaaatatcacttcatcattaataacccttttgcccacttatctttaaatcttcatctttgctggctcacacattcaaatctcttcaaaacaaaaaaacagaaccaaaaactccacactcctaattagtgccctattcttttcttctattcacagtcaggtttctcaaaatgatcaagcactcatgactctaaggtgctctagcaaagctcaccaaaggattccctattattgaactcaatgaaccttttcagtcctcacgttaactgacgtctctgcagcacttgaagctgttgacctccatgaagtgctttttctcccttggtttctatgatatctttctctccaggttttcctcccactttactccctctcagtcgcctttgctggcttctctttttcagcttgccccttaaatgttcctgttccaaagtgttccatccatgctgctcctattttcttttctacctaccctctccctacattccttccacctccacagcattagccatcatctgtatactctagagaatgtcttcctcatttctaaataccggcgtccccagcacatagcactcactcagtaaggtcagatgaaagcctgatgaatgatagacaattacagaagcaaccagggcccactatgttgcagagttagctttagcaaattctaatttcttgaccagattaaatctatctacaaatggtcagtcttactgagggctgactaccattgcctgtaagtgttcagctaagtgttcatttagtcaacaaatatgcagtgcctgctatgtgtcagcacagtgcctactatgtgccagctacatgataggccaaagaattcgtggagaaagccctgaaaatagaaacagacaactctttctgagtccatgtatacatctgtgtgtgatctgggcaaaccaattaagcttcctttttttttttaagacagagtcttactctgttgcccatgttggcgtgcagtggtgcaatctcggctcactgcaacctccacctcccaggttcacatgattctcctgcctcagtctcccaagtaactggaattacaggcacccaccacctcgcccagctaatttttgtatttttagtagagacatggtttcaccatgttggccaagctggtctggaactcctgacctcaagtgatctgcccacctcagcctcccaaagtgttgggattacaggcatgagccatcgtgcccgacccaattagcctttctgcctacaaatgtcttcatatataaggtgagaataatatatctattttacagggttactgtggaggttacatgagataatacataaatctaatatgttgcatattacttatgtctgttattcactgtgaataatatgtaataataaatattttatgtactcctttgttaaaacaagcttataagacaagttaaggcaggaattagtattcccactcagaatactaattctattagtattctaatagcagcaccagaacctaagcaatctccccaagcccactcacgcagtccctaggtggtaacgttctttagtgtcagagaccaaactgtgattctctttacttagtatctcttacagatcccactgctgcccagcagcataaaagatcctacccagaaaagggtctacagttgagaagccaaaggtcctaagatagtagccgaggagttgatgagcaaacaaagtgtttgttttcttaataaagaaaaacagttttctgcttggacacagtgtaattccaactataagaggcagcataatgttttcagtcagggaaaggtctccaatttcataagttttgatttaacaagaagattctaatattaaaaactgtcaggttgccacggtaacaatctatttgcaatcaagatgctggtggtattctgttatatttctctcaaggaaaaagtaaactagatgtagccaaggaatttaataaaagtatctgttggaccaaaaccaagatatgactgtttttaggcaatatgacaggatttaaatatacagcaagagaccctcaggttacaataccagttccatcaataaaattaaaagattttgaccttgacaccagtacaagctatagccatatgatctggaaatctgaatcctctgagcaagaaaaataaatcgttaaacaattgagatgacaggcatgggacaagaaagtcaaaattcatcagaaggagaacaaaatcaatccccaagggaggtatgaattataaagactaaatttctcacagaaaattcaaaggtttgatttgggtgttttgttctgctgttgtatgtatgcatgtatgcatgcggaggtaggttttgcactccaggacattcttggatgtttttaacttgctgctttcatctagaaaatgttagaaggacatattgaaaatgaactgattctagacaggagaggaaggaagtgactgtcaggaattaggccgctctgagtctggacatgcagactatgcagacagagaaacttcctccacaaccaccgaagcctcagtcacgcccatgaaaatcacatggattttctctacagttaagacttttcaagtacttgtttctacaacgattcaagaaatggtaacacttgcccccacaactttagccatgaacaactcatttctcttcaatgtgttaataactttacagaactgtatatgcatgctgaatgtctagaatgacaaccagaataaaaactgcaactcctttggcttcgacaataaattggcttcacaagaaaatacctacattcatgacagaagaaactggctcttgccttaacctatatagttaatgcagatttatatataaataacattatatactttttagaacatatatttttataaatgtatatttatatacaaaataactaaattattttctgaaacagccttgaacattgtgtgtaatctcattttctgtaagtcattttccttctactttctctataaaattggagcactgtcctctacccctccgaaaagacatttgttaaaatcacagtgaaggttcagcataccttagaaaatcagacattttaaattctatgaagttcagacaaaatattaatacaatatgatattcctatttaaataaactcctatttaagtgattaatgaatcatttatgtattattgtactatacttagtacagataacatatttttgttgagatagcgttcttaaagatcacagagattctgaaaatgcttctaggttgaggaacttaggtagaggaagctaacaatcgatgaatacaataaaggaaactcatgagtgatagagatttgaggaaagtgctagataatcatccagactttaaatagtttgggcaatgattcagggacataaatggccagcagttagaaatagagttggaactcaggagggggctctgacacagagacaaaaatttactcattcacaattaagtaatagttgaatctatttagaaaaacaatgtgaaaaagaaagtaagaaagagaaacaaggaccatctttgagagatgccaacatttaaagatccatggaggtgaaacaaacaaggtgacagaggtatcttcaaagtcataaaagaggagtttcattaaggaaacagtcaacaatatatgcctcagaggagtcaaacaggacacagaaagagaacaaaatactgtattcaacatttaggatgtaactagttacgtgagtgaattcacttcagtacggtagtagaggcagcagctagcctacaatgggttaatgagttagcagggaaacaacgcatccaagaatttgtcttatattctaagatcaagaaccctcaacgaacaaaggtaagtgattcaggcttacatcataacccttcctaagttaaaaggacaagagcatttgttcaataaggacagaacctgaaattactggcttgtaatgaaaacgtttttaaccctaaacaagaataaatttcttgactagaatatttttctgatgcatcaaatgtcaaatattcaattattctgatgtataaataccagagattcactgtattgaccagagaatgctatgaatctacccaagattcacaatacttttcaattaaattaagcaatttttccttctaagacttccatttcagttctaaatatgtgttatctccattcatccttgtctcataggacaatgatcttcatattttagaggtagacagctttactctttggtttctgttaacaggacatcttgaatttaattgccaatgttatttatgaattataactgtaagagtgcttttcagtatgatgaatattccatcatctttaatttttatgagatgcttaaaatgaagggggatgggacagtctagctgctcttttcctctcttgctacaccctcttctggaaagacaataaacaacataagctttttcctttgtctatataaacctgcaggttcacagacagtgccacttgtcaacagctaaagagaaataagaaaagaacttcagaaggggaaacattcataaagagcaagagcacactgaggtaaaaaaataataataataaatagaagctattacagcaggaaaaaaagaataaaacataagtgcatactaatatcaagaactacaaaggtggcaaattgaaataatctaaatactgaatattaatttttttctatgaccaaaatcatattaaagcttacaaacccaacctaatgcctaatgaactcatttaagttcaaagtacatgaatgtaaaagaaagctgaatataaagaggctatcttgtgttttcaatacaatttaagtgttattataggagctgccacatttgttcccaagtatcccttcataaaatatcagagacaagatggaggttttgtactaataaagtaaaaggtatacttccaccaggtaaaaactttctggacctaacagctttaaaaataagattgtaccaaaagctatctttatataatgatgatgactggaccatcaagaatatgcaacactccctgtatattatacttcatcatataaagaaggaacagctctacttttaaaagccagagaaaatgtctaggtctgcctagaactgtcatggccttaaaaatttcatggggaaaaaaaagagtcaaagtctcatggttttattatgcaaaacttcatgatttcaaacccaccagaatcaaataactaaaaaatgaaaatgaaaattacaaagaggcattacttatatcacttttaagattggcaaggatgaaaaagagtaacagtatcccgtactagcaaggctgtgagtaagcaagcagtgttcttgtatagggttggtggagtgtaaatgcaatatatattagagcacaacctggcaacatatataaaaatgtaaaatctgtttctgcaacttcatttctactaatttatcctatgtaaaaaccagtttcatatgcaaagatagatgtatactgatgttccctacagtggaaaaaaatggaaatacttcaatagcgtactggttcattaaattttaatgttacatgcagccaacaagtgtatgaaaaaaagctcaacatcactgatcattagagaaatgcaaagcaaaaccacaaagagataccatctcatagcagtcagaatggctattattaaaaactcaaaaaataacatgttggtgaggttgcagagaaaaaggaacgcttacaaactgttggtcggagtgtaggttagttcaaccattgtggaaaacagtgtggcgattcatcaaagacccacaaacagagccaccatttgacccagcaatcccattactgacacatacccaaaggaatataaatcatttatcatgaagacacatgcacatctatgttcatcgcagcactattcacaatagaaaaagcatggacaccctaaatgcccatcaatggtagactgaatttttaaaatgtggtacatatgcactggggaatactaagcagccataaaaaaggagatggtatcctttgcaagaacatggatggaactggaggtcattatccttagtaaactaacatagaatagaaaaccaaacaccgcatgttctcacttgtaagggagggctacataatgagaacacatggacacacggagaggaacaacagacactggggcgcacttgaaggtggaggatgggaggagggagaggatcaggaaaaacgactactgggtactaggctgaaaaatgactactaggtactaggcttaacacctggtgacaaaataatctgtacgacaaaccctcatgatacgagtttacctataaaacagtcctgcacatgtacccctgaacttaaaattaaagtttaaaaaaaaaaaaagttaacaaagtttaacatgttcatacaatggaatagtatacaaccattaaaaaattatacgtggtatgcatgtagctgtgtatatactaaataaagatataaatgtggacccaactgttaacagtgttggtctctaagaagtaaggtttctagggtacttggatttctcatttgtgcttttacttactttaacttttcataatgcacatagtttttttatagaccccaataaacatttcaaatgagtgataaaatgtattagcacagttgaaaatgcacatttgcatgtattatagacaatggcttttgttgtgttgaaggatcaaggggacttagatgtattaaaggtaatgtgatggctgtctatagtctgctgttgttattaccaaagagatttctaaaatacccaaaattgccttcttaggtgtacgggtgaggaaagcggccagcaatgtttaaagtattacctgaatgagaatgctattgatctttgtggtggtgtgggacgccaaggtatgaatctggaattttcaaatgcctctgtgctttccaggtactaaaaacatgaactctaaaattacagacacctaggttaaggatcagttctaccactgactagctatgtggctctgggcaagttccttcatcttcctaggcctcagtcttgtctcctggaatacagggataataatagtacgtacccccatagaactgttgtgaagatttaaaatataatatatgcaagccacagtgcctggaatacagccagtattcaatgttggctcttatccttctcaaagcacatcaagtttgctttttcattactgattacaaagacctcaggaaatcaaagtctggattttattgcaagcaaaatagaaacaagggatattaacttcagatcagataatagaaaacacccagcctgtcagtgaagttcattttctttctagaataatgctacccgtcctaagggtagttcagctttgtagagatagaagtcgtcactgattatcaataccaaccctctgactgtgtgaaaagtattaaaatactaccagtaccaaatgtgcacatggaagactaatgaagagcaaaacccaaatctgcctattaagcataaatgggaacttaagggaaaatctgaacaaagtctaatgaacaaataaaatataaatagacaatgaaaaaaatattgaaactagtccccaggacacttccaccattcgacagattcaaatcagcaaacatttattaagcaattcactgctctcaagaatgttcaattctcgtgcaggagccaagacaaaccaataagtaactgtgataaaagacaggatgagatgagtgctggaaaaattccataggtgcccgaaagggaggtagtacacttcctgcagggacaagggaaaacaataaagctacagtgggaatggttttcaggtatgagtacaaacaagatggccacaaattaagattgattcacctagcaagtctgaagtaatgagaatatgttttaataaactgcatgcacacattttatactgtctattgagagtctgttttataagaaatataatgttacgtgctataagggaacacaataacatttctgacatctcctaagctttacaatccagctggggagcaaattatgcatattgtattgtgaattccccaagggcaactgatgtgtcttttttatctttctattcccatcctcttgcacaatccctgcaacatcactggcactaaatgtctggcaaatgaataaataaataagtgactataatacaaagcagaatattatacgtgtcactgataatccgtattagagaagtttaagagagggacagaaagtaagcaaggaagctgcactatttctgtcatctagcactcactcctcatattcctctgaaaatcatcccttcctcattatctgtctctgtgattccttggaacagactcccagggaggacatgcgagctaaggcaagcacatagaaataccgcgtttccctggttatagcaattgcttcaagagtgcatacctgccccaagccccaccagtgaaatacaatcaccactaatcttggggattatgcttaagcaacaaaataataagttacttttcctgttgaatttggagctgagaggatgaaaacctagaacttttggccactgtcttgccaccctaagaagaaaggctatcagagaatcgaagcaactcacagaaggaaagcctagcaatggggggagaccagaccctaataatgttgtttgagcccctggccttagcaatgctaaaaggaagcatttttcagtcatagccaacaaattccttttgtgcttcattcaatgtgggctggatttttctgtcatgtgaaactgttttcatgaaaagactgaattagatttcatcactgaaaactgcagtgggtttttaaatacagaaggaattcaggtgaaaaaaactgtataaacaataagtgaagtaagaaaacagaagactacttctgttacaatgatttatatatatatatttcaagtttaagttcagatgaagactgaatagaatgggttagggttagctaagtaggctgagtatagcaaattggacagttcatgcttcacgaaggggtggctgctacccagctcaagaaaattactgcgatgtggaaactgacccaatatggccacaactcccaattttccaacaaaaagctcaatctagactttacaagaactggcaggagttaatagcaaaagaatgagtttatagcaacatacagaaccaataagcaagtctatgaggcaggatccagcagttagctttgtgactcagaggttacttaaatggccaagaaagtaaaatcaaatccatacaaaaggtatgtggacccaagtaaaggtttcctaaacaccacaaatatgtgggtcttctacggaacactatatgacaagagaaagaagagagaattgcggatatacagaaaaagcaatggaatgaatagctacagcactgagctcctaacacaacaatagctgaagagcagacagagtctatgctctcaagtcaggctgcctgagttcctacccaggctctcctactttgttgttctgtgactcctttgaccaagtgtcctcaagtataaaattctgctaataatagtgcctgcttcacagagttgctgtgaggagtgcatgagttgatacttattgtggttggcagaattttaaggtggccccaagattcctgcacccctggagtacacactctgtataataaatgagtgctgttttaagccactaagatcatacattcctccctcagtattgactctagcacccctgtggataccaaaatccacaggtgctcaagtcccttagattacatggcatactatgtgcatatagcctgtacctatcctcctgtatactttaaatctatacacttataatacctaatataatgtaaacactatataaattagttgttatactcttttttaaattttatattatttttattgtactgttatttttcatttcaaacatattttatttgtggtgattgaatctatgaagaacccaaagatacagatggctgactgtagtaatttattatgcagcaatagaaaaatgtgtacagcgataaagtacttagaacacagcttgacacataggaagccctcaataaatatcagctattattattggattctatttaagtgtacattctggtacatttaaaatagcattctaattacaaaaattcagtttgtccatatcatgtttgctagcacagaagatgcacaggcagacagatgcatcccagtgatacaaagaactagggcaggcaattgactaaaaaatactttctacaacacgtgtattgagagtgattttaaagtgattttgtagaaggaaactaattattgtgttcatctactttagactggaatccagttggaaataagttcaggatattcaatgatagtctactaacctaaaaacaaaatataacatcacaaagttatttgtaatacatattgggtcaacaaatacttagcagagaacaaagcataataattttactggtaaatgaaattatagttttatgtatgtgatagtattaaataaagatactatatttcagatgctcgtaactaagaaaacaagccataatacaaaatacatttgcatgaactcctatatagcacacgtacaaaacaaatagtataaatctgtataaagcaggcagcaaaatataatgaacttgaagtcattcccatggacatagccataatacatatagaaatttatttcagtttaaaaaactagttcaaagcacattgtaaaaataataaacatgaaagactttcaatgtaatgtgtacatatgccataaaagtacatatttctctgaacattagtaaatgaccagcaactgaaaatatgataaaaatagacttcaatgaatacataagcaggaaaaaaaatagagaggaaaaaggtatcataaagattttgatgtttagcctcaaagccaagtaaagcaagcccaaagcatgaaaatccacttactagcactgctagagtttggagttttctctttatcccaagcatttatcccattagccacacagtcaccattatctttaaaatacaccccctgcagcctaatcgctgtacaactcttgacattaagtttgaacttaatgttctgtcaatgcctctgctgctttctgagccataggctacaaattaataacttcatatgtaaagaggaaaagccccatgataaacctctgtgggctgcggcttgtttgtttttaaaaactaccaatgagacatgaaactttcatctttgttgagattttttatgttcctgcactccatcattaagagcagccttgcttgctacagcccaccaggaacaactaacatatacctgcttggtcttacaccctgcaacaggcacagaagatagaagctaaattctcatacgattacttggaataaggagcatgtgttactttacaatctattgcctaacataagtcccttttcctgaggttgccataagcttacatgagaaggtgtcctaaatctctcacagtaatgctgaatccgaaagggttcggagcactcattttgaggagcacagacctcattcagtgaaacaatgattaaagattctgtttcatattttattctaaaatcttacaagaagatacagaatcgcttccagaaaaatgttgaactccaacaacaatttaatagaattatagaaaatctcatttcaacacaagcctcagcagaagagcttccttgttatcttcaatgtaacacaaatcatctttttaacataaaatattaggaatcatgctaatttcacagctttgttacattagaaaaaaaagttaatggtcaattcaggctgcatccattttataatgtacagataaggggtattttctcataaatctgcttaaaaatgaatattaaagagggataacgtgacaccatgtcaaataaacaaataaggatgataaaggaaatatagctatttgaagaagattatttgaaataacacatgggcttccatagtcatatttagagaaacattctaactaaagtcagactttgtattaattaccacagaattcttaattacaaaatctaacatgaaggaataaaaaaacattttaaggttcctttcttcaaaaagtacacaaagttagcttgtcctacaattttcagtcattatcttatcttaataaatgagtatgatatttaacagcccaactctcctctttaatttgctcttgatgtctaatggcagcgttcaaccatgacaaagcaaaattactaaagttctcaccttcaagtttagaaagagctattgttgataggtgagccatgtactcacacaacttacagtggatttgctgaactctcttggtggcaccacaaaatatatttctgctcctgtcttcattacaaatcaaaattgaaggcttatacaaatttaagctgcattaaaaatattcaacaggatcccagcacattgggaggcggatcacttgaggtcaggagtttgagaccagccaggacaacatgacgaaatcctatctctactgaaaatacaaaaattagcagggcgtggtggcgcctgcctgtagtcccatagtcccagctacttgggaggctgaggcaggagaatcactcgagcccaggaggcagaggttgcaatgggcaaagattgtgccactgcactccagcatgggtgacagagcaagactccgtctcaaaaaaaaattcagcggggtgtatcttcaaactttgtgccattttttcccttgaaataaaaaaaaaattagaaactgggacagatatatttttcctatttgaatgctcatgaataaaactatattttatactctaaaattataataccttaacagcatggtggaaccactaacagatatggcttttcaatggatagtcactttagtactttagtataatacttaagagatcacacaatacataaaaataaacctctatctccaatttattatggtataagtattaccaaaattaaatttgtacaccacttttaaggtgtaatattgtaaaactctgcactacaaagaattaattgaagcaaactcgctcagataagatcattttgacctctgttcttcacgctagacattttcattacagaacaaaacagtcacaagtttactaatcctaaatgacttggcaaagccaatcctaatgacaaggattttgccgagtcatgtaggatttaagtgactctgtggttcctggtgagatacagtacttcaaaacacactggctgatcctcagaccaatgacctgacatcaagtcagatggaagtaactttgagtttcaaacataggggaggatgggtttttcttaagaatgaaaaaaaaaacaactcagcttttcattcagagcaatatattctgagaaacaacttatcattttggtaaaaacaggagaagcctaatcactcagcttctactctggagtataaaatagttttcacacttttagtccacatgaaaaatagctccgctgaatttctaattgctgtatttagtgctgaatttgtccttttatatattggccacctcctttttgaaactctcttcttttatagatctcaaaccacctgagatcccaaatcctgagtcaccttaagtggctctttctcttcatgtctttctaaaaatccttctcagtttattctgaaaagcagaaaacaaaaagcaaaataaacaaacaaaggcctacagccacgtttcccatttgaagaaccctgctctcataaattaggggattcttttttttttttttttttttttttgagacggagtctcgctctgtcgcccaggctggagtgcagtggcgtgatctcggctcactgcaagctccgcctcccgggttcacgccattctcctgcctcagcctcccgagtagctgggactacaggcgcccgccaccacgcccggctaattttttgtatttttagtagagacggggtttcaccgttttagccgggatggtctcgatctcctgacctcatgatccgcccgcctcggcctcccaaagtgctgggactacaggcgtgagccaccgcgcccggccaaattaggggattcttatcaggaagagaaagcagcacgaggagggctcacaaagggaagtgaggctcactagaacagccccaggcataaattgcaggggaaacctgaaatcaactgctcctaacccaaaacaggcacgtccgtcaagcatgaaccagcagcaagaagctccttggcatccagtcacaaggatctaatctcaactccaggtacctcggtagcctatttgcaatggtgactgttaaattctaggaagtcagcactgactcttccacctacagtatcttccattaaaggccaaatcaaatgatctccccactccaaatctccatcttaggtctccgcatcaccattatcgcagtctgctggagaatactgtgagcacctccatgtactgaacgtggaaagcaagatttacaaaaagaaggcagcacagttttgctttcaacgaatcttcaatataactatatttatttatatatttctttcatttatcctaccagacagggcggaaatgaagtcttaattatccttatttctccacatggtgctgtgaatagagtcagtacaaatttgttgaactgaaatttattaaactggttctttctgacctaaaagagccaagtaagaatcccactgctttgttttggccctatttgtccactttttcaatatgccatagaaataaaaggatgacaagtcaaaccaattttcccccacttctttactgcaaacaaataatactaaatattataataatataatactaaatatcacagtgatatagagaatgagggagagagtttcgtcccagaagaaggccctcctagccgactacaacagcaatctctagaaaaaccccctaccaaactgacaaattcaaaacagcaataccatatgatacttaagaggaagaatggttcacatttacaatttatgatagcacaaaggcactccagaattttatgttcagtgtactgaatagaaagcagctgttaggcaaagcatgattaaatgacttcaatatgggagaattaatcacattttcttatactcgggattctgctgtcactcaaaaataaagatggaaaggactgtaaggtcagtatttttaaaaacaacatcaaaatgggcacctaaactagtatccatctaaaaaatgtaaaatgactcacaggcctaagatagtaagattttattatccatctaaaaaatgtaaaattacttatgtgcctaagatagtaagattttattatccatctaaaaaatgaaaattacttatgtgcctaagatactaagattttaaaagcttatttgcactaaaagtttttaagaagcatccgttctgtattaatataattagtagaacatcaaaggtgcctccaaaaccaatatgtattttttaattgtgaaaaaaagtttaatactagcaatactaaaaaaaagttaaaaaaagcttaattgttaaaaaaaagtttaattctcatttaattttcatttcacagactaggctacaattctagcaaaacaatgcatttatcaaaatacatgatcacattatgccatggatgggaaaacagaaatataaaatacatgcagacaagaaaataaaagcaggcacttggattatcatactcctccagccagacgaaggtatagtgaactagagagttcaccacaaacaggaatagaataaccaaaaactccaatacatcaaacatgtcagaactgaatggctgcctgaaaatgaatgcccctgaaaacactatccttacttcctctgtttaccaggtagaaagtttgaggattctattttgtttctcatactctgtgtctactgtggtcaatcaaaaaaatctactgaagttaccgggctttgaaattacattcagaaaaaagcaagctggactgtgggataggtatttatcaatgaaatgctcccaaggacactaatgaggttttagaaaagaggaagccacttgctgagacattgccttcacggccaagagtctttactagccaattccatagcactcttcctatgaattataatttagaaaggcagatcccacccaattctagaaatataagttcaaataggccctaagaatctggtgaactccatttaaaaaatgatttgtctctgcaaaagaaaaaagaaaaagatttaactgactgcaaatgagctttactttatggaataccagacactacatgaggaaatctaggtttttaagacagagcaatgagcttgccaaaataaatcttcttccacaaaaaggttcataatagaaccctgttaaactctaaattttcctagttaatataacctggtatattatttataaacattataagcaatgttttcaggaaaaaaatttgctgtacaatacagcactgaattctatgtttatcattttgctataaagataattagaagtaattagtaacttggcagctccaatgaacaagacctgcttttttcagaaaccattaatcctttgattcttcatagaggacaagagaaatcggaggcaagtctacctgaaaagagagaatgacacgaatagactggaagaaaagagctccaaaatgtctggaggtgagacactgacattcattttcagcagccattcaatcctgatggactggagcttttagctcttcccattagtgatgaaatggccagcttaagatactagcacctaactggaggagcaaaataatggaagttgctgccctttctcttacccacttatattttacacttctgctttcccattcctgtcctaatggacatgtctaagagagttgtgaaaggtttcctagaaaaggcaccatgtttaaacgaaatttgccaggcagagctgaagaaactgtacgagcaaagcttggaagaagaaaaggaatcctgagttttaggggaaaggacaaagagtaaggcttttttttttttttttttttttttctgagagggagtctacctctgtcacccaggctggagtgcagtggcgcgatcttggctcactgcaacctctgcctcccaagttcaagcaattctcctgtctcagtctcccgagtagctgggtctacaggcatgtgccaccacgcctggctgacttttgtatttttagtagagacggggtttcaccatgttggccaggctggtctcgaactcctgacctcgtgatccacccacctcggcctcccaaagtgctgggattacaggcgtgacccaccacacctggcctaacagtaaggctttaaagagcctactcaactaatactgaagactgttagtaaatatgtgacctatggaatgatcacactctatagaatgatcacactgactgagagctctatattattttgtaattgaaaacatgagttgttttcaaaagaacttttaaataccaagatgatgcaagtttaaaccttccttgtcatggagaaaatgcccttccactccaataaactaaaagataatttttaactatacagaacataatgtcttgtttccacaaaatgctaaatactttgcaagattctccttgctgactctgaggtggcagaaagtgacaaatatcatccaaatcttactgatacaaggaaaatattttcagcacaaaaaaaatctttgtagcatcatcattgctctaaagaaaagctagaagcctgccataatgattagcaaactcatatagatatctccaggaaaggatttacaaaatgtcatcacatccttgtaatcatctaattatcaaactcagcagtgttgacaaagcacaagcccactcagctactgctaatgattattattcaaagctacatttctaccaaatcagaataacttacaggtagaagctcattagccttaggaaccaccctccttgaacactcacacgcacacgcacacgcgtgacacgcatacacacacgcgcacgcgcgcacacacacgcacacacaccccagccataactaggccttgctgaattgtcatttgctttcatgaccctccttcgtgtatatgagcagctttacgaattggttcaaaaatacccagcctttcaaaaataattccctatctagaaaaataccctacagacatctatatctagagaaataccctatggacattagtttgctaatgtcatagcaacagtgcggcaggcatcgtcaagctttggtggcttgaagaaacacactggcaatgcaacaatgggaaggagctaaaacgtaatgtaagtgacaatgcaacgtgaaggaatggaggcataaaggcaatgcaacaatgggaaggactgaaagcataatgcaagccatggaggaaaagcatacactcactgaatctccgcaatctacttgtcactacaccaggtgctaggaaaatggttacgaccctcaagctgcttgcagtctatgcaagcagtcagccagctccaggaacgtggcatgagatgaagcttgcagggtcctcaaatgccatacttaaaagccttgatttcatacaaaggcagtagggaatcaacagacatctttttgcaagagattaaatgatcaaatctgggttttttttcaattatctctaatggcaaaatataaaaatgaattgagactcagggaaacagtgagaggcaaggatatgagttagaggccatttaggtgagatcggaaggattttaataataactgggacagtgacaaaacaatataaaaataaaacaatagagtcaagagatctttaaaagcagcataagcagggcatacagaagtttgggggaagaatcagaggtattcctgatattcctggcacggctggctcaggagattgcaacgtcaagagagaagacagcaaaggtggagaagcagtatgctgtgcggaagaaaaggcagagtttaggcactgcacacgacgaatctgaagtaaaaccaggtcacatagatgaagatttttgttggtatatagaaaatatgggatgagctcagaaacacaggcaggcaagtaaagccatggcagcaccatattgtcattcaacaggtaaccagagacaaatcagcaaataacttttaaaacaaactggtgagacaggcagaaggacaatgatgagcaggttaaaagacttccgaaggttaaacactatcacacctcaaatctgcataccttgagatttaagtgggtattgttggttttggtttgtttgtttttcgtttttttgagaccgagtctcgctctattacccaggctgcaatgcagtggcacgttctcggctcactgcaacctctacctcccaggctcgagcgatcctcccacctcagcctcccaagtagctgggaccacaggcatgagccaccacaatttttgtattttttgtagagatgggttttgtcatgttgcccaggctggtctccaactcctgagctcaagcgatctgcccacctcggcctcccaaaggactgggattacatgtgtgagccactgcacctgggcaaagtgggtattgttccataaaatcttggccaaatgggaaacaagaaaacccacagtatagtcacttcttattacagaagacttttgaggcccccaaacaatataccttaccaacttctgctctaacctgaaagacccacagccactgaatgattgtgaaggaggaaaaacagaccctaggacaccaaccagcaagtcacacacgcctctgcagatgctgtattggctgaagaaaatgctgccacccatcggggaaggaaaggaaattctattaaggatatttttaattctgatcctaattcaggtgatcctaattaaacagctctgcataaacagtgtcttgataaatttttcctataagcatcaaaacgaaaaccaaatgtcaatcaaaacttgaaatagcgcccatgactgccaagtctggtcacatgtagctctaatgcttttcttttacttgacaagtatttattcaaaaacaacattttaaaattatttgcctatgtcattaatatcaagtataaatgttaaggtcaaataaatatcactaaaagaaaaagaggtgttaataaggccaaagagtattttcttatacactgcatatatagtttatagcatagaaaatgtttaaatctataaatgcatgtatctatagaatcatagggaaaagcacacccaataatggcttgaaaatgataaagactcaatctggagggctcctgaataattaatgttttaatatgcagtactaaaagattgtagaatgcagatttcaaaaggtaccttaactccatgcaaattccatgtcaattatctttattttcacatacagttgtggcaacatcagcacagaatcatttgacatgaataatccaccctcctcccactcaaactaccagcatttatttagatttgaatatatgaaggacagaggtatgtaaggcatgatgtaccacctggataaaaatagcagaaatcctgattaaataatttacagttttgcctagagcaatactttagtattagagaatattatcaaatattcttatttccatcattctggattttgctaaggcttataatggtccataattagggctctaacagagaactaatataacacagaatgcagtatggtggaatgcagaaaataagaactctggaatgaagaaagccatgttaaagctctgtctcttttacttaaatatagtgtgaccttacgcactttctcatctacaaaggcacgatacccataactcagagggctactatagaagataatgtgaaagtacacattaaagtacttggtagaataaaaaattaaaacaaaggagtgcggcactaggaaacttgtgatcaatccgccaattgtcccttgatctgttgatgtaagacaggtaccagtgtctaatactcatttgcttcctggaaagtatgggccaaaaaatgggaaatacaagacaaatccacatactcaaatatgtaatacagcagttctgtttataactgagttatctgaagggaaggcagacagctggtttgggaagccaaaatcatttaaacacggacatacagaatctctgaattgaaactcatcattagacaagctaatctagtttcaaatgtcgaacgatactattctgtaacttatttttaattttctgcctttacacagataggcttcaatataagaaacagatattgctgaaaggttgtctgtaatttaacttctgtttgctgtatcacattttcacttcaacttagcagctaagttcttgagcacttgggcatcaactaacagaaagggcattagacagaactcagaagacttcagttctagctttcttcctgtcactgggtgactacttccccctctctaagccacaactgatgtattctggagaaagggagaggagaaaaaatgggaaggctatggtatcagagagtttctgtgatctcttcagccctaaagttgtataattttattttgcttaaggaagaaaatggggacacatgacctattttcatgaaatttatagtctaagtgggaacctaagaaaaaaggacagacaacttagaaagtaggggatagtcacagttgtcaaatgcttggcatagaaaataacagtgactactgattttacaaaagggaaagctcaatcctaaccaagtagatttcaccaaagatctgagtagaaaccttaagaataagcaggacctcaatagagagggcgagggaagataaactacacccttccatgatgcaccagaaatatcacaaactcacaaattcaaagagcagtttacatatcatctaggcctaccttatagagacaacccatcctgacacgtaattctaatcctcagtgaaactcttccaggaagaagtagcttccagctgtaccaggacacgctgatacgttgttggaacgctctggttataaagctcttctagataataaaacagtatttttgtcctttcttcatcatgctttgtaaatagacatttatttgaatatgtctctttaaacatgtaacattaggtactaaacacagaaactgtaatgaaaatcaacttttgaagatagaaggaagactcttcctctttgattaagatgctttaaaagaatctggtttggcgaagccatccccaaactcgcctgcttacctttatgatataccaagtcatcttattttccacatcaaatggcaatgtctgatttttgcccctaaaaaaaacactctgtttctgcctattacaaaatttaatagagcagtttatcacagtttttcatcactcttaatattatatctctaaaacatatttgttttttcctcccatgaaaggtccttcttatttgcaatagaaacagccaaatcataatttaaagtttgagggcaataatccacaatctaagaaaaatcaaacaaaaactttgaacctgagttacataaccacaatatttctaatagaaaattttatctttatgtttcatttcaaaacaaaataacaaaatataacacctttaattaagaaccaaaagcatgatagcacatgtctgtagtctcagctactcaggagactgaggcaggaagattgcttgagcccaggagtttgaggtcagcctgggcaacatactaagaccctgtcttcatgggtttttttttttttttttgagagagtttcactcttgtcgcccaggctggagtgcaatggcacaatctcagctcgctgcaacctccccctcccaggttcaagggagtctcatgcctcagcattctgagtagctgggattacaggcatgagccaccacgcccagctaatttttgttgttttggttttttttttttttttttttgtagagacggagtttcaccatgttgcccaggatggtcttgaactcctgacctcaggtgatccacccaccttggcctcccaaagtgctgggattacaggcgtgagccaccgtggctggccaagaccctgtcttttaaaaaattaaaaattaaaggccaggcacggtggctcatgcctgtaatcccagcactttgggaggccgaggcgagcggatcacaaggtcaagagatcaagaccatcctggccaacatggtgaaaccccatctcaactaaaaatataaaaattagctgggcgtggtggtgtgcggcctgtagtcccagatactcgggaggctgaggcaggagaatcgcttgaacctgggaggtggaggttgcagtgagctgtgatcacgccactacactccagcctggtgacaaagtgagactcctactcaaaaaataaataaataaataaaataaaaatttaaaaaaaaaggaaacagctaagaatgacagtttaaaatattaagacaataaagtccctgctttttctattttataatttctttctctctttagtaaaataattgcagttttcttactataccattgagataaaacatttttaaattattgaattaaattggctttagagtaaaacaaaaattgactcaaaaaacaattactgtgtgtgtactgtgctcagaaatgtgaccagcaatgtaaaccgacagaaccaatggctttttagaaaataacaaagtatttccgatccttttttaagtagagaattttctcccagcacatcctatttccaattgtgtgcaaaaaaccttccagcttacaaatgttaattcaggggttggcaaataaaggcccagaggccaaatctggcccaccacctgctcagtctgcaagctaaggatgttttcttacatttttaaatggttggggagaaatagaaagagtatttttgaatatgtgaaaattacatgaaaaatcagtgttcagtgtcaatgtttctttggtatacagccacacccattcattcacgtattgtacacggggcctttcaggctacaatggcagagttgagttgccacgataagcatgtgaggtaatgcatatgttaatttgctccatttagccactccacaatatatacgtatttcaaaaaatcatgttgtacatgatatatataatttttatttgccaatttaaaataatttttttaaagaagcagctaccacagagaccataagtagcactctctttacacactacaaattgtcatgaggcagttgtgactcacttttgtctcctgcctggaaagcctaaatatttacaatgtgagcttttagagaaaaatgttcttcaaacctggaataattaatatagttattcatcattccttgaagaacttagtataatggcagtctctatgagtcagagctatcaagtaattactagatttcttgaatcttatcatgatattagtgtttctttttgtcaagtctcatatatttatattatgtattaatttttaaaaatacattatctgggccagctgtagtggctcatgtctgtcatcctagccctctgggaggccaaggtaggagaatcacttgagcccaggacttcaagaccagcctgggcaacatagcaagaccttgtctctacaaaagtaaagcaaaatattagcaaggcatggtggcacacacttgtagtcccagctgggcaggggaatcacttaagcctaggagttcaaggctgcagtgagctatgatcacatgactgcactctagcctgggtgacagagcaagatcctgtctttaaaaataattttttaatgaaatgaaataaaatataaaaacatttatcaaagtgtgctccacaaaacggaaaagggatactgttttctcacattccttcaatccgtcaaaaattaaagacctcctgcatacaatgaaggttgctaggaattcaaaataaataagatgtaattcctggctccacgtaattgcattctagtagagagacacagtattccagtagattgttgtcactaaaggaaaagccaaagcaatgacagtaacctttgccatttcataatgtcatacagacatttaaaaaatatcacctctgtctgcattaatggcaagttatacacttaaatagataaagcaacaaggcttgacaaacacatttatccatcaatactttcaagcaaagcattagccttacataagcaattaaccttgaccaacacgggtataaacaaaaatgctgattaagaacttactaattatccttcccaacttcagaagtttagctggcatctggtttttaactatgataaatatacaccaactcatcataggttattaacacataagtgaaaagaaatatttaaccaaatggctacgaatgaagaacacgataaacaaatatcatcattaaaaatccaaacaatgagttgttttctttgaaagcccaagtgtcctacaaacatcactttatttgaaggtagagaaatatttctgagaataattgtctcctgaatcaacttcgagattcaatctgttgtaataaagacaacatatataaatcatagatgcatgacaccgtttcataattagaatgccaggatctgcatgcagttaagcatcctagctgtttgcctgctttacttaacaccagaagagaagtataatcccaacagctaagtattctagcagctgttgtgagcagagtagagagatgtggcatgtagcagtcaccaccacacgtaaacacacaagcaccccggtgactggaggttagcaatcctggtgtgcctgctcgcttttagtgttaaatatttaatggcatatttttccttaatggaacccaggcacatctgatcagtcactgggatcatttagtaatgcagtcaaagttatcatactgccatttcacatcaactttgtaattagataatccatcactttattaattcaaaagattgctttctttactaccttatagcaggctacagcagtgaaacccaacagagctcatcaacaaaaaaggctctaaaatctggtcctacatgaacttgaaaccctcaagtgacaaacatatacacactcctgacctttcaaaacaacagaggtaatactcttcccacaaattagcccaccaacaacaatgaagtaacagagcaccagtgtatccagaatgagatggttaacagaactgaaaatttaagcttaaaagctgaatataacatgatcaactttgttctcgctttttattgaggtacactgttcaccagaggatgaaaaggatacacaaaaaagtcatttagtaattttccctccatgctgatttatatacttcactaaaattatgagggaggttatagcagaatatcacatccattatttatgatcactctaaatgtaaaggcacataccggccaaacacaagcatgtaatcttgaatatagtatcacgattttctcttgctttatttctaacataccacaaaatattaaatcgcgatttcttatcgtattgtgaattggtaagattctcgttttaacaccttcacagcttctccaatttaaaaaaaaaagaatcctccaataaaaaataatttactcagaatgaaactgtaaaatttaaatatcatagtaccaaaaacaccctctaaaatactcactttccaatctatgcaaccagtacatattgcaaaaccagctacagctaatataattaaaaattagattttggaaaagcaagctccggaggtcacatacgtgccctaaagaacaaaaataacatgctaccaggagaattattaatttgaaagaaagaaggagagaacatcttctcaaacagatgtggaatttctaatcaaaaaaattctgtggcagttgcacaacattataaagttcagcagtactttgcagagctccggaaacactaacaatggcatatgttctgtggtcaggaaggtcacttttattcttgttgccgccaatctaatgcctgtttttgaaacattctatgcaactagtctattttctattttattgttcagattttaccacatttctaatcaggctgccaaataaatttttagaaaagaaagttataagcccagaaaaaaaaattatatatttttctagaactctgtacaataatccctaaagaaatcttttatgtgcataaaaaaaatctcaaaacaaattctactgaaattacgttgagactatcaataaccattgccaataattatcaatggacattttaagggatagaatagagaaatacaatacattccatggcgtttcaattaattagaacatgacaactgaagcacgcttaattccatccttttaagatgcatgtgtgagaaagatttccatcatcaagggaagcctacttttacatttcccacgtgaaattccaagaaactactttgataccatggagtttctaagaatgttggcaacagtacatgatttctgtccacaatggctatgactgaaactaagcctcaagaaaagacaccattgcctgtttgcaaaatttcttctcaacaaaacaggtaattctcaggatctcaagagacaccagcactgggcacaactgtgagcaaccatctgagactctagtttacaaacagtggcagactgcgctcttggctagatgacagcacagggagatttaaaacaccaaagttctataatccaataaaaataaagctgagaggtgggagcaacagtagtagaaattaataatatgtgtcagacactactaagtacgttatagttgatcctccttgaaatctatgaagtagatattagtatttccatttacagataagaaaattgagatggagagaattttatttacttgactgaggaaaatgacctaaccatcatattattcagcctcccatttaaatttggcctctctctaactgtaatttttgtttgttttgagttggggtctcactccgtcccccaagcagcactcatggttctctgcagtctcaaactccggggctcaagcaatcctcccatctcagcacaccgagtagctaattgtaattttctgagtttcgaaggatatatttatgcttaggagtatatacattttctatatttgtagcaaatgtttcggacccaatcagtacaccgaatcacagcatttgtcatgccatgataaatttttttgagacagggtctcactttgtagtccaggctggagtgcagtggtgagatcacagctcactgcagcctcgacttcctaggctcaagcaatcctcccacctcagcctcccaagtagctggaactacaggtgtgtaccaccctgctctcagctaattttttttttaagtttttttgtaaagatggcatctcgctatgttgcccaggctgatctcaaactcctgggctcaagtgatcctcctgcctcggcataccaaagtgctaggactataggagtgagccattgtgcctgaccaataaatccatttcaaaatctaacaggtgctgggtggggtggctcacaccagtaatcccagcactttgagaggccaaggtgggtggatcacttgaggtcaagagtttgagaccagcctggccaacatgacaaaagcccatctctactaaaaatacaaaaattagcccggtgtggtggcgcatgcctgtaatcccagctactcaggaggctgaggcacaagactcaacttgaaagccaggaggcagaggtgcagtgagccgagatcacgctactgcactccagcctgggcaacagggtgagaccctattcccaaagagggggaaaaaaatctcaaaggaaattttgtttgaaaatggaagtggagatttaaaaaaaaaaaaaagtgtgtggtagagaggagaaacagcttgtagagatggagacatacatcttctcttctctaaacaatgtgaaaaagagccagcagagatgaaattggcctttattttttatatgcatataaataatcacatctcctgtgttcatctgtatatccccggtgcacttcctatcctttcaacaccttcattgctgtctgtggaaattaacacctttcattgctcacactttacacttttatctccgttcagccacacactccccagggaacatacaatctaagttttttaaaaaaaacaaaactatccaaataaagctgcaagtaatttgctctagcctctccatccaacagattatcactcagcatcccctcctctagagaaattctgggagtatccctaccctcactttctattacatttagtgcaaaacaaacattttaaacatcaagctcttattctaactctactgtaattactaaatataactgaaatctgtattccacaggtaacaacttcctttgaaaaccttctccggaggaggttgatatatttccctcaggaggttggaggaatcaacaccctcactccccaacagcatttctagaccactgtatatcactgtttcccaacaccagcctcgcttttgaaatttacgtcagtttccacttctgatatgaggtcctccttgacacccacccctagaaaaattcctccttcctatggctcatgttactcagtttttacagccaggcaacaaattcataagtggacaggatatatctatatagaaaactccacaatcaaactccaattgctattagggtgtgtgtgtattaacactggtgctaagagtcagagtcagactaacactggtgctaagaagtggggtgaaaaggaggaatatctgggaatatgaccgggaaaattacaagtaacagaagaaattttccaggtaaaattaaggcttacgcagcagatgcacgttcagcattgagaacccggtccgacaggaaagacacaccatttttccgccagaaactccagtgttcaaaatacaaactgccaacttttcaggcaataatcatgagcttccattagaaaaagccatcagctcaccagacgacgaaatatgctctcgggattaagaactttctcatcctccctgagccctttcctttcaggggaagtgcaagtttgataaagatatgcatattcttcaagtaagacttttgacctgctgaagttttctgccttgatagataattttgagatttagaattagccacatacttctacaaccctgtgtcaagagtattttgtacacactagacctgcaaataaataaataaaagtctgctgtacttgctaagcaaattcagattcaactaacaaacacctctcagcagggcaagagacttggtaagaaaagactaattctaatgaaggtttaaaactccgaagagaaagaacatctgtgtgaactgtaagtattaaaaatgacagatataaaatgagtctgaaaattagggaaaccagctgatagaaacatgaagattcattctactagtccctctatttttgtgtgtgtttgaaaatgtccataatttaaaagtcaaaaaaattaagacataagcaattttagaaaagctctcagaattccatatgcctttcaatgaaaattagatggtctaaaactggccgggtgcggtagctcacgtctgtaatcccagcacgttgggaggccaaggcgggcggatcatccgaggtcaggagattgagaccagcctggccaacgtggtgcaacgttgtctctactaaaaatacaaaaattggccaggtgtggtggcaggcgcctgtaatcccagctccttgggaggctgaggcagcagaatcgcttgaacccgggaggcggaggttgcagtgagccgatgttgcgccactgcaccctagcctgggcgacaagagcgaaaactccatctcaaaaaaaaaaaaaaaaaaaaaagatgggctaaaacataagcttagtatgtctattatctgcacagaacctgaatgaatgtaaatgagaggaaccaaaagaaaaacaaaaaacaagatcttgtttattgaggccaggtatagccagccttgttgacagcgtaaattcagaagtcagcagcttcctctgtatgtacaaactgtcagtcagggatagttgcatgttgacccgctttccacagcctaatgaactgacttttgaattttcgctgtgaagaaggctggctttacctggcctcaataaacaaaatcctgttttatgttatttttttatggtgcccgtttcttctctttgattaattaattttataccagagtaaaatgaggagaggagcagtagactgggataaaaatctctgcccagggatcttcacccagttcccgtgtgcttgatgtgacttgcaccatcacacaccgtcaacattctgggctcagtgactcatccctgaaagctgcaggatctatttaggttaatttaggatctttcatgaacaaggaaggagaaggagtcagggggcgggaaggagggagaaggagtcgggggagcgggaaggagggagaaggagtcggggggcaggaaggagggagaaggagtcgcgggggcgggaaggagggagaaggagtcggggggcgggaaggagggagaaggagtcgcgggggcgggaaggagggagaaggagtcgggggggcgggaaggagggaaaaggagtcgggggggcgggaaggagggaaaaggagtcggggggcgggaaggagggagaaggagtcggggggcgggaaggagggagaaggagtcgggggggcgggaaggagggagaaggagttgggggggcgggaaggaggggagtgatttaaggacaaatttataagcagaaaaatacaaattaaaaacattaacaaaactttcaccagaaagtacagaagccataggttattggctgctttcatctgattattaacctatattttaatgcagaagtgacacactaaggccaattatgcccaaaaatctcaaaactgtgtattttctagcaataacaaatattatgtggggagaagggtaagcattatattaaaaattggtacacttaatcatagcaacagaattttccccctatacaacatggagataatttcattataaaatacatgagactaaaatcttcagaaagaaagaagaactaggatagtaattcacattttacatgtagcaacagaaagtattttaaaatatttttcatggatattaataacatcagtaattatcactggaacattttccaacaatagaaataattaccacagaatagccacaaacttaacactaggaatgaggtaataatcatcataaggtatatttttatctttcagtaggtgttcgtgtttatagtgttgaacatgaaaacagccttgggcacggcacacgatactactacaggttataattttcagaagcatatgaaatagatgagaaagttttcagatgcactgtaagaaatcagtaaattttgaaatcaattttaaattatagataaccagaatataatgctaagatgacattaatcagaaaatcataaaaatgtaccatacagaataaaaatacatttgagaaaaactggaataaatctccagcaatcaaaccaattacatttaatttttcagaaaacagtaaattttaaaacatgccttaaaatattaatggcataaatatatcttcaaacgtgtgcttacaaattacaaaataagtggcaaaattgtcaaaagtaaagttttacttgttattaaattgtgatcaacattaaaacaaatgcaaacacacaatgtgagaaagcgaggacagcagatccatagcagtgagggggtgtttctgtcatccctatcccagggtaaatatcaagaagcaatcatttcatgcctatgggctagtgaagaaaaaaaaaaatcaatcatcgcactcttcctccctaggccaagataaaccctcggaatcatttaaaaaaaaaaaaaatacttcaggaggccgggcgtggcagttcgcgcctgtaatcccagcactttgggaggccgaggcgggtggatcacctgaggtcaggagttcaagaccatccgtctctacaaaaacaaaaaaaaaaaaacaaaatttagctgggcgtggtggctcatgcctgtaatcccagctactcagaatgctgaggcatgagactcgcttgattctgggaggcggagattgcagtgagccgagatcgcaccactacactcaagcctgggtgacagaacgagactctgtctaaaaacaaaaaagaaaagaaaagaaatggatttcaataaatttttcatttcaaagacaggctctatgcttaaacaaccaccataaaactcaatgaatgcaatgcaacggcaaacaagtccattcacaaaaaataatgggatatgctattttcttctgagaaaagaaagcatactctttcttccaagggtacactttgagaattcacaatgaacatactcaggcaataacaagaatattaatcaaacagaaaaattcatacccttctcaatgcacacaatacattctctcatgctctactcactatgataaggaagtaatataaggcattaagggtcttgaatttcctgtcaagattctcgacatttttgtaactaacaacaaaataaggagcaaatggttgatgtatggaattagcaaagagcaaacttaacacttacttttgcaaaggcttcaaaaaggtcaaaggcaggtggcagctgagaggcatcctgtatttcttctctcatgaaatgttgaaatgtcattacgagttgcctgaggccctctttcttatcttcagtcagtttgttaatatcttttttaaagagaaaataaatagcacaatctcaaagtaaacttctgaaggataattttcaagtgttcaatgctggctgttaaaccagatatttcctaccttacattggattttgacaaagagcaaatacatattgttttatcttttgacaactaaatatgatgcatatgttatcaattaaattctgccaaattttgtctgcaatgtaagatcaaacacctatcaaaacataagtacgcacatatatgaaaaagcattaaaaccaaaatcactgagattgtgtgttaccagattttctacatcattctgtacacacatacaaacaattatcagttcttattaagtcagtaaacttaagcagacttttccatgaaataatttacaactaggtcatgactaaactaataaacagcatcacctctaaggcaaaaagacagaaaataagaactaaaaagttcagataaagttcaaataggttaaatttgtcatatggctagtacatcatgaatagaacagggatcaagcacagcaatttcaacttcaagttatctgagttgaataaacaagataaaggagcctggcgccgtgactcacgcctgtaaccccaacactttgggaggccaagacgggcagatcacttgaggtcagtagttcgagagcagcctggccaacatggtggaaccccatctctactaaaaatataaaaatcagcagggcgtggtggtgtgcgcctgtaatcccagctactcgggaggctgaggcaggagaatcacttgaacccaggaggtggcggttgcagtgagccaacatcgcgccactgcactccagcctggacaaaaagagagactccatctccaaaaaacaaagacaaaaaacaagatatgatgtggcatcaacccaaacagaaggagatggttctaaaacaaaagaagaagaaaagttctaacgccaatactacccccttaaatatcattttcaatcataccacaaatggggtgttaaggctgaaaggatacaacaggtcaattaataacatgtgagagcatttcacttaaggtcatgtgtatgacactagtactgagtagggctaatgtgaagagtaaaacccatggtaacagatgttatttacctagcagtaatataacaagaaaatttgaatactttgctgtcttttaaaacttgaaaagatacatcaagttgaactacagcataactctgttgcttatgtctatgcatatcctttagattacttattcaacagaataacccaatgatttctttttttttctattttatatgcttgttaatttttttttgatggtaaatatatgtttttttattttatttattttttcttttattattattatattttaagttttagggtacatgtgcacaatgtgcaggttagttacatatgtatacatgtgccatgctggtgtgctgcacccattaactcgtcacttagcattagatatatatactaatgctatccctccccactccccccaccccacaacagtccccagagtgtgctgttccccttcctgtgtccatgtgttctcattgttcaattcccacctacgagtgagaatatgcggtgtttggttttttgtccttgcaatagtttactgagaatgatgatttccaatttcatccatgtccctacaaaggacatgaactcatcattttttatggatgcatagtattccatggtgtatatgtgccatattttcttaatccagtctatcattgttggacatttggcttggttccaagtctttgctattgtgaatagtgccacaataaacatacgtgtgcatgtgtctctatagcagcatgatttatagtcctttgggtatatacccagtaatgggatggctgggtcaaatggtatttctagttctagatccctgaggaattgccacactgacttccacaatgggtgaactagtttacagtcccaccaacagtgtaaaagtgttcctatttctccacatcctctccagcacctgttgtttcctgactttttaatgattgccattctatctggtgtgagatggtatctcactgtggttttgatttgcatttctctgatggccagtgattgtgagcattttttcatgtgttttttggctgcataaatgtcttcttttgagaagtgtctgttcatgtccttcgcccactttttgatggggttgtttgtttttttcttgttaatttgtttgagttcattgtagattctggatattagccctttgtcagatgagtaggttgcaaaaattttctcccattttgtaggttgcctgttcactctgatggtagtttcttttgctgtgcagaagctctttagtttaatcagatcccatttgtcaatttttgcttttgttgccattgcttttcttaaataataatttattaccatgggaacttcagatcccacaaccttatataaatctgtactagatcatcttcttgtctccatccagaagtattaaactgtgcagcaaatttactgtatgtgccctggctagttttgagttgaaatcacttacaaccttaacgaaaaggatctgcgccaatacaaaatcaaaacgaaacctacctttgcttagcactcagatatgggaagctttttaagtcatcacaagaaggtggctacctacatggtagtttcagagaagaatgatgcttcacactgccacagagactgagtcatctgttccttctaccttccttaatgtctaaaagatcagtaaccctaaaagctctgtggaatccccctgttcactaatcactcttctctgacatcaaaaagaaaacagaacaggaaaccaagagacagaagaagggaaacagggaagaaaaaaagaagaaaaatgattttgtcaactggactaatggttacactaccccatgtaacctgaacatcttcatggcgctttactaacccttatcaggacgaagctaccctggaataagtgaaataaaccagtgtgacagttgtatataaaaataaattttgttaggtttgcatcacattataaagaaacagaaaaacatagttaaaaataaatccattcaccaactcagcaaacaaattatagaaacttttttaagatgctgatagacaatcacttacttgactccagatcataaaatgagtaaagcttctctgattctgaaggtgctccatccatctgtgaaggaaaaggggaaaacgccaataacaatttcaagtgttccaatatataaacaaataagtttgagtacctttgtatatttaaatgaaagtccatcaaaaagaacattttctatatattctttctattcatcactctcattagactgaattaatcaacaactttaaaataaaaatctaacttgtatcttcactcaacagtttaatctccaaatgcaaaactcttgtacaaaaagttcccatatttttatattcataaaaccctctataaaatcgtgtaccggccaaaagagtcagtaaacaataggaaaaggtggggcatggtagctcacacctataatccccgatactttgggaggccgaggcaggcagattgctttagcccaggagttcaaggccagcctgggcaacatggcgaaaccctatgcctaaaaaacatacaaaaattagccaggcatggtggcatgcacctgtagtcccagctactcagcaggccgaggagggagaatcacttgagcccagcagttcaagcttgcaatgagctatgattgtgctactatactccagcctgggtaacagagcaagtccctgtctcaaaaaagaaaaaaaggagaaggacaaatcgggagcctacaataatttgagaaagatattcacactaaagatgggtaaaaaaatctaaaaggcttcaccacagcaagatttcacagagtttactgttttgccacttatgaaaaagggccgaagaaatcacttcagtgaattttaggaaataagataagtactcttccagtcaatactaattatgtatgtgtatcttccttgaagaggaaagtagaaaatgacatgctcgccctgtgcattagtttacaatacccaagttataaaggcaatgtaacagagattactaccatctcatacctcagagatagaacctcctccatctttattcccacaagaagatagcagggccttcaaagagagactgtgtatttcttcactgctacagattccatgattaataggaaaagaacaaatttttttgtctaagacactccctggaataatctaccttctacattaacatggggttaatttcagccttaaataggaataacacaggcatacctcattttatcacacttcactttatagtgctttgcagacattgcactgaagatttacatcatcgaacaagtctgtccataccatttttctaacaacacgtgttcactttgtgtctatgtgtgacattttggaattctcacaatatttcaaacttttggttattattatatctgttactgtggcctgtgatcagagatctttaatgttactactgtaattgttttggggtaccacaaaccatccccatataagaccacaaacttaatcaataaatgttgtgcgtgttctcactgctccgccgaccggcttattcccactgcctggctattcccctatctcttccctctcctcaggcctctgtattctctgacacaacaatattgaaattaggccaattaataactttacaatgacctataagtgaaaggacgagtcacacatctctcattttaaatcaaaagctagaaaaatgagtaagcttagtgagaaagaaatattgaaagctgatatagaccataagtcaggcctcttgcaccaaacagccaagttgtcaacacaagggagagttctgaaagaaaatgaaaagagctactcccatgaacacatgagtgataagaaagcacaacagtcttattgctaatctagagaaagtctgagtggcctggatatagaagatcaaaacagccacaatattcccttgagccaaagcctaatccagaggaaagccctaacttgcttcaattctgtgaaggctgagagaggggagaaaattgcagaagagaagctggaagttaacagaggttggttcataaggtttaaggaaagaagccatctccataacataaaagcacgaggtggccaggtgcggtggcttacgcccacaatctcagcactttggaaggccaaggcgggcagatcacctgaggtcaggagctcgagaccagcctggccaacatggtgaaaccctgtctctactaaaagtacaaaaaatttagctggccatggtggtgggcgcctgtagtcccagctactgaggaggctgaggcaggacaatcgcttgagcctaagaggcggaggttgcagtgagccaagctcacgccactgcaccccagcctgggtgacaaagcaagactccatctcaaaacatacatacatacataaatctaaaaaagtgcaaggtgaagcagcaagtgctgatatagaagctacagcaaatgatccaggagacctaactaaaataattgaatttggctacactaaacaacagatttttaatgtagatgaaacagccttatattggaagaagatgtcacttaggactttcatagctagagagaattcaatgcctggcttcaaagaacaagtggacttttttttagggactaatgcagctggtgactttaggttgaagccagtgttcatttaccattcctaaaatgccagggcccttactatttgtggtaaatcgactttgcctatgctttaccagtgggaggtcaaaacagcaacatgaaccggagttcagaagattcagaagaacttggttccaaccttcatggataacactgaggggtcaagacttcagtagaggaagtaagtgtagatgtgatagcaagaacgaaggagctggaatcaagatgaaaacctaggaaatacccttctacacatcagtcttggcaaagaatttatgatgagtcctcaaaagcaactgcaacaaaaacaaaattgacaagtggacctaattaaaataaagagcatctgcacagcaaaagaaacctgcaatggagtaaatagacaacttacagaatcgaagaaaatattcgcaaactatgcagccaacaaaggtctaatatccagaatctataaggaacttaagcaattcacaagtaaaaaacaaacaacctcattaaaaactggacaaagggccaccacagtggctcgcacctatataatcccagcacttggggaggcctaggtgggagaatttcttgagcccaggagtttgagaccagactgggaaacatgatgaaacttcgtctttccaaaaaaaaaaggaaaaaacacaaaaactagcggggcgtggtggcatgcacctgtggtcccagctactcgggaagctgaggtaggaggactgcttgagccccagaggttgaggctgcagtgcgccatgatcatgctactgcactccagcctggggcaacagagtgagaccctgtctcaaaaagtgaaaataaaaagtgcacaaaggacaagaacagacacttctcaaaagacaacatacaggtggccaaaaaacataggaaaaatgctctacgttactaatcatcagagaaatgcaaatcaaaaccacaatgagacaccatctcataacagtcagagtggctattattaaataaaaaaaaaacacatgctggtgaggctgcagagaaaagggaacacttatctactgttagtgggaatgtaatctagttcagccactgtggaaagcagtttggagatttctcaaagagttaccattcaacccagcaatcccactgttgggtatatatccaaaggaaaataaatcactctaccaaaaagatacatgtactcatacactcatcacagtgccattcacaacagcaaaggcatggaatcaatctaggtgcccattaacagcacaatggataaagaaaatgtgatacataaacactatgaaataccatgcaaccattaaaaagagtgaaatcatgtcttttggagcaacatgaatgcagttggagggcattatcctaagtgaattaacataaaaacagaaaaccaaataccacaggtttttactcacaactgagagctacatattgggtggacatggacacaaagatgggaatagcagacactggggaatacgagggggaggtaagaagcagggagtgggcaagagatgaaaagctagctactgggtaccatgctcactacctcggtgatgggatccatcataccccaaacctcagcatcatgcaatatacccatgtaacaaatctgcacatgtaccccctgaatctaaaataaaagcaaaactttttttaaaacagagagaagtagagcctaaagaattataaattaactgattaaaaattaactgattttctgcaatctcatgataaaacttgaaaagatgaggagttgcttcttatgaatgaacaaagaaggtggtttcttgagatggaacctactcctggtgaagaagctgtgaggcatcatatgttacagtgaaatcatttgcgaaaggaagaggcaatcaatgcggcaaattcgactgttgtcttattttaagaaattgccacagccaccccaaagttcagcaaccaccacttgattagtcagcagccatcaacatccaccagcgaaaagatgatgatgcactgaagggtctaatgatccttagcagttttagaaatatattttttaattaaagtatgtacattgttctgttggcataatgctactgaacacttaatagactacggtataatgtaaacataacttttatatttactgggaagccaaaaaatttgtgagactcattttattgcaatatttgctttattgtggtagtctgaaactgaacctgcaacatctctgaggtataccggaaaatgcaattgcatatgtttatttaaccaaaacccagctatatttcatgagttttatactcacaagtttgaagacaactctgccaagaagtcgaacggagtctggaggatatctgggtttgcagcttttaaggcatttgcattcccgcttgtggtctggccaagcttttttctattaaaacaagagtggggagaacataggtgacctaaaatttaactttcatttatactggttttgaacatcaagagtcataaacattaaattttaatagtccaaatgtaactgcacaatagaaaataaaagcaatattctaaatctgaaaataatccaggatgagtctttgccaaatatgcaattactatgcaaggacattaaaagcctcagcttcacctctgtgctttcatttgtcccctggttattacctggctagtggagtccaaagaaagagccattacagcttacttaataatgtataagatggtcttggaactgattaaacaggattcaacaatagtcattttgaatacaaaaggaaaatgtcactccaaattagaaaataaaacgtggttcagaagactcaaaatagggatgacagccttctgaatttctgtgctgctacagaaatatcaggagggctaacacacccccaaatataaaatctctttgttttaaaagcaacataaaaagaactattagctaaaatcattaaatgtccagtttgtcctggatgtgtctaggtttgtatctatgtcctggcttaaatattaatagtgccccttttcactctgaaaagttctggttttgatgacaaattatatggtcacctaagccatgatcctagccatgtgttgatgtggctaaagagaccattgagtcagttgccaatgtacagatgaatggactaaagggaaggacactatccttgagccttggatcagaaaggcgacggctcctttcacacggaatcactttcatatggaaataaaatccagatcatctaatatttagccctggtgagtagaagaagcctcaatcaaatgtctctcgtgttatattctgaaaattggaatttccattactgaaatgcctgataccacttactcattcttatttcaaaaattataaatctgctcctcaatttctgggtctacaaaatcaatgtgctgttcataatttttgttttagcatttacacttcactcacttctaaacaagactgagctgattcaaagtaaagatgtgtatgaaataagactgcaaaaccagaaacagaacatattaaaattatggaagggggaaaaaggaaagcacgctagcatttacttagcattctacaaggtactagatacatggctaagcaaataacgaagcacgtttcacttgattttcgtaacaatccaaatggtaggtattatccctctattacaaataaaggctcaaaagctgatatctaactatcaaactgcccaaatacaaaaagagagagtaaaaattcttagcatgctaaacatgagagctgaataatttctgcattacatttgagtatttgtacgtcacatttatttgagatgccttacaagcaaggcaaaaaagaaggcataatggcttatataatcctcaactgacagaaagtaaaaacatacagtttcaccaagtattaaatcacaggagggatttattccaagaatgctaatcaacacactgaacaatgtccttaacaacagttcacaactataatggcctttcatatgacttctaatatcagtactcactgaaaggcataatattaaaatacaactcagtgaaagaacaagcttctgttgctcagggggctagtccttgactagcaattagcaattaccaatgtgtgtaagaggcctaaaatatacatggtacaattgtcaagtaagttttaaaaacacaatatcatgttgaccctacttagagattcaaaatatacttagcatcctaaaagttctaaaagtctatgcactaaagaaatgtgtataaattatttaacacagtttcccatgcttgttattgtcaccctttagagagttaggttggtattcactaactcagatatatctatatattttttttcacctggtctttgtatgtgagtgggttaagctaacaaatttacattcatttgcactcacaagaaacaagaatgttaacttttttggttttttactgatagaagggagaaccataactttggcgttagttttcctttgattatagaagttgagaaacctgtcagatgctctcatggacagagcgtgtaggcaggaacggataacatagtgccagtgggtctatcagaaagtaccttaggctctgttcaaatgcctcagtgtccagctgaacagggctcacactcagcaaaacaaggcagagataatttgaggcaaaagaccttaagagcagattttaatcaatgctcattttaattacaagagatcatccataacccctctgttaaaacctaaatatttgagcagctcagcctcctgatagcttaccagggtgagataagtacaaaacgtacaccagataatgaacaaccgatcagttagatgacagcatttggaattaaacatccaaattttggaaaattcctgttaaaacaactttaggtccttaacataattgatatagagctccttttctcaacaataactagaaactagacaaaatgtttcttaaacttattcctagatcattgcctgaaaacatacttattttctcatttgcttcagcaaaaatatgttcattatttccatgaaaagccaaatcagatcatttaggcataaatagagaaagcaatcataccacttaaaattggtctgtaatatggtaccacatatcagcccattccttttctttttaaaacattaactgttaaaatttatcattcagcttcacctatcacatcttaccataagggttacgaatacaagcataccatagaaaaggcttacaaagaaatctttttacgcagctcctttgactttgaagcaaaacgtgacaatcatacaaaaacaaaaggcattatcttcactcaacaaactaaccttggtcaagacctcgatgacacatttgtcatatatatttgccaatttctcaaaagacaaccttcctgatttacattttttcctattttcttacattacttccaatacaggatataattaagattttgctcataacattggctgtagtattttcttttgtcatagctgaaaattaacaatgatgtacaataagcatgaactggcttgagagacaaaggaaattaaaatactacattaagaagtaaaaacaaaaggagacaagagtttcatgctggaaaaaaaggaaatgacatctataacacaattctttcagtgcatgcatgactcaaaaaacaacttcagaatctatacagtttcataatgtatttttatagtatttataacagttcacgacataaactcattaaccacaccagtagttctcaatgggagtgacgcctatcttgagggttgtttgagaaatttatgcgggtatttttatttgtcacaaggtttatggaaaattacaggcacttaatgagcaggaaccaaaggagccagacattctgtgtcggacagttctccacaatgaagaattatccaaatccaatgcaactttcaagtgtccaaccaaattccatgacggtggaaaacttgtttataattgtctgagcctagaactaaatctccttttacatttaaaaacaaagagctcgtttttacataatcctaacagcactgaattttctaggtaaatcaaaggaagactgtattttaagaattttacctaaattactcaattaaagccatatcactgaaggcaacaccacttagagtacttgagttaccaatacaacacggcttctgacccgcatctctacttcccttctcacagtgactctatgtataggtgcaaatatgtgactaatgatgtcttccagtctaatacctcagcatttatatactaaaatacatattattttatcataggttttaattttctttttccttatattccaattatggcattatattaatgttttgaaaatatgtaactaggtatattgcactacctgtaaaatttcatttcaagatagtagagagggcaataaaaatagttctcacaaaaatggggagttgggtctgaaaagaactgagaagcccagatctaaaaaaatgctacacagttacacatgccacacacatacacaagaatatatttttaaacacatagcctaacacccaccctagggattctgacactacccatgagacagaatcaagcatcccactgcagggctgctatggtttcaatgtgtacctcaaagttcatgtgctggaaacgtaatccccagtgcaacatgttgagaggtggggtcgttcagtagcacagcgctcacgaacggattcatgtcactattgcaacagtgggtttgctataaaagagagtccggccctctcttgttccctctcaggagcacgctcccgtcatgtgacgccttctgccatgctaggatgcagcaagaaggcccttacagatgtaatccctcaaccttggacttcccggcctccagaaacaccagccaaataaacttctattgtttatgaatgacccagtctgcggcactctgttaatagcagcacaaaaacagatcaagacaagggcattccatgagtagctaaagttgaaaaaccactgagttaaactaaattacaaaggaggtcgttatatatactaaatagatgaaacaaaatacaattctataattatcattgaactattgttctatagaaataaatattgtataatattaaggtggaaaaagtgttttaaacagaacataaaatgtaaaaaccataaaggaaaataaatatatattcaattacataacaataaagaatttttgtcttgggggaagaaaaccagaaacaaggtttaaaggtaataaaccatgaaacagtctaaaatacatatatagacacagtgttaaatgtctccaatatacaaaaaggccttacaaataacttttgaatatttcaaaaaatataaataaaggtaaaggaaatgaataggaaattcatgactgaaaaagaaaaaccaatagacaactaatacaaaccacaccagtgctcaaagacatgataacagaaactagataacatagtgtcccattaatttggcaaaaatgaataaaactggcagtatttagaagcatctaggatttggggaaataggcattttccagccttgttagtagagttgtaggctgctctgatctttctgatgggtatttggtaatgaatatcaaaattgtaatgtgcatattgttgacacagaaatattattcataaagtaatttattttaaaaaatttaaatagtataaagaaataaatttaagaatgttccaccctaagcaacatagggaaatcccatctctataaaaaaaaattttttttagttagccagacatgatggcatgcacctgtattcccagccacaccagaggctaagaggagaggatcactcccagctatgctggaggctaagatgggaggtcgagactacagtgagccatggtcacaccactgcattccagtctgtgtgacagagtgagaccccaggtctcagggggaaaaaaaaaagaatgctcacaatagaagatgattaaaatactgaaagttaacttttccagcttttcctaaaagaaattgctatttttgtctttctctttatagctttccattactatttaaattttctacaaagagcatggagtttatgaataaaaacaaatataattttatgtgtagtaactgagaatcagggagaagtacttttatacgaaagggacagcaaaattactgtttaataggcactggtgcttcttaactttttaatgtttattttggaaatctagttgcaactcaaagcatgatttaaatgtgttaatttttaaatgttaaaaaatgcttcagtgaactgttctgtaatgctgatgcaatcttttttaattcagagattcactcagtaaattcttttattagtttggctatattcatgtctgtttttcttaaatgagtatagtaccaattaagtacaccttgcatgaaacaggtgttcaatacatattttatgatttattctaaaaccagtaccattcagggggtaaaatttactatatattatcattatttgaaattaaggccatacaaaaagaagaaatgaaagtagactctcacaattctttctttgaccaataagagatggtcttgattacatgattatgaaaggagtgtattgatgagatgttacactaataagagaaaatcaatttatttctttcttacgcaaaataacatttgcactattatcatatttccctctcctctttacatacaaagtccctattgctcactcaagaacccatttaaatgctgttaaacaccaagttttggttggagtggatatccattttagggtagctcattattgtttgggatagagtgtaagaagggtcatcctgtattgaaccttggattgggtaaaatacatccaattcatgacatcagctcactaggtatttattccataagaagattagattcaaagatctgcaaggcagtcttccaatgataaaattctgagtctgtaacatccattcctaacaaatatctgaattatgtcaaaataggtttgaaacctgcttgggttaggcttacaatcattgaaaatttgcaacagtattttcctcagctatttggtcattaaggatgaagaagctgtctttaaaaatatagaaaagaaaatgaattttttgagcccacttattcaacagtttcatataatattaactaaacatcttctacgtgaaatatcacagtgatttttttcctacatattcaggacttactccactcacaaacaatcatctacagaggtttcctatgggcaaaacttaggatagttgagctgccacgcaacttgcaggaaataaaagatactcgacagttttccatttacatccagtttgcttgatagcaaataaataatgcctcctcctttatccttgaaatgtagtccaatattgaattacagattgtcagatgcaggcagatctgaaaagctggaatctgggaaaagaaaactggaaggctaagcaggttgtctaacagctacagttgactgacaggtattgattaagatcttgcaaaaaaatctctttagagcacactagagattagtgatagatatgagacttctcactttaaaagcttactgaatgctgtatcaaatgtagagcaagagcatcttctcactagtcttaatcaaattagatgaatagagctaaatataaagaaggaatgtgccatgaaaatggtcttagggcataaggttgacaagaggaaaaaaagaacgtgaataaatgaccatttcttgggcaaatgggaattacggtctcctgttaagtgaggaacctataatatgagacaataataacaacagtgcccccaaagtaagtcaatcatcatctactgcagggttccaaaaatatatggctcataggtaaaattcattttacatttttacatttatgtaaaattcaaattcatgtacgttctaattcgtgctacatttttagtaaaattgtacattacagggatagagccacacttattagttacattcattcatttcatgctacatcagagttgaacacatacgacaaaaatcatatggccacaaagcctaaaatatttactatatagttctttacagaaattagccaatgcttgatctaatgagagatcatatgaagacgaaatgacttaattgatagtttggctggaaagcaaaataaatcatgcacttccacagacttccaatcttatttggaaaaagcatctatcctagattaatcaaaatatcaacaccagcttctagctgaatacggtaggtgagcacatgtattttatttcctcaaaacaagtaattatcaaattttttactcccaaagtgaactggaacagccatcaatggatgagtggcagggaaggatgtggttagccccatttgagagtgaaaaagtggtggtaagaggacaggctgcagaagcagggtcaaagaggccacatgtagggacagtcccatctgagagggaaggtcagcctgccaagcagaattccagaaaggatctagaatcaaagactatacattggtagaatggaattgaaaaatagatgagaaagagaaaattaaccacaagtctgtatgccaaagagtctcaaaacaccccttctctacttttggcttgattgagtaagcaatggaaggttaatgtacagaatcttgttgaatttgatgctaagattatctctgatccagattattgctatagcctcctatttggtcttcctgccctgactcttacccttctacaacggcttcttcaaacaatagtctaattctttgagtggcttaaaaattgtgatcactgtattacagaaaaagaaataaaatctatgcatacttaatagctctgtggtgaccaatatgtttcaaactacttacttgaaatataatttacattattaaattatatttaggttggtgcaaaagtaattacttttaatggcaaaaaccacagttacgtataataaaatgtatccattttaacagtatagtttgataaatttttgtttttttgagatggggtcttgctatattgtccaggctggtctctaactcatgagttcaaacaatcctcccaccttagcctcccaaagtgctgggattacatgcacgtgccaccacacccagctttgataagttatgacacatatatctccatataaccaacaccaaaattaagctacagatgttagtactccccaaaagttcccttgtgccccttacattcaagtcctccatcccaggcaactcagtggttttgtctctataattgtaagatcagttttgtctagcctagaacagtcttacttcttttcatctggcttcattccctcagtacagtgttttgagattcactaacgttgcggcatgcatcagtagtttgttcctcttaatggacaagtaatagtacagtatgcatctctttattcatttacctgtggatgaatatttcacttgtttccaggtttggaacattgaacatttatgtacaagttgtttttgtagatgtaagttttcataactcttaggtaaataactaggagcagaactgctgggtcatacagtaagtacacctttaacattattacaaactactaaactttcccaaaacaatgataacgctttactttctcaccaccagtgaacaagagttccagttgctccatcaccttgccagcacttgacaaagtcagtccttttaattttagtctttctagtgggtgtgtagtaatatctcattatggttttaattttcatttatctggtgaccagtgacaatgattatcttttaatgtatatcttcttaaagtatctattcaaatcttttacctgttttactcagttttcttactactgaattataagtattctttataaattctggaaacaacttcttggttggggtgagagagagagaaggagggagagaaagagaaaaggagggaaacagggggaaagagaggtctcaaatattttctccatgtctgtagtttgtctttccaaggagctgaagggtttaattttgatgaaaatcaatttatcaatttttcttggaggcttagtgctttctgtgttctacataggaaattttatgtaccccatatccaaagagtttctcctatgttttctcggttttatagttttagcctttaagtttaagcttattgaacctaaatcttattaaatctagtgaagaattgtttttacttttatcatttattttccatgtgcatattagcacaattttttgaaaagatcatcctttcattattgaattatgttggcacctttgttgaaaatcaactggccatatatgtgtagggctatagtttttatatttttatttctgaatacaggttgagtatgccttatttgaaatacctgggaccagaagtgcttcaggttttggatttctttggattttgaaatgtttgcgttatacttactggctgaaccatcccaaacctaaaaatccaaaatccaaaatactccaatgagcatttcctttgggtatcatgctggtgcttaaaatgttttggattttggagcgctgcagattttttgatttgggatgctcaacttgtattatgatgtgttgacattttaaaaacctttctgactaaggagaagactgctcctgctcctcccagggacagccaattctaagaaatagcaaaaagctcaatcctgagcatgcctttgataggcaaactaaatgatccacagccatacatcctctgtctggccctaacaccctaagaggcaatattcttctgccttaatcatcccagggccaggtaccaggcaaacagagaccacccttaaaccccaggatcccctgatattactcaaactagccaatcctaaactgagaaacacctatgaatgccacagtccagggacaaaggctcaccaaaaacccaagacctaatcatagaactatagaactggccgggcacagtggctcacgcctgtaatcccagcactgtgggaggccaaggggggtggatcaagaggtcaggagatcgagaccatcctggctaacacggtaacaccccatctctactaaaaatacaaaaaattagccgggcgtggtggcgggcacctgtagtcccagctcctcgggaggctgaggcaggagaatggcgtgaatccgggaggcggagcttgcagtgagccgagacgttctactgcactccagtctgggcgacagagtgagactctgtctcaaaaaaaacaaacaaactaaaaaagaactacagaacagttcctctcctcttacatcttgccatcacactactaaaggcctatttacagtggttccttttacatcacgtctagctatcaagaaaaaactataagacatactgtattagtacattcttatgctgctatgaaaaaatactcaatactgggtaatttataaaggaagacgtttaattgactcacagttccacagggctgtggaggaaacttataatcgtagtggaaggggaagcaaacacatccttcttcatatggcagcaggatggagaagtgcccagcaaagcaggaagccccttataaaaccatccaatcttgtgagaactaactcactatcaagagaacaggatgggggatactgcccccacgattcaattatctccacctggtcctggtccctaccgcgacacatggggattatgggaaccacaattcaagaggagatctgggtggggacacaaccaaactatgtcacatactaaaaggcaaaaaaacatagtttgaagagacagagcgagcattagtaccagactcagatatggcaaggatgttggaattatcagactaggaattttaaaaaactataattaatatgctaaggattccagtggaaaaggagacagcatgcaagaacagacaggggatataggcatagaaacagaaattctaaaaaccaagaagaactgctagatcaaaaacaccaacaaaaataaagaatgcctttgatatcttattggcagactggacgtagctggagagaagaatctctgagctgaaattatctcaatatggtaaccaccaacattaagaagcaaagacaaaaaaagactttataaaaaaaaaacagaatatccaagaactgtggaatgattatataaaggtataagatatgtgtaataggatatgtcagaagaagaataaagagagaatggaacagaagaaatacttgaagtaataatgactgagaagttctcccagattaatgccaggcaccaaaccacagatccaggaaactcagagaacaccaagaaggataaaagtccaaaaatctatacttaggcatgtcattttcaaactacagaaaatcaaaagttttttaaaatactgagagaagccagatttttatagctaaagataagtatatgtctgttttaggtgtttatagatactgaaatggtttcagtaatatgtcattttctgaaaatctcaaaacacttgaaaggtgtgtgcaatggtttgaaggtctgtaccctccaaaactcatgttgaactttaattaccattatatcagtgttaagaggtgggaccattaagaggtgactcagccatgaaggctctgtcctcatgggcaggattaattccagtatttgatgccctcttgtctcctggcccttccaccatgtgatgtcacagcaagaaggccctcactacatatagccatcttaatatagaacttccaggcctccagaaatgtgagtcaacaaatttccgctcttcacttatacactgatggtgggaatgtaaattagttcagccactgtggagacagtttggagacttgaactaagtcttgaactaccatgtgacccagcaattccattactgggtatatacccaaaggaagataagtcattctaccaaaaagacacatgtacccatatgtctctccctgcgctgttcacaatagcaaagacagggaatcaatctaggtgcccatcattggtggactgaataaagaaaacgttatatatatatatatatacacacacaccatcaaatactatgaagccataaaaaagaataaaatcatgcccttgggccgggcgcattggctcatgcctgtaatcccagcactttgggaggccaaggcaggtggattgcctgaggtcagcagttcgagaccagcctggccaacatggtgaaaccctgtctctactaaaaatacaaaaattagccagacatggtggcaggtgcctgtaatcccagctactcaggaggctgaggcacgagaattacttgagcgtggaaggcagaggttttagtgagcctagatcgtgccactgcactccagcctgggtgccagagcaagactctgtctcggaaaaaaaaatatatatatatatgtcttttgcaacaaaatggatgcagctggaggccattatcctaagcaaagtagcacagaaacaggaaatcaaatacagtatgttctcacttacaagtgggagctaaaattgggtacacaagtgtataaatatgggaacaacagacattggagaatataaggaaggggaaggaggaggaggtgcaagggttgaaaaactaccttttgagtactatgcttactttttgggtgacaggttcaatcatactcgaaacctcaggatcacacagtatacctttgtagaaaacccgcacatgtacccccagaatctaaaataaatgttgaaaacaaattaaataaatttgaaacaataaaaataaatttttttctttataaattactcagtgtcagttattctattatagcagcacaaaacagactaaaataaacaacttacatatagaggaacaaagaatcatagccaacttctcagaaaccatgtacaagagagtggaatgaaataaagtactgagagaaaaaaaaattactaatctagaattctgtaccctgtggaattacccttcaaaagtgaagggaaaataaagactttttcaggaaaacaaaagttgaggaaatgtattgccagtagacccacccgcatgaaatgttaaaagaaattctgtagagagaaggaaaattataaaggttagaaacttagatctacataaagaaagaatgagaatcaaagaaggaataggtgaaggtaaaataaaaactttcatttttcttattcttaattgatctaacagataatagtttgttcaaaagactgctaatagcatcaatgtatttaattatgtatgtttatgtataagctaaataaatgacataagagagggagcaggggccgggcacagtggctcaggcctgtaatcccagcactttgggaggctgaggcaggtgtactgcctgagcttaggagttcgagaccagcctgggcaacatagtgaaatcccatccccacacaaaatacaaaaagtagccaggcatggtagtgcacgcctgtagtcccagctatttgaggaggtgctgaggaaggaggatgagttgaactgaggaggtcaagtctgcagtgaggggtgttcaggccactgcactccagcctgggtgacagagagagatcccatttctaaaacaattttttttaaagagagggagcaggaattaaaagtattttgttattctaaggtactcattctacctgtaaagtggtaaagtgttatttgagagtaaacttggattcgtcgtaaatgtatattgcaaactctggggcaatcactaaaaaaggagatatatctatatctgatgttctaatgaagagaaaagaaatcatacaaaaggctcaactgaaaccacaaaaggcaaaaaatagtgaaagacaacaatcagaacaaataacaagggcaacaaatagaaaacagatacgataaatattaacccaactatatcaataatcactttgaatatcaatgatctaaatgcatcaattaaaagacaggaatggtcgcagtggatcaagacacaaaacccaaccatatgtcatccacaagaaacccattttacatataaatagattaaatgtacatggatggagaaagatataccgtgctaacactaatcaaaagaaaagcagaaagagctacattaattctagatttcaggttaaatgtcacctctacaggaaacccttctgtatccacctactcacaggtgagtttgtgctcaccccaatcacattcaatcatataatcatgggcatttgtcactgtctctctactccataacagaagctttatcaaagtcaggaccttatttacttgctcactgcctattacttatcataccaaccaccaggacttagagcataataatcactctaactcctgtgtagaaaataaattagaagttggaaagaatcgtagttaacaatgcagctaatccagaaaagagaccatggtaacaggtagtactaaagaagctgacgagaagggaaccaattcagatctttaggtagtaaaatagtaaaatcagcacgacatgatgactaaatggatctgtcgccaagaaaggatgagaatcggagatgacacctggcaactcagactgctgggtggctggtgaaactgttcactgaggctggaaaacatgaagggaagtgggtctgggggaagataatgtactcagatttacacgttacaccagagacgcctgtgcaacagccaagtggaaatcaggagaaaggaggctggagacggagtcttgagaaggattaatatacagatgccacttgaagtcataggagcagataacatcacacagcaggcaaaggtaaagtgggaaaagaaaaacttccggctccagacacctgtggaggtcaaaaactgaaatacgaccaaatcgttttaaacttcatgtagtactccctttgtgttgacagttagatacaaagctgacttatctacagtacattccgtgcaaagcctatcagtttcaggccgaatttatgaagtaaacaaagcttgacttccttcattatcactgctttggttatggtagtctaagaaccagcctattaaatcactctgttaagtgcttactaatgtgggattaattttctacccatcgaatatgaatcaaatcattccacaactaagcataaaatgtaaacccaaaaatacgattcacatttttaaagaggtctataattatcaatataaaatagagcttgtatctgctaatacagtgcttttaaaaagtatataaattacaatttgatggagtgcctaactccttattttgctcagcaattaattcattcaactagaaatgtatatattatcaatcatattaaatcctcaaaaggtaaaataatacttggtgaattacttgaaattgacttacttgctatcaccactgctgccattttttgttttgaaaatgcttttttataagaaattttagcctgctcctcctctttgatctcataatcatgtgtgatgttctgtttatagcaatagagaaaaaagactggacctccttctatgaaattatatgatagacacctgataataaggtatagaccagaatataaagccagtgatgacaaaaatattttgaccagtaacagaaacagtactgtacacaggagtaaatacatatgtcgatgtgtacgctatatatgatgcataaaccaatagtttggtgtatatcctccatccataaaatagacacatatggattatctctgaaaaacagaagtagaagcgggggaaggaagctggggaaagacttttatgttttaccctgtatgattctatatggtgtttttataataaaaacatatccttgtattgcttatgtttaaaaatgaaatgtgcaccagatgcggtggctcacggctataatcccagcactttgggaggccaaggctggcagactgcctgagatcaggagcttgagagcagcctggtcaacatgatgaaaccccacctctactaaaatagaaaaaattagctgggcgtggtggcacatgcctgtagtcccaactacctggggaggctgaggcccaagaattgcttgaacctgggaggtggaggttgcagggagctgagacggcaccactgcaccccagcctgggcagcagactaagactctgtctcaaaaaaaaaaaaaaaaaaaaaaaaaaacataaagaaagaaatgtgaataccaatagcactgacaccatcctgtgggcacaaggtacatgttacacctgcaataccccaatagcctctctcagacaacttgatgccatggtcccacacatcaaatgctaagctagtgaaccaaaatcatgtccccctggggtatacatattatggattttatactacagatttacatcctctgtttcaatttccattccaagtgcttttgcgttctgttcatcactgttcacagttcagtatgtcatttaattttgcgtagttttgtgggtatccacaataattacaatgtttaatgttgtattttaaggttgagataaacacagcagtttaaacgcatatgttctggccaatctttaactccccctccacacacacaaacacatactctagctgttattacatatatccttcatcttgctagctgttttcctgttaccttccacagtatatctgacagtgacattgttattgatgccacagtaaacagctaatatatgtagtaaaaacacatgcactacaggtaatcaaaatgacatacccacccaccaaactcctgctactcattctaatcagataatggcttttctcttccctgagtgtactacaaaaggatgatgtggcactagaggaaaaatagtcacaaaacaggggaaaaaaatgttttattaagtaaactgtttattaagtgttttattaataaactgtttaggtcattgagattagaaagcaagtttgcctagacttgtgtcaaataatatgataatctgtcgcttctctatgtactctgtttaatctgaagttcctagaaacaaatagctgagcttcacgtgaataaaacacctagaacatcaccataaaccaagctttctggaacgaatactgtataaaaagcagtattaatgtttcactttttgcttttagttactcttgttggtaacaatcttacataaatcagggatctttctagcttcgacaaaacttttgtttaaaaaatgaggtagaaataatattattgttttgaaatttcctatcctattttaattagaaagtgttatactggctgggcacagtggctgacacctataatcccagcactttgggaggccaaagcaggaggatcactagagctcaggagtttaacatcagcctgggcaaacagtgagatctcgtctccattaaaatttttttttaaattacctggccatggtggcacgtacctgtagtcccagtggctcaggaggcagaggcagggagaccgcttgaacccaggatttcaagactgcagtgaacttgataacaccactgcactccagtccaagagacaaagcaagactgtccccaaataaaaacccaaaagccaagaaacaaaagaataatacaatatataatggaaaactagacctaatcagaatgttagagcaagaacagaatttaggtttaaaagagcagttaaaagtctgaatacctgggtttcattcctgaaacttcagagcctactagttacagaatatttggcaagttggctgtctctctgtcctcattgtccttattaataaaataaaaataataatagtacctaattctcacaagactcttggaaaatcaaatggaataatacagtgcctggcacacagtggatgcctaataaatattaactcttattgttagtacagattcagaaactgaggcccacacagtgtgtgttttccctgagataatttaaccagcaaatgccagaattagcatgagaacctggaacccctgatatttttgaacttttgatttcttttccattaagaccactttttgtgtcgtctcaaattactttcaaaggataaaatgagagagaagaaaacccctgagacaagcatggcctaaatttaaaagaaggaaagaagaaactctggaggtgtgtgtgcatatacaaaacataagaaacaaaaaggatgagtggagggtggcagggaggaggcaagtgacatagacacaaaacctctaattagacttttaataagatgtaactcattaggacataattacatttcttattaaatgattaatcataaggttagaagaaaaggtcatgctgaatgttaattatacatcctttcaagaatttcaaagatgttaacaacagtactcgtaaattaactcaaactcttggcaggatatttggcattatctttaaaaattcaaaaggcatatatcctttcaacaatcaatacaataagaatttatcctactaataatttggggaagtgtgcaaaatgtgcaaaacaggatgtgaagtgcattattggcaataccaaatattagaaaagtgccaagcattcattaacaaagaaattattattatggtcaattcatacaatgaaacatatgggatacaaaatgttccccaaagtagatcgttaaatgaaaaaaaaaaagtacacaagaattcatgccagattaaactatatctttttttttttaaacataggatgtagatacacaaatatgtctgcacaagcaaatgctgcaaagacacatgagaaacttaacagtgattgcctgtggaaatgagaattgaagtcggggggcaataagatggggaggaatagacatttactttcacatagtagacatatacacacacacacccaatttttaaccatatatatttaacatcagttttaacattttaatgtccctggcaacctgtgtgactcagcaggtgaataacaagtaaaagtaaattaaaggctgtaaagaagtagacacaggccaacaggtatagtgaaggacaaatttaagagtaaagaatttgaaagcttcacttatatatggctgaaaagtcttacctgacacttagcactacagtatttggcgacgcggcactgagagcatcgcatcagcttttccttcctgtggggaaaaaaattaattctgcattaagaaatgagtgggaaacatagtacatagttgaagaaagaaaacataagtcaacatacggacacccgtatgttctgtttactccattatgtacagtcccttaagatttggattttcacactgatgagcctcctcttgaaccttccatgtgagacactgatagaaaaactaagtccttttgtctgacagaagatggcggggaagaggcaggaccagcttgcagctcccgatcggacagacagagcagcgtgtggggactcacactgtgaacttttgatccaacaactgccacagcaacataccaggtaaactaagagaatccacagaccctctgaaggaactgtatcgccactgcaggctccctgagactctgaaaagatgtgagctgcctgcttgctcagcagggaggctggcggtctggggcaagttctcagccacagtcaccagctgcctggaaacagactccgtgctgctgtgggggcacggtgggagtgagaccagcctttaggactgcgggctgtgtgggagtgggatgaggcctgtgactgctggctttcccccacttctctggcagcctgtgtgacccagcagaagcagccataatcaccctgggaacataactccattagactgaaaaccacatccccatcccaacagcagccgcagcaatccccagccaaggagaatctgagctcagacacacctatccctgccccctggtggtctttctctaccagccctgggtgccaaagacaaaggccataatctcttgggagctctatggccctgcctaccacctaagaaacctgaataggtaaccaggcgaccttagggcaagtttgcttcctccctgtaggaccacagctgatgtgttcctgaaagcaccaactcctggctggaggccaaccaacacaaaaccagcacactaaacaaaaatacaaccaagggcccttgtagagtccacttcacgcccctgctacctccatcagatcacaggactcttagcagtcactccccagtaccagcccagagcccagtacctccactgggtggctagacccagaagagcaaaaacaatcactgcagtttggctcttgggaagctccatccctgggggaggagggagaacaccacatcaagggagaaccccttggaacaaaagtatctgaacagcagcccttgagtcccatgtctcccctctgacacagtcacccaaatgagaaggaaccagaaaaacaattctggtaatatgacaaaacaagctctttaacaccccccaaaagatcacaccggctcaccagcaatggatccaaaccaagataaaatatccggattgcaagaaaaagaattcagaaggttaattattaagctaatcaaggaggcaccagagaaaagtgaactccaacttaaagaaatcgaaaacctgatacagaatatgaaaggaaaattcttcagtgaaatagcataaataaaaaatgatcacaacttctagaaatcaaagaaacacttagagaaatgcaaaatgcactggaaagtctcagcaacagaatcgaacaagcagaaaaaagtacttctgagcttgaagacaagtcttttgagttaacccaatccatcaaagacaaagaaaaaagaatttttaaaaatgagccaagcatccaagaagtttggaactatgttaagcatgcaaatctaagaataattggtgttcccaagacaaaaaaaagaaatctaaaagtttggaaacattatttgagggaataatcaaggaaaacttgtctgaccttgctagagatctagacatccaaatacaagctcaaagaacacctgggaaactcatcacttagacacacagtcaagaggttatccaaagcaaagatgaaggaaagactcttaagagctgtgaggcaaaagcatcaggtagcctataaaagaaaacctatcagagcaacagcagatttctgagcagaaactgtcagaggcatgcatgtgaaccagggcaactctatcttgaataggagctgagttaaatgaggctaagacttactgtgctgcattcccagacagttagggcattctaagtcacaggatgagactggaagtcggcacacaatacaggtcataagtaccctgctgataaaacaggttgcagtaaggaagcctgctaaaactcaccaaaaccaagatagtgataagagtgaccagaggtcactggtggtcctcactgttacactcccatcagtgccatgacagtttacaaatgccatggcaacgtcaggaagttaccctatatggtcaaaaaaggggaggcatggataattcaccccttgtttagcatataatcaagaaataaccataaacatggacaaccagcaggcctcggggctgctctatggagtagccattcttttgttcctttactttcctaataaacttgctttcactttactctatggactcaccctgaattatttcttgcatgatatctatgaaccccctctgtaacaaaaccctataagctagaagggattggggtcctatttttagcctccttaaacaaaacaattatcagccaagaattttgtatgcagcaaaactaagcttcataaatgaagtaagatacagtcttttaagacaaatgctgagagaattcgccactaccaagccagcactacaagaactgccaaaaggaactctaaatcttgaaacaaatcctcgaaatacaccaaaatagaacctccttaaaacagaaatttcacaggacctacataacaataacacaataaaaaaaacacaaggtattcagacaacaaacagcacaatgaatggaatagtacctcacatctcaatactaacattgactgtaaatgacctaaatactccacttaaaagatatggaatggcagaatggataagaattcaccaactaaatttctgctgtcttcaggagactcacctaacacataaggactcacataaacttaaggtaaaggggtggaaaatgacattccatgcaaatgggcaccaaaagtaagcaggagtagctattcttatagacaaaacagactttaaagcaaaagcagttaaacaaaacaaggagggacattatataacaataaaaggactagtccaacagtaaaatatcacaatccaaaatatatatgcacctaacactggagctcccaaatttataaaacaattactaatagacctaagaaatgagatagacggcaacacaataatagtgggggattttattattccactgtcagcactagataggtcatcaagacagaaagtcaacaaagaaacaatggacttaaactataccctagaacaaatggacttaacagatatttacagaacattctactcaacaactgcagaatgtacattctattcatcagcacatggaaaattctccaagatagaacatatgatagggcacaaaacaagtctcagtaaatttaagaaaatcgaaattatatcaagtactctctcagaccacagtggaataaaattggaaattaactccaaaaggaaccctcaaaaccatgcaaatatatggaaattaaataacctgctcctggatgattgttgggtcaacaatgaaatcaagatggaaatttaaaaagtctttgaactgaacaataacagtgacacaacttatcaaaacctctggaatacagcaaaagcggtgctaagcagaaagttcggagcattaaatgcctacatcgaaaagcctgaaggagcacaaatagacaatctaaggctacacctcacaaaactggagaaacaagaacaatccaaacccaaatgcagcagaagaaaagaaataacaaagatcagagaagaactaaatgaaattgaaacaaacaaaaaaaatgcaaaagataaatgaaacaaaaggctggttttgaaaagataaataaaactgatagaccattagcaagattaaccaagaaaagaagagagaagatccaaataagctcaactggaaatgaaatgggaaatattactgataccacagaaatacaaaagtttattcaaggctactatgaacacctttatgtgcctaaactagaaaacctagaggggatggataaattcctggaaatatacaaccctccaaaattaaaccaggaagatatagaaactctgaacagaccaataacaagcagcaagactgaaatagtaattctttaaaaattgccaacaagaaaagtctaggaccataaggattcacagctgaattctgtcagacattcaaagaggaaccagtatcaatcctattgacactattccagaggatagagaaaaagggaatcctccttaaatcattctctgaagccagtatcaccctagtacaaaaaccagggaaggagttaacaaaaaattaaaactacagaccaatattcctgatgacacagatgcaaaattcctcaacaaaatacaagctaactgaatccagcagcacatcaaaaagataattcatcatgatcaagcgggtttcataccagggatgcacggatggcttaacatccataactcaaatgtgatatgccacataaacagaattaaaaacaagaatcacatgatcatctcaatagatgcagaaaaagcatttgacaaaattcagcattcctttatgattaaaaccctcagcaaaatcggcatagaagggatacaccttaaggtaatgaaagctatctaagacaaacccacagccaacattacactgaacagggaaaagttgaaatcattccccctgagaaatgaaatcagacaaggatgcccacttttaccacttctactcaacatagtactggaagtcctagccagagcaatcagacaagagaaagaaatcaaaggtatccaaattagtagaggaagtcaaactgctgctgtttgtttgctgatgatatgattgtatacctagaaagccccaaagactcatccaaaagctcctcgaactagtacatgaattcagcaaagtttcaggatacaaaattgatgtacacaaatcagtagctctgctatacagcaacagcaaccaagctgagaatcaaatcaagaactcaatcccttttacaatagctgcaaaaaaataaaataaaataaaatacttaggaatacacctaactaaggaggtgaagacctctataaggaaaactacaaaacacagatgacacaaacaaatggaaacatgtcccatgctcatggatgggtagaatcaatattgtgaaaatggccatattgccaaaagcaatctacaaattcaatacaattcccatctaaacaccactatcattcttcacaaaactagaaaaaaaaaatcctaaaattcatacggaaccaaaaaagagaccacatagccaaagcaagactaagcaaaaagaacaaatctggaggcatcacattatccaactccaaactatactacaaggccacagtcaccaaaacagcatagtactgttataaaaataggcacaatgaaacagaatagacaacccagaaacaaacccaaatactgacagctaactgatcttcaacaaagcaaacaaaaacataaagtagggaaaggacaccctattcaacaaatagtgctgggacaattggcaagccacctatagaagaatgaaactggatcctcatctctcaccttacacaaaaatcaactcaagatgaatcaaagacttaaatctaagacctgaaaccataaaaattctagaagataacatcggaaaaacctttctagacattggcttaggcaaagacttcataacaaagaacccaaaagcaaacgcaacaaaagcaaacataaatagatgggacttaattaaaccaaaaagtttctgcacagcaaaagaaataatcagcagagttaacagacaaaccacagagtgggagaaaatcttcacaatctatacatccgacaaaggactcatatccagaatctacaaagaactcaaacaaatcagcaagaacaaaacagttccatcaaaaagtgggctaaagacatggacagacaattctcaaaagaagatatacaaatggccaacaagcatatggaaaaatgctcaacatcactaattatcagggaaatgcaaatcaaaaccacaatgtaataccacctcactcctgcaagaatggccataatcaaaaaatcaaaaaaataatcgacgtaggcacagatgcagtgaaaagggaacacttttacactgttggtgggaatgtaaaccagtacaaccactatggaaaacagtggagattcctaaagaactaaaagtaaatctaccatttgattcagcagtcccactactgggtattctaccaaaaggaaaagaagtcattatacaaaaaagatacctgcatacacatttatagcagcacaatttgcaattgcaaaaatatggaaccagcccaaatgcccatcagtcaacaaatggataaagaaaatgtggtatatatatacaccatggaataacactcaaccataaaaaggaacaaaataatggcattcgcagccacctagatggaattggagaccattaatctaagtaaagtaactcaggaatggaaaaccaaacatcgtatgttctcactcatatgtgggagctaagctatgaggatgcaaaggcataggaatgatacactggacatcggggactcaggagaaacgttgggaaggggtgagggataaaagactacacattgggtacagtgtacactgctcaggagatggatacaccaaaatctcagaaatccccactaaagagcttattcatgcaaccaaacaccacctgctccccaaaaacctattgaaattaaaaaagaaaaagaatctcagagaaaaaaataataacgcatggccctggacccatagatctccatgtactacaggagaatgctgtggtacgcacccccagcaccgcccccacaaaaaaatgtcctttttaaaaactttggtagaatatacgtaacataaaattcactattttaaccattttaagtgccctacttcacttcatagatactgatctctccatatcaaattcaaatccagtccataaactggttaaaagtattttatacccttcaaatatacaaattttgtcttaaattatcatatagtttaattatgaatatactcctcctgagaaatggttttaaaattccatttaattcaattactactttagacatgctgagttgagatgctttaactatctcccccaaatcacctgggtgacaaaaaagcagatatttttaaaaacctgaattatagctctccctctccctctccctctccctttcccacggtctccctctccctctccctctccacggtctccctctccctctctttccacggtctccctctgatgccgagccgaagctggactgtactgctgccatctcggctcactgcaacctccctgcctgattctcccgcctcagcctgccaagtgcctgcgattgcaggcgcgcaccgccacgcctgactggttttcgtatttttttggtggagacggggtttcgctgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccagccgccatcccatctaggaagtgaggagcgtctctgcccggccgcccatcgtctgagatgtggggagcgcctctgccccaccgccccttctgggaggtgaggagcgtctctgcctggccgccccgtctgagaagtgaggagcccctccgcccggcagccgccccgtctgagaagtgaggagcccctccgcccggcagccaccccgtctgggaagtgaggagcgtctccgcccggcagccaccccgtccgggagggaggtgggggttagcccccgccaggccagccgccccgtccgggagggaggtgggggggtcagccccccgcccggccagccgccccatccgggaggtgaggggcgcctctgcccggccgcccctactgggaagtgaggagcccctctgcccggccaccaccccgtctgggaggtgtacccaacagttcattgagaacgggccatgatgacaatggcggttttgtggaatagaaaagggggaaaggtggggaaaaaactgagaaatcggatggttgccgtgtctgtgtagaaagaagtagacatgggagacttttcattttgttctgtactaagaaaaactcttctgccttgggatcctgttgatctgtgaccttaccccccaaccctgtgctctctgaaacatgtgctgtgtccactcagggttgaatggattaagggctgtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaataaaaaaataaataaataaaaaggaaaaagaaaaaaagagagagaggcaggaggcttagagtcagagaagtcaatgtggtgctgggatctgagaaaaagaacctggaagatggtcagttgctggctttgaagatggaggaagacactgaaccaagggatgcaggacaagctggaaaaggcaaggacacagattttccctggagcttcccagaggaagccaacatctggattttagtcccataagactcatctcagatttgtgagctccaggactgtaaggtaataaatgcgtgtggttgtaagccaaaaaaaaaaaaaaaaacctgaattgtaaaataaaaacaataaatctgatggtaaaattcacagtgacaaggatcagacgggactgtgtatagtttcaaggtggtcaagggctctaaaagtcaacctataatactaacatcaatgacaaaacagaacagctctttctaagcacttctgatatgacaggcacagtacgaagctctttacatctattaactcacactaaatttgaaacagttctgtataaggtaagcagtcttattatgccgactttagagatatttcaatacgttttcaaaagataaaaagtagatggagtagtacacactgctaaggcatcacaccataaagtgaaagtggcaggtgatactgaaaggataaaaacggaatcctatagagaatcagaacttgaatacatcaggtacctcacccctgaaagaacagaagtgagttatgggacgtaaaacatggggagtggttaaaagtctaaataaagcaacatcaaaaaattccatccacccccaagtgcagaactctagcttctaggtatcaatactccagcaacaagccaaacccaaacaatcgggccctagagttcttgattgtaaccacacaccacactaccattcttcagtgaaactggatacaatcaagtcaacacttagctgttcatgagacacacttcaaacaaaaggacatgcaatggtggaatgaaaaggatagttcagacaaatatgaactcaaaaaaagcctgtgtaactacataagtttctgaaaaaaagagacttgaaggttaaaagcattaatagagataaagccaatacacagtgacaaaagacttccatcaccaactgttacatacaaagtaaccaatatacccagtctcaaaatctataaagtatacatcacagatctctaaggaaaaaatgacccatatacaataagttaaagcagggcctggaatacagcaggtaccatataagagttagacattataaattctctttcagaaattcatagatctagaagataaagaataagtagataaagaagataagaataagaccagtctgggcaacatagtgagccctcatttctacaaaaaaaaaaaaaattaaaaaattagccaggcatggtgtcacaagcctgtggtcccagctacttgggaggctgaggtgggaggatggcttgagcccgagagactgaggctacagtgagctgtgatcacaccactgcactccagcctgagcaacagagtgagaccctgtctaaaaaaaaaaaaaaaaaaaaaaaattaggaatataagaatattactcaagattcagtcgggttaaaaacaagggaattctggggaaatgatggcagtgatgtaattttttaatctcctcgactctccccataaaaaaaaagtaggacagtaaaacctaatcaccactccccaccctggaaaacatcaataacaaacctcaaaatatgactgggtggaaaaaactatgagtggttctgagagcagaattaaatcagtatctttattgtaggaaacaaggcaacttaacttccaacagacctgtaaacaaggaggccccaaatcgccaaaagctgtccagcatagaatgccaagccaatctgagaaccgcagccaaaactgggagagggttctttctttagcaaacctctttaagatgaattccccagggctgctctgaaccctgccttccctagacctggctcctcagattttctcacttccctctctcttgtctaagttaatcagaggctatgtctgttggctaaaaataaagatccacaagtacatacaaaatgtttgttcttgattttaaaaaataacgagcagaatcaagatacctaagaagctcaggtgatgaacacctagcaaatatcaatccttcatttcctcctccctcccatagctaccaaaaaaacgctataataaatgttgacacagaagtttggtaaactaactaacaagataattcagagtacttgaataatttatgtgtcatttaaggtgtgatggcaattccttaacatgagttatttaaatgtttgggattgtttttacatattaaatgactaaataaataaatctaaattcttactttcaaaaaaaaggcaagttgagtccaagaaaaaagtgatgtgtgcttgattaaaccaactactgaaactttgatatgttactgcttttctctttggggcatggttcagagcagcagccccctggcaggctcccctgcagagaaaatacttgggcagcagtgagagggaacaggaggtcagcagaaacacagccaccagacagtacgagaaaaccttctttttctcttaaaaaaaaaaaaaagcaagagggccacatctgtaatttcaacctcagtgacacgcttggggagcatagaatcatctcaaaaacaaaattggccaggcacggtagctcacgcctgtaatcccagcactttgaggtgggcggatcacgaggtcaggagtttgagaccagcctgaccatggtgaaaccctgtctctactaaatatacaaaaattagccaggcatggtggtgtgtgcctgtaatcccagctactcaggaggctggggcaagagaatcgcttgaacctgggaggtggaggttgcagtgagccaagatcatgtcattgcactccagcctgggcgacagagcgagactccatctcaaaaaaaaaaaaaaaaaaaaaatcaccacatgtcatttcaaattgaacaacaaagccgtattttttggggaaaaaaagagaaatgtctatgtcaaatcaaaaacataattaattagcagtttatagaaaaaggaccacttattttaggtagcttcagaggctaaaacaagaaatagtgaatggaagttagaggagggcagattttacctaaattgtaacgatttttctggtgacagcaactgttcagaagtctaatgcaatgccttgagaagcgtagggttcccagtgacttgacatgtttaaggagaatctagtagtaagtatatttgctagacatgaggtaagagaatttccagtattgcaaaagagaaggagttagataagttttcttccaactccaaaattatttggttttgtttctcttgtgcaaccaataaatataaactaaatttgaagatgacagaaattgtgcatattttaaggcaaagtatggtggtctcagaaaggtagagaacatgctgtttgcagagtgtttgtctaaaaagtcgatccagaactggagtttctgaatgaaaaaccgcaacctctgcctcccgggttgaagcaattcttatgcctcaacctcctgagtagctgggattacaggcgtgcacaaacacgcccagctaatctttgtattttagtagagatggggtttcactgtgttggccaggctgctctcgaactcctggcctcaagtgatccgcccacctcagcctcccaaagtgctgagattacaggcgtgagccaccatgcccagccaaaaaataatcttaaaaaaataagtgaggaatgtatcagtcagagaaaagtgatttttaccttttttcccttcatttcaaagatgaatattagcattgtaccaccaaataagagaagatattgatattattttttaccaaaataaatgggatcgttagcaacccaccctcttcaaaaaaagcaaaaaggaatcccctatcacttgttcatacaaacctgactctagagaacggagtgtcatatcaaagaaaattcttaggttactcagtgtcccagacacagtggttcatggagcacaagttaagtcctctcttctgggtataggctgggccataattagtttctccaacagcctaagctactgaaatgtaaaaagaaaataaaaactgggcaaaattaattgttcttcagtcttccagtatacaaattaaaaacttagatatgggtatagcaggaacaaccatctctaagaaatttttaagaagtggggcgtgaaattaattgagtcactcaaatctcaactatgggggtactatcttagggaccatctctctatccttcttgggtgtcagagggaaagagtatgtccatgtttagaaactctgtgctaaaaccataaaaccagttaccagacagtaggaaggaagtttcctggaatggatatagaaaacaaaaaaatcctagtgactcccaaattccccccagccctgggacccacagaatccactttaaacttcctatagagaaaaaaattcatctacaacacattcctatataatcaactcattattcagagctccttcctagtaacatgtcttaattacctaaaagtctctgtgatggttaatactgagtgtcaacttgattggattgaaggatgcaacatattgttcctgggtatgtctatgaggttgtggccaaaggagataaacatttgagtcagtggactgggaaaggcagaccccccctcaacctgggtgggcaccatctaatcagctgccagcacagctagaatcaaagcaggcaggagatcgtgaaaaggctagactggcttagtctcccgacctacacctttctcccatgctggatgcttcctgccctcaaacatcaggctccaagttcttcagttttgggactcagactggcttccttgctcctccgcctgcagatgacctatattgggaccttgtaatcatgtgagttaattcttaataaactcatatatacagatagaaagatagatagatattccattagttctgtccttctagagaaatctgactaatacaaccacttagcagctgtgtaatactaagcagtttaacctctcaaaaccactgaactaaaatgagcataaataataataataacattacatgggccctgagatttaaatgaaacttaaaaacttaatatcatgcttggttcacagaagtgctcggtaactattactcattatcatcacagttttactattattttaagatttttaaattgcaaactttcaagatgtttctagatatcatctgaaatatcttagtactaacagattaaacaatactaatatattaactagtttagccactgtacacaaattcagaattttataaacctttgaatgtttataatccttagaatatttttcctagttatttttgggaaaatttcagaatttttaaaaattgaagtgattacacccaccatccacctatcaaatggctattaacacacaccagtagatgtggtcaaaattgtacagactcataggaaaatagaattgatttggattcatttttctttcttttttatttttgagacagggtctcgctctgttacccaggctggagcacaatggcacaaacacagctcactgaagcctctacctcccaggctcaggtgattctcctacctcagcctcccaagtacctgggaccacaggtgcatgccactacacttggctaattttttaaattatttgtagagacagggtctccctatgttgcccaggctagtctcaaacttctggactcaagcaatcctcccacctcagcctcccaaagtgctaagattagaggcgtgattagattagagccactgcacccagcctgggattcctttttctacattccatttcatcttatttcacatttctaacacaaagtataaaacaaaaaaaaaaatgtaatggttagtatttcgaggaaaattaatctatacttcactggcaccataccttcctaggagaaacacaagcaccttaaatccagcactttgggaaaagcacagcaaaatatgtggacccagttagaatccgagaggcagaccagctgcttgagtactccccttccactgtctgcaaccctctaaactaaagctaatatccttgtggagcctgtgccatctgataaacacaaaccccaggtgtgaattcaacaagtgctcagcaaccggccaccatgggcatcatcgcataacgtcccgggtggatgacagtggagagggtaatgcagtcactgcttcttggagatggcaatcaagaaaggcagaccaacacacatcacttgcagaatgaaccataatacaaaaccattttttgagaagtgacacagactatacaggaccccagttcaggtgaaggaaatgtcactttctgatgaataaagagtgagtggcagagaatggtaggactattttgggggacaaggaaataaaaggttttagtagtttagggttcaaaacctgcaatacttactaggggcgtacccttgtaacatcttgtagcctcaatttcctcctctgcaaagtgggaataagtgacttactcacgggactgcaaggcaaactatgagataatctatatggagcgcctgctaacacagcaccaagcaaagtatttagtgcagagttaaaactgaggctgctgggtgtattctcaaattgttcaggatagttttgtccatctctatcagaaaagtttcttctatatcacttccatggttactaaaaacggaaaaaagctacatctacgtgtgtcacaaatgtcgtcatctccacacaggtacacagaccatttattaataccactttttgaaacccacatgtagccagactacttggctctaatttcaaattttgactagtatcctaagtatttgatacctcaatctacattcactgaagtcataagttttaatgtgatcagaataactgacttcaaagtggtctaattcaagaagctccaactttaaagttgtaaaaatgctttttgaaggttgcatttgtagaaatgaaatttgaaaagactattaaatattcaataatattaaaaggcaattacaactcctaacattctgtttgctttaggcaaggtaatgtctgtaacaagctaaggagcaaattaaaacgccagggtccttatgttttataacaacacggttctaaactctcctcatcatactaacagtatttaaaagattatacactgcctgttgtaagtcactcggacagctaatcattggaaataagtgaattaagaatcggtattaaaatacactggcttgtttttcaggtggagcacagtgagtagactggagaaagctgtgaccaagatgaactgcagaaaaggaagttttttctagtaacaacacccgtccctaaataagcaacctcttcagtctagtctagtaacacaactctgatcatctaagagatgtgttcaatttccctaagtcttcttgaaatctaaaataatttttaaaaaatgaggaagaagaaaaaaatctgatttttcccaaagattgaaatcaaacaccctttaggtgtataactattgctagtacaaatatcacagtaaatacatttttaaaaagtaccatgggtaaaatttcaaataaggtataacaatatttgatcaatattttcataacatactatgacgtaagccttcaaaatggcaacagatgcccaccttgagttcagttccagaaaatattttgtcactctagaaaaattctctctcttacttcctccaattagaaaacaacacatcagcaccatgcttccacttcagcttcgggggtgggaaaatcaaaagctaaattcactaattggagtcgtttgttcatttaagaggcctgaagccatcttctccttctgcctgctttaaatatttgctcttctgttttacaattatgtataatactttgtttaacttttaactgtaaattgcctcaagtctccttggaactaagcaatgacaaaatctcaattaattcattctctcttttggaaaataaaatgacactttaagtttataaagaaagactagcatgctgcctagttcctaagtaaagaaaccttcaaagaagaggccttaagagacatggaattaaatgttacagctgcaagtgcactataattaattacaaattctcatcgatttttattaagaggtcaatcatctgctgatagccatggaacgacagttaacgggggttggtgcaagcactttgatgcctgctgaccctcctctagtgagcatgttgtatgcccaagagaaggctctccatggccctaaaataccactcagatatttttcttatcaaacacccatctgagtttgagcatatctttttattctatttttttagcacatgtctgtagcagccagagagtttaagaataccttgagatgaagtatagacatccctctaaaaggctatgactacaagtcatttgcacttagtatgaattaatttattcagataatcttacttcctttttccacttagctgagattttaggaatagagattttgcatagagtaggtacagaaagaggagataacagtgctgaacatttaaaaagcctagaaagaagcctgtaatcccagcactttgggtggcggaagtgggtggatctcttgagggcaggggttagagactagcctggccaacatggcgaaaccccatctctactggccagctgcagtggctcacgcccgtaatccaaggactttgtggggccgaggcaggcgggtcacctgaggtcaggagagaggagaaaatgcagtataacaaaaagggagttagaatgtataagaacatttcattttccataaagtttggagtcaggcccaacatgctctcaagtatgaaatacagaaagtacaaggaggaggaaaaattctaagagaactgaagagaactgtactttaagcctggctgcttcatttactgctctccatctacaggcaatgaataaatgtatccacccctaaaggtattctaatcataataataaaagctacctagaatgtcaaaaggaattttcatatcacatatacattgtaaaattaagttttttcaatgtattaaaaaaaagactgaaaagaaatagaccaaaatattgatttttttctttaaatgatacgaattggggtgatttccccctccttttattttttccatttttcagttttatataacaagattattttacttccatgatcaaataaacataaacattaatgaaaaggaaatatgtattatttaacagccttaaattgtgtctagtctaacgcagggcatagagagaaggacagacagacagataggtatgtcagctttaattacaatttattccaatgtttagaatagtaaacacaaatatatactttattcaaacataatttaaattaaatattctttattaattgaatttatttctaactggcattagctacaaaggatgttatcaaatgaaatatttcttagtttttgataacatgagaagctgacaacttacaataataaaatcagtatcatatgctaaatacaaaaatctaatagttctggatttaatatcttccacaatataaaaagcaatcatttcagaaaagaaaccgttattaaaaagaagaaaagcttttgccatatggaacttgggttgctcagcctttttctgaaaagatgtctcaacttcatctgatggttcatattttatcattttctttgacttatatgaacttgaaggtcacccagataaagtaaaactttattcttttatattaacttttatttgatttggagttagtcaatcaaaacattacttgtttgaaaatatagacatggagaaatctttaacaagcaagatatgacagaaattaaaggctattccacaaaacaaccctgccattcattcactgattcattctttcaacaaaaatatactgacccccttccaaatgccaagcacttaattagaaacacagtgggcactgtccattgtttacccaaaaaccaccccactctttcctagcatgaagaaatactgtgatttgctgatgtagcaaacacagaactcttgatttcagggagaggagattgccagagccggggaataaatcatgattaatctaaacttaaaaaaaaaatgtatccctcatgggcactggccactctaagaacaagccatgtggcccggttttggctaatgacctgtaaacaggtacactcacttctcattattcatatattccatatttgcaaattcacttattcacttatatttatctgtaactccaaaatcaacagtcacagcatgtctgcagtcagttgtggacagaagaggaaaggccaaaaatgtgtgtcgcccaatatgtatgttcccagctgaagtcaaacaagaagacactgccttctcagctctcacagtgtaagcgtcctttttgcagaccacttggtgctctgtttttctcatttttctcgatttgactgtataatatggcccctaagcacagtaccacagtgctgtctcgtgtccctaagcacaagaaagttgtaatatatgcctcacagagaaaatgcatgttttagataagcttcactgaggcataagttatggtgctgctgaccctgagttcaatgttaatgaatcaacaatatatattaaataaggtggccgggcatagtggctcatgcctgtaatcccagcaggagtgtgaggccgaggttggtggatcacttgaggtcaggagttcaagaccagcctggccaacatggcaaaaccccatctctactggccaggcgccgtggctcacgtctgttatcccagcagtttggggggccgaggcaggcggatcacctgaggtcaggagttcaacaccagcctggccaacatggtgaaacctcatctctactaaaaatacaaaaatcagcagggcatggtggctcatgcctgtaattccagctactcgggaggctgaggcagaagaattgcttgaacttgggaggtggaggttgcagtgagccgagatcgcgctgttgcactccagcctgggcaacagagtaagactccgtagcaaaaattaaaaaaaataaaataaggtgtctttaaaaagaaacacataataaaacaaggttatgtactgatcaggtgacaaatatgttgtgactagaggctttcaggaacctaatcctgtatatctactaggaggaatgaatggctcagtattggctaattcagttttcacagtaactttataaaacatacctactggaaataataaaaatgaactacatttctaatgagagactttttttttttttttttttttttttttttttaccaattttcaaccttctcagcacaagacacaacatgagagtaaatgccaccactctgttacatcaaatagccaacttccaatttttggatgagaaaaataagttaactatttgtttaagccactacagtggaagtgtattcacaaagatgtaacaaaatggtgcttcctccttgtcagtaaacagtacagtggtcctgaaagaacacagcgaagatgttctacattctagcataccaagtcttacatatgctgcttattttctagtcaaatagagcagcacgtgttaatacttatatttctgcccttcaaaattaaggtcaaaagatcggcaataatgtgaactggctaaaatctaatttttttattgttgttgtttttgtttttgttttgagacagagtcttgctctgtcactcaggctggagtgcagtggcatgatctcggctcactgcaacctccgccccctgggttgaagcaacaatcctgcctcagcctcccaagtagctgggattacaggtgtgcaccaccacgcctggctcatttttgtatttttagtagagacggggtttcaccatgttggccaggctggtctcaagctcctgaccttaagtggtccaccagcctcagcctcccaaagtgctgggattacaggcatcagccaccacacttggccttaaaatccaattcttaataaagttttggactttattattacttagaaatatgcctagcttctcaaaaaaactattttgacacgtgataaaggaatgtctggaaaacagatatggtctgattaagatataaatatgatggtataaatattacagtattacatatatatacacacacagctctctacgtgtcttgctatttcatattgatagaaccgatcttatgttcatattgatggacattagtgttgataacaatgttttaagctattataaacaagcagggcacagtagctttgggagcccaaatcctagcactttgggaggccgaggtgagcggatcacctgaggtcaggagttcaagaccagcctggccaacatggtgaaaccccatctctactaaaaatacaaaaattagccaggcgtggtggcaggtgcctgtaatcccagctacttgggaggctgaggcaggagaatggtgtgaacccaggaggcaaaggttgcagtgagccaagatcacgccactgcactccagcctgggcaacagtgcgacactccatctaaaaaaaaaaaaaaaaaaaaactaaacataaataaaccagtataaacaacattacaatgaacacatacttgaactgtgcacttatacaattctttccaaaactttctggtctcagtcctgacttaaaaattactgaaggatcttaaagaggctttacttaggtcgacttctctactgatatttaatgtattacagattaaaattaagacgttaaaaaaataacgtattggccgggagtggtgtctcacgcctgtaataccagcactttgggaggctgaggtgggcggatcacctgaggtcaggagttcaagaccagactgggcaacatggtgaaaccccatctctactaaaaatacaaaaattatctgggcatggtggcgcacaactgtaatcccagctactcaggaggttgaggcaggagaatcacttgaacccgagaggcagaggttgcagtaaaccgagatcacaccattgtactccagcctgggcgacagaggctttgtctcaaaataataataataacgtattaattcattcaaaagtaagaatcctattacatgtcaacatattttaataaaaaataactaaatttttcaaaacaaaaataagttagtgaggaaagtggtaatgttttacttttttgataatccttttaatgtctggcttaatagaaagcagctaattttttttatgtttcttcattcaatctactgcaatgtagcttctggaagacccacagtatactcatgagataataagaataaaaaaggcaaataattctttttttttttttttttgagacggagtttcactcttgttgcccaggctggagtgcaatgacgccatctcagctcaccacaaactccgcctcccgggttcaagcgattctcctgcctcagcctcccgagtagctgggagtacaggtacctgccaccacacctggctaattttgtatttttagtagagatagggtttctccatgttggtcaggctagtcttgaactcccaacctcaggtgatctacctgcctcagcctcccaaagtgctgcgattacaggcgtaagccaccatgcccaaccataattctgaattattatcatgaaaatagttttcacttaaatccctgaaagtcccatgggtactcccagaggcctccggactccactctcattccatttctttaaagtatgtattcctagaagtaaaactgctgagttgcaagaaagcacaacttgaacaattttgcatattgacaaacaggtctccaaggcagctggaggaatttacactctcacagccatataatgagagttcccctaaatctgtatctcatcacctcttgataccgtcatttcacattctgccggtctgatgggtgaaaatgttatctcaatgtgctttcccttgacaaatggtcagggtttgagcatcttttcatgtctattcaccatgcataatttcccttttatcaactgcctgttcatagcatttgcatattttctactgagttttcttagtgaatttaatcatttgttgagtgcctgttttacaaactcatttctcacagactgtgtctgtatttcacaactaggcactatgaaagaatataatactgtaattaaatagcttacactagtgccacgtggcctggaattaaaatttagttgaccactgtgatggttgatactgagtgtaaacttgattggattgaaggattgatcctgggtgtgtctgtgagggtgttgccaaaggagatgaacatttgagtcagtggactgggaaaggcagacccacccttaatctgggtgggcaccatctaatcagctgccagcacagctagaataaaagcaggcagaaaaatgtaaaaagagagactggcctagtctcccagcctacatctttctcccatgcaatgcttcctgcccttgaacatcagactccaagttcttcagttttgaaactcggactggctctccttgttcctcagcctgcagatggcctattgtgagaccttgtgattgtgtgagttaatacttaataatctccccttcatatatatatatatacacacacacatatatatatacacatatatatacttaataaactcccctttatatatataatataatatattatatattatatataattatatataatatatttaatatattatatataatttaatatatttaatatattatttttatatattatatataatatatttatatagtatatataattatatataatatatttatatagtatatataaatatattatatatataaagcaatctccctgtttatagctcatttataacaatcctcagaaatggaaatttgtaattgatcaaccttgactaaacaagaagattcccaatggcaataaactataacatctatttccccccagagaaaatgagaaagaaaacaatattttatatatatattattaagtatatatatacttacacacacatacatacacacacacacacacacacacacacacacacatatattccattacttctgtccctctggagaaccctaactaatacaaccatttagcaactgtgtaatactaagcaatttaatctcttgaaaccactgaactaaaatgataataaataataataataacattacatgggtgtaataagaataaaacttttaaaaacttaatatcattcttggctcacaggagtgctcagtaactattactcattatcatcacggttttattattaagatttttaaattgcaaactttcaaaagctgtttctagatattatttgaaatatcttagaactaatagattaaacaatactaatatattaaacagcttagcctttctagaaaatcagaattttataaagctttgaatgtttataactcttgggatgtttttcctggttattttcaggtccttcacatatctaacaatgaaaaattactgaattaacgtaacagttgaagttattcgcagaagtaaccataggtatagctaaacagtaactacttcttagcctgaaagcaaccaaatatgaatacaataacaatgaacctaatgtttctggaaaaatcattaatccaactgacttttaaaagttttgaaaaggccgggtatggtggctcacgcctgtaatcccagcactttgggaggccaaggcggatggatcacttaaggccaggtgttcaagaccagcctggacaacacggtgaaacctcatctccactgaaaatacaaaaattagtcaggcatggtgacacacacctgtaatcccagctactcaagaggctgaggcaggagaatcacttgaacctgggaggtggaggttgcacctcccagggaggtcgagatcacaccactgcactccagcctgaggatcagagcaacactctgtctcaaaaaaaaaaagaaagaaagaaagaaaaaaaaaagttctgaaaagtcaacgtccatacccaaatagatggaaaacttctacacatttttctcatatctcagaaaaatattcagagataatacagtacattaaatacttttatttttctacctagataataaggaaggctgagaaaatcttaatgcatcaccttcatcctctcctatacacactaggctaatacgaatagttttcaatacaggagaaaaaagataattaactcttttcaggtaaactaacccatttcactaaaaagcaatctccctgtttatagctcatttataataatcctcagaaatggaaattcgtaattgatcaaccttgactaagcaaaaagattcccaatggcaataaactataacatctatttccccccagagaaaatgagaaagaaaacaacttttgaaatgtcattacttgaatgctttttaaaaactatgtgatattttaaatggaaaatgttaattatcttttaaagaccttcttctgaatgccatatccttcctattgttgctgttctttcattactggtcccataaatacactaagagtctttttgtaccatggctctggtaggttctggatatataaggatcaataagacagttcctattttcaaggactgttgatgctacgacagaggcagaatagcaggaacagcaataatgctcaccaagcgcctattatgtgatgtcaggttctgtgctagatacctgtaacatgcagttgttgaaaagtaggaatcttgaaattgagatatctgaagtaatagttactgtgctggggtgtggccatgggtatagccatgggctactgtcctaggctatggccatgggaagaggtagctagggtaaggtaaaggcaaagagaattggaagtggggacaaacagcccaggtgtcagatggatgctcaattcgctaagaatgatgttgccagtaatgataaagaaagaaaaagtgagccatgaatgttaaggaataactggaaggtgaggtaatggggagtagaatggcaaatgcttcagaggagctggcaattttgaggaagaggaaaaatggtgtaaatggatgaagaggagcaaaactgacactctctgactctctaggcctctagtcttaaaggacttactctcactggccagaactcagtcacatggccatgtctagaaagtcggaacatttcattctttagctgggcttactgccacctcgaataaaactgaagttcttttattaaagaagtgcccagcgaatatctggtagataaccagcagtttttccataaaaaaataaaaacaaaacctattatgatacctgaaattattttaacaggtataaatgataaacttgggatggcattaaagtgattaaagacactacctggtgagaaacagaggcgaacagagaccaagtttatcgatgcttttgtgtaaagttgcatacacaaaccgcaatcaagtcaaaacagaagacttgaagatgttctcataccatgaaggaagaccaatgaactcagactggtcaatgtactggaggcaacaaggacttccttagaggagtgagtacatccagtacctctttatatcgccatccatgtctcccgcagtgccctgcatattttatacagtgaataaatgtttgctaaagaaacaaatgtgtttacatatggaagtattttcaaccaggccttcaacaccaataactgttgacacttttagaagaaaatcaaagcagcccctgcagcctcagactcctccagctgtcacctatgggatccagcctccaggccaaccgcaggctccaggccagctcctgtagccccagacccctccagctgacacctatgggatccagcctccaggcccaccgcgggctccaggtcagttcctgtagccccagatccctccagctgacacctatgggatccagcctccaggccaaccgcgggctccaggtcagttcctgtagccccaaatccctccagctgacacctatgggatccagcctccaggccaaccgtgggctccaggccagctcctgtagccccagacccctccagctgacacctatgggatccagcctccaggccaaccgcaggctccgggccagttcctatagccccaaacccctccagctgacacctatgggatccagcctccaggcccaacgcaggctccaggccagctcctgtagccccaggattcagactgaaacccaaagactcagcctccgggcccagtccagccccatgtcagccgctacaactctaggttccaggctcactagaatgccaggtcagtcctcacagccctagactccaggccagcacccatggacccacgctccagcaaacccaggacccatgcccactctatagactcagagtccaggcctgcctcagtaaactcagcatccacagccttaggcaccaggctagcacctgtgaacccaggctccagaccaagccccgtggacccaggctcaccccagcaccaggccaatcccaggctctaggctggtccctgtgaccccagactctaatagacccaggatccaagctcattccagcagacccagggtccaagtccaccctggtcaaccctagtgccaggttgccccacagatccaggctctaggattgcccctgtggacccaagatccagacaggtccccacaggcccaagaaccaggtctctttctgcatactcaagctccaggctcaccccagcaccaggctaacccccatggactcaaactcaaggcccatccacatggacccaggcacccagacaatcctagtgccaggctggcccccacagactcaggctcaaggcccactccagggccaggctggccagacttcaggccagcccctacagacacatgctccaggctcgcacccatgagctcagtcaacagactcacccagtggacctcaccaccaggtttcccccatggacccggggtctagtccttcaaacccaagatccagacctgtcccagtgggcccaggctccagacccacccccatggacccaggtcccaggcctgcccacctattgacccaggcacaaggctagcctgcccaagaacttgaggtagccctccttccctcaggaggcggaaagaaggcaaattaccttacaggcatgaaagacaccaaaggaatcatcaacttggcctctgtttacacagcaggatctaccagctgggaatgcatttgaatgagtgttggggatgggtagatcagagatctcaatattcagtaaaaagaatctttctgagaacgttctcctcccaaaagggcagaaggccacaactactgaaacacaaagcctgacttcatttgagagactgactccaccccagaccaatgaatcagaatctacatcttaatcaaatgtctaggtgattcatattgcactaaaggtagaaaagcactggtctaatatacaacaacaacaacaaaaagccatatctgaaatggaattacagacaattattttggatatgaagcctctttggtttaaaaatgcattatcctttaaactgcaggcagcaagaggtaatacatcacatgaaataaaagctgttatgatgctttttggaagatgatcaaaatatcaagatggggtcaggcatggtggctcatgcctgtaatcccagcactttgggaggccgaggtgggttgatcacttgaggtcaagagttctaccaaagttaacaaataactcctttcagcaaaaccctgctcctttttcttaggccagaataaatgccaacatgtttgtttctcctgccatgttaaatatattacaagcttgctagctttcactctgttattgatatcttcaatacatgaagaggaagtgcaagataaacagaaacatttatagtcaagggaaacacaaaggcattaaataaaattaaaagatctggaatggtgagtctgattagtcagggagcagacacctggtgtcttagacaaaacaaccattaaaaaaaaggaggatggaaaatggaatgactcacttttactatatatgtatctcatatgaagtattttcttctgggtaaactagaaaataaaatgcaactattttggagcaatattataatatggaagctgagagataattatccttcagatatctttttctgtcaggctaaataatgtgtttcttcatctttccctaaaatcaggtctcataaaccttcagagtttccatttcatgtataggttgagactaaatttagaaaaatcaggtcccataatgttctaaacagagatggacacacacacaaaaagaaaatgtaaccattgaacaaaattagattatatttagaaacagaattttttttttttgagacagagtctcactctgtcgcccaagctagagtgcagtggtgccatctcggctcactgcaacctccgccacccggattcaagcaattctcctgcctcagcctcccaagaagctgggattacaggtgcccgccaccacgcccggctaattttttgtattcttagtagagacaaggtttcaccatgttggccaggctgttgtcaaactcctcacctcaagtgatctgcccgcctcggcctcccaaagtgctgagattacaggcgtgagccactgcacctggtctaaaaatagaaattttatgtgtgtatatatatcaataaaagtatcacaattactgtccttaaaaagcctaggtttggaagaaaaattataatgggaaacatactgtgacagctcagtaaaagacaactaaggtagttaactgattctcctatttactatctgtcaaaagacattatttgtagtagctgaattgagctgattttcttcatacctcagaaatatttcacccatgggacattacataatattctctaggacttacgcagtgataaatacctgaccaaatttataataaagaaatctttcattcatacatttaaaaaaaatgaaacaaatcaaaatcatgcaggataaagcttaggtattttctgcctaagaattttactgaataaaatcttacaagactaggtttttcctatgtgctcaaatattgaaaatttatcttttgtctccagcatgtctttcaaactgaatttaattggtaaattatttaaactatgtgcataacacaatacttacttgaaaattgatctgagtgaatcatgagcatgtaacatttgagacagagaactacatgcgaattttaagtactaggaataaattgaaatacttcggatatgcccatttcctaagtatacttaggatatacccatttcctaagtatttcaatttattcttaatacttaaaattcacatggcactacgggcttttaaagtattttataaatataaatattttaaaaatattaaaatgttataaatattaagccttactgcatttctgctcccacctcaaatctgtgtatactgcattaagtcatattcctaggagagaaaggacccaccttctgtaacttaaaattaacactagaaatgtttccagtaaaggaaataaaaagaattatctgagtgaaagaattcagtaaagaaccccgtataaatagtactgccctccaaactgtgcattatattgtctatgaacaagaaatgaaatggacatggaccatcaaaagcgggaactgtgtagagcggtgcttttcaaacaaatcacttttttaaaacaaacacaatcactaaaaatgcagattctaactcagtaggtctgaaagtggggcttttctgcacttgtaacaagcttccaggtgatgctgatgcctcctgtccacggaccatactttgagtaggaaggcagtagaacacatacacctttttttttttccgccactctttcgcccaggctggagtgcagtggcacgatctcggctcactgcaagctccacctcttgggttcacaccattctcctgcctcagcctcccaagtagctgggactacaggcacctgccaccacgcccagctaattttttgtatttttagtagagacagggtttcaccgtgctagccaggatggtctcgatctcctgacctcgtgatccatccgcctcaaccttccaaagtactgagattacaggcatgagccaccgcgtctggcctaaaatacatacatgttatctggaggtgcgaaagcccagtgccagaagaccaccagttaggtttatcggcttgctacagtaaaaggagaatgcgtactctaggaaactgggcatttctgcaaaggggagttaaaatgaacttgctatagagattgtgttttctactgggtgatatgggagaaggtaaagaaaacagaagtctgttgtgaattcagtgttgtcaggaaccaaagattactggtagactaaacattttaataatttttatccagggagcaggaggaacaaagaggcgctaaagttgataaaaaagcaattgtcagccaggtgcagtggctcatgcctgtaatcccagcacttttgggaggctgtggcaggaagattgcttgaggccagatgttccagaccatcctggccaatagtgagatttcacctctgttatcttttaattgttaaaaaaaaaaaaaaattgtcagtcactcatgttactgaggagaccatataagaactgagactgacccaagaacaacaaactatgttttacctcttggtctctatagacaatatgacaatgagagaaagggtgggagaaattgaccacttattacatagtttacccctcccgccgtgtatgatgtgaatcctgttatacattataagattgttatacaatcctatgttatacaatgttatactttctgatataaaaaaaaaaaacctttttgtgcacagaatatgaaaaagggactacacaataagcgagagtcttcgaggtataggccagtacattaatatcctttggggaactacctatgttatatgactctcatgaaaaacgcacaagaaaagcagatagagaatacagcaagcagactgctttgcacacggtaaagggcagtgctcagaaatactattaagaaataatattaccatttagaagcttcctttaaatgaaaataactgtggataaatatcccttctaaccaccgcatgaggcaacgtacttagcatatggtatacggtatgagctttagacatggactgagaatcttggcttcacacttaatatttataatatttagaggacaacttagttaacttttctagcttcagacttcttatctataacatggaggcaacactgttaactttgttttaaggagtaaataaaatatgcaaaacatttaatgtattaagtacctcacagttggccctcaacggcatttaaagtgaacatggtaccaaaccagattcaaaatgccagtttaacatttattcatcccacagatatttgttaccatgtgccagacattgtgtttagaaagaaatgtaatattttaaaagtacctggcttcctggagtttacagtctagcataaggacaattaatctgacaatagaaagcacaggatattaccagaacacagagcagagagacctgaagcaaagcagcagtgtgaggcagggaagtctcctcggaggaagaaaacctgaaggaaaagtaagagttctgaaggacttctagttacagctatgtggagaagtcagtaatttgttactatataaaacaactataaaatttggaaaaaattatattaaaaataacatttcagagcactgaaaatagaccaaagcagagaacaaatgaaaaagcattcattcttgaaaatcacctcgaggttgaagtcagtttctggggacctccttgtagaaagcattcattctggaaaatcacctcgaggttgaagtcagtttctggggacatccttgtagaaagcattcattcttgaaaatcacctcgaggttgaagtcagtttctaggggacctccttgtagaaaacattcattcttgaaaatcacctcgaggttgaagtcagtttctaggggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctggggacctccttgtagaaagcattcattcttgaaaatcacctcgaggttgaagtcagtttctagaggacctccttgcctcaggctgcttctaccctacactcagctgccgtggtgaaaactttgacaaacttggggctgtctgcaaaagccagtatctttgctaccagaaggggcagatctgctgcgggatggggggcaaaactccaggtctttatcagctaaagtagcaaatgtggtgggagacaaaaagggaaaaaccttacctttgttccctaacgctatagtccaagttggggcaagtggtaggaggatcccttgagcccaggagttcacggctacagtgagctatgatcatgccactgcactccagcctgggtgacagagcaagattctgtctccaaaaaaaaaaaaaaaaaaaaaaaaaaaagcaaactccataagaaggaatactggaaattgttgatatgtaggtaaatataaaagcctgtatattatatactgtatttttaatttctttacaaatcctaagattggcttaaggtaaaaaccattattcagtggataacatatatagatggacagtacatgacaaaaatagcacaatgcagaatggggagggatgaagctgtatgggaacaaagttaccatacttcactagattaagtaactataaaactttcagattatgctatgttcaagattcatcctgtaatccttaaagcaatgctatccaacagaaatatgagaaccataaatataagtcacatatataatttttaattttctagtaatattttaaaggtttttaaaacatgaaactttaacaacatattttatttaatccaacatatccaaagtattatgacaacatataatcaatacaaaaattatgaatattttacattccctattaagtcattgaaatctgatttgtatttcactttagcacacataaattcagactagccacatttcaagtgcacaacagccacatgtagctagtggctactgcagtgggcagtacagcactagagcaacaacaacaacaacaacagatgacttttaaaaaaatcaacagatgaattaaaacggtacactccaaaaatatttaacgcaaatgtaatagaagaacagaggaagacaaaaaagacatcaaacctatagaaaacaaaaatcaaaatggcagacataaatccaaccatatccaaaattacattaagcatgaatgtaccaaacattcacatcaaaaggaagagaccatcaggctggagttttaaaagcaagcttcagctgggtgcgatggctcatgtctataatttcaacactttgggaggtcaaagtgagaggatcactcgaggccaggagttcaagatcagcctgggcaactaagcgagactctatatctgaaaaaaaaaaaaaaaaggcacagtggcatgcacctatattcctagatacatgggaggcttaagtaggagaactgcttgagcccaggagataaaggctacggtgagctttgattccaccactgcactccagcctgagaaacaaagcgagaccttattgagagagagagagagaaagagagagagagaaagagagagaaaaagagagagagagagagagagaaggagagagggaaaaaggagagggggagagagggagagaaggagagaggaggggaaaggaaaagagaaccaaaaatgcaagactcgaccatattctgtctataggagatatatactagattcaaagatacaaacaagttcaaaagaaaacaaaccagtaatcataagaatgctgcagtgactatattaatatcaaacaaaatacactttaagacacacatattactagagacaaggaggaacatttgataatgaaaagtaacacatttcataatgaaaagctaaatatgtaaaaaggagagagggaagaattttctgagcattaaagatccagaagcaagagaggtgctttcctatttggtactcccgtctccagctgttcatatcacattcccaactcctatcagcacaacccatggcagcatcctataaatctcatcttaccccgaacattcaatgtcttcaaattcctatgcctttgaacatacccttgcactatccataacactgacctcaatatttgcatcagaaactcccactcatccctccagtttcagcttatcaccaaacccttctctgaatacttcaccgaagcttgcaaatacctacaataaagctctcattgctctccaactatcatttgaatttccctccagactttcatcctttttttttccagtttgcagcatcaggttctatcacaaaacatgacacataataggcattcggtaaatgcttgctaaatgaaggataaacgaacaaatgaacaattgaacacatgtaggaaggaccaaggttggtgaaaatgggagttgaagatttttttcacaactcatatcagaggaattaaaatagaatgaccaggaaacatgaaacgcatgaaagaattactttaggcaataataacaataataaccaacatgagaggagcactcactatgtgtcaggtactgtgctaagtatttcacatatatcaattatttcaatcctcataataactccattatgaaggactacttttgagggggtttttagacacaagatctcactgtcttgcccaggctggagtgcagtgtggctcactgcagtctcaatctcctgtgctcaagcgatcctcccaggttcacctcccgaatagctgggactacaagaacacaccaccacatccagctaattattaaattttttgtagagatgtggtctcactctgttgcccaggctggccttgaactccaggcctcaagtcatcctcccacctccaccttcaaaagtgctgggattataggtgtgagcccaccatgcctggccttgaaggtactagtttttagagatggttcaacagcaaaaaaaaaagaaaaagaaaaagaaaaaaaaaaaactcaattagaataaagaaacatttcactaaaagaagatacacaaatagtcaataagcatatagaaacatgttcaacatcatcaatcattatggaaatagaaatcaaaaccacaaagacaggcgacttcaaacacactagaaggctgtagtttaaaaaacagagaatacaggtgttgacaaaaatgagaagaaagatccctcatacttactggtgggaaagtaaaatggtttatcacttaggaaacaacctggtagtcccacaaatcgttaaatactgagtaattatacaatccatataatgagtacaagttttattttagaaagaaggaaaatgttctaaaataggtaatggctaaacaactctgagactatgttaaaaaaaatacacagaactatacaatttaaatgagtgaagtatatgagatgtgaattatatctcaatgaagttctttttttaaaaaactaacttaaaaaatgtttaagcttgaccattataatccagttactcagtgacagaaccagaggctgcctgatcccgtgttcaggattcctacatacatcacaaaatcactaagagaagcatcacaattagctcattttcaaaaaggacttcatctatttctctcaaccaaagcaatacattctaacataagcactttgtgtactgatgtaatatttctcaaaaagttaaacagcatgagaaatttataatattagataaaattacaggctaggcatagaattgcctagtggctcatacctataatcttggcactttgggaggccaaagtaggaggactgtttgaacccaggagtttgggaccagcctgagcaacatagcgtgacccccatctctaaaaaaaaaaaaaaaaaaaaaaaaaaatttaattagccaggcatgctggcaggcacctgttatcccagctacttgggaggctgaggtaggaggactgcttgaccctgggaagtgaggctgccgtgtgccaagatcgcgccactgcactccggcctgtgcaagagagcaagaccctgtctttataaaaaaatctaaaaacaattgtcttatttctaactctgaactactttctatgctttggtgacatctatggtgaaaattgaaaactagcattaacagctagaaagaagcaaaggatttttccacatgaattccatctttcttagctttgcttttatttcacagaaacagaaaataaagaaaacctaatcagttaaattactcctctctggtgtcacatcctaataaataactgttatccttatgtccttcaagaaagaaatgatactagtaggacaatcatgtatgttttctgattactcttatcaataagtacctaaaatattaggcaaactaactcatatatagcacagctatgtagtatgtataactgacaaaacccaagatctctaacacattggaatgtaagtattcatttcctttaagaatagaatccaaacagctgtttctcaccaatatacactgtgagagaactcctgtgtacctccttgccataacgaaaggaagtttaaccccacagtacacaaacctcactgcacacacaagatcctgatgtcagaacaccaatactgaggggcgtacaatgtaaacatacagcaggaacctatggcagaggccgaaccttaatcatttccaccaacctttggaattctgctttggatttcactggaacacaggcttttgacagagaaatcagaatattcgaaaacaagaaatcaccaatatcaggctcttaagtcctattgttgtaaagactgaacaatgaacatagcagcaatcaactcccaaacttagctatgctttattatatgagagcctcccgaactcagctatgctttatgatataagagaggctcccgaacctagctatgccttattatgtgagaggctcccaaacttagctaagctttatgatatttgagaggctcctgaattcagctatgctttatgagataagagagcctcccgaactcagctactctttattatatgagaggctcctgaactcagctatgctttcttatataagacagacccccaaacgtagctatgctttatgatatgagaggctcccgaacttagctacactttattatatgaaaggctcccgaactcagctatactttatgatatgaggctcccaaacttagctatgctttatgatataagagaggctcctgaactcagctacactttatgatataagagaggctcctgaacctagctatgctttatgatataagagaggcaattcggtcacttgttgggtagaacctcctgggacaagcagtcaacagcaagaaagcaattcctgctccctccattttaaaacagaaggctctatttttaccactatccccaagcaaccaaaccagaaccaaatagcatggatcttttggaacgaggaaagctctaaatgccaaagtccaagtgtagaaatatatcttaacattttgctccatccttcaaatgtttcaatgaaatgtttcaatgctgtctgaatagcaacctcaataccaacatctctcatgcagtccaagtggaaatgttccgtttcttctattttccttcagcctgagacaaattgattcttttcaaagagtcatttcaatcatcctcacgggttctcttaaaatagacaaggcaaaaccactggctgttacgtgcctctcacaagttccacctttttcacaagtggacaatgtgcactactactgcgagtggacccccacggtcagacagggaagaggaacccaccatggctggacagggaagacgaacacaccacagtcagacagggaagacgaacccaccacagtcagacagggaagacgaacccaccatggctggacagggaagacgaacacaccagtcagacagggaagacgaacccaccacagtcagacagggaagaggaacccaccatggtcagacagggaagaggaacccaccacggctggacagggaagacgaacccaccactgtcaggggagaggagcccgatcgctgcctctatgctctgccaccacctagtgaataagaacaagaaaatcacatggcaagagcctgcagacgtcaagacacctatgatagacacctaagatgatagggtggcttttaaaacctgattttaagattacaaggttagctaaatatctgaggtagtttaccaggaaaaagaaaaatgtttagaggaagaacttggtcaagagcctttatgagagtgagggtcactatatctcatcatgtaaggggccttaggaacacaccccaaattatcggacagtctagaaaaatactatttactttaggatggaagtatgagttgctcatatataaatgacagaaataaattagcttttgcaaattgggctttataggtatacgtacatcaatatcctactggtacatgtctccatttttcttgatcctatactgtttggaaattttagtgttagcttctcagctagctgattattcattatcaaagcttttttgttcccaacggctcacttactaattatatatcaaaccacaaagctctcgaagtttctgctccctccttagcatcctatctggaccatcagacagcttctggatcagaactggatatacatcatcaacgcacactggactaattcaggataactttcctaagaccaaagaacaaactattatgcaacatcggtttattttgatacttaagataaccagtgctttcatatactcaatgatatggtttggctctgtgtccacacccaaatttcaagctgaattataatccccagtgttgaaggagggcctggtggggcacgactgaatcatggggcacattcccccttgctgttcttgtgacagtacgttctcacgagacctggttgttctcctgccagccatggtgagatgtgcttgcttccgctttgtctttcactatgattgtatgtttcccaaggaagcagaagactgtatggcctacagaatcattagctgatgaaagctcttttctttataaattacccagtctcccatgtgtctttatagcagtgtgagaactaatacactcaacaagtacaaaaactacggcttaaccacagcaacaatatttatttaccaagcatggctgaagatactaaaggagtgtgtcactgtgatgtagaatttctagagattaggaatccttaggatgggtatgctcttcggaaaactgtaccatctctttgcctgttcatggaccactgtcagtctgttgcctgttagaaacctggctgcacgacaggaggtgagtagcgggcaagcaggcattaccacctgagctccacctcctgtcagatcagcggcagcattagattctcatagtagcataaaccctgctatgaactgtgtgtgcgagggatctaggctgcacactccttatgagaatctaataataaatgtaatgtgcttgaatcatcccaaagccatcccctgtcctccagtctgtggaaaaatgatcttccaagaaaccagtccctggtgccaaaaaggttgggactgctggtacatcatatattagctctgtgaccttcttaactatttcagatgataccttttgtgctctcggttgaaaaaccatctccgaagataggagctattttaacacagctatcctaaattccttacttatccatcatggaaaaaaacaaatgtttattattgccaggccctcaagaagtgaatggtctagtaggaaaaatatacctagacagatgtagtcacctgatgggttcttcttgcctgctgcacagatagagctgattcagagacaacagtataaatgacagcagtggagaaagaggttacaaacacagagccagccaagcaaaagaacaggagtttattactcaaatcagcctccccacaagctcggggaccagggcttttcaaggataattcagcaggcagggggacagggaatggggaatgctgactggtttgggatgaaatcataggggtgtagaaaacaggccttgtgtgttgagtcggcctctggggtgggggcacaagactggttgagtcataaaaaaaaaaaaagcaagaaaagaaaagaggagaggggaggggaggggagaaagaacaacaacaacaacaacaagactggttgagtcctgggtcgtgggtctgggtggaatccgtcaatcactagaatgctaaagtctgaaaaacatctcaaaagaccaatcttaggctctacaatagagacgtcatctgtaggagcaattggagaagttacaaatcttgtgatctccggaacaatggctggttatggtctaactatccctacatctcagcagaatttcaggctcttcccatcatcctaatctcatcggctttcattaattttacaaaggcagcttcagtccctgagcaagaagggagttaatttgagggagggactgttttcatccttgctccaaggttaaacgacacactcaattcttcccgtggttagtttggcccacgcccagaaatgggcaaggacagcccgcctgtgagcttagaaggcggagtcagccatgctggacttctctgtcataatcattgcaaagctggtttcatagatgagaatctataataaggtatggtaaaagctaccatagagagatgtacaacatgcagtggtgatgacctctacttgggaatagcttcacaaatgaaatacttagagtggttcttaaagggcaagggttaaaccaggctgacaaggaaaagcatgtacaatggtaaacagtacattcaggggactgtaaatagtatagagtgactgaagcacagagcacaaagagggagacactggggctcaggttagtcagatcagcaggagccaaaaggaggaggagactggaagagaaaaactgagaatgaggtatgcacaatggaggaagataaacaggtgagagcattcacagaacccaaagaaacagaattcaagaactagtgatgagtctgacaagagctatataaaatagacagtatcaaacaacatccaacacccagccctctttctactattaataaaaagactgattgcccagcgtaattagtcataccataaaggagtagatagttgtagattttctcttgagatttcaactgtacacaaatttttcatatattttatttttattttatcttatttatttgttttgagacagagtcttgctctgtctcccaggctgcagtgcagtggcatgatcctggctcactgcaacctccgcctcccaggttcaagcgattctcctgcctcagcctcacaagtagctgggactacaggcatgtgccaccacgcccagctagtttttttgtatttttagtagagacagggtttcaccatgttggccaggctggtcttgaactcatggcctcaaatgatccacctgcctcggcctcccaaagtgctgggattacaggtgtgagccaccttgcccagccccatattttatttttatttatttatttttgaggcacaacctcattctgtcacctgggctggagtgcagtggcatgatcactgctcactgcagactccacctcccaggttcaagcaattctcccgcctcagcctcccaagtagctgggactacagatgtgtgccaccatacctggctaatttttgtattttttttacttctttgtacttttgggtttttccacattgcccaagccggtctcgaactcctgggctcaactgatctgcccgggtcagctttccaatagtgctgggactacaggcgtgagctaccatgcccagcctctcatttttaatagatactattttaaaaagtactgtgaaaaagaaacaaaaatgaaaaagacacatgcctatccttaaggaacttatgtcctaccaaactataaagtaagccataccatttatggatttgtagcaacatgtcatcctgtcaactttattactgaggctatgagatgtattaacattggctttcaaattatttgtattagcaaacataaaattcaagcatagaaattgagtctgatctaaaaatcagcaaattacaattatgaatttgttatattctcactgtatccacgtcctcaaaactctgacattagcaagccattaaacaagaccactaagattacattaattttatactaaagttgtatgctaaaattttcatctttctctgtttcatctttctctgttttcccaaaagaaaaaaaaaggtaaagatcaaaagttatatatttcagatatataatcctaaaaaatgctccattgctaggtgactaattttaagacactgccatcagtttaacaggtcactcgttcatttattcatctaacatttatttacccacatactgtgataggcagtgaggaataagcacagaacagaaacagtgcctgccttcacaaagcttagtctagcaggatagtaacttaagacactgaaacagtatattaagtgccttttacaaatattcttcgcagctataccagctactacttgcatttcaacattttatttcaaagccattatttatttgtttgtttattttttttgaaatggtgtcttgttaggttgcccaggctggtctcaaactcctgggctcaagcagtcctcccgcccgagcctcccaagtaactgggattaccggcacatgccactgtgtctggatccaaaaccatttttttaaaattatttcagtgttaagacaactttaagaaacaatattatgattggtatcggtcattaattgtgctattttatgacttcaatcttttgatgcagtatagtttcctggccatttccaatagaaaattccttgcccctttcaggctactgtagttgagatacaagacttgagatatttttctaagagaaaacaaaacaaacaaagcagccaagagaaacaatatcagccatgtaataaaatacccaatgtactttatttcattatcctaggcaaataaaaaaaaaaccactatgaattatacagtatacaaatatgttttcttcggaaaacactgaaaaacagattcatgtggaaagaaattactttattcctaccactgtctttttcagacacactcaaaattcataaaattcacaaaatctgaagctcataaatcaaaagaaactgttcatacatcatgaacactatactaactttttaaaaagtattcgaggcagctgaacatcatcacagtatcttaagactcatatttccttagattaattcagtgatcactttcaaagcaaagctttttatgaaagctaaaataaaatttctaggtaaccaaggagagtctttcaaatggaaaaaagctgatgatattaaactctaaaaaataaggcccaggcatggtggctcacacctctaaatctcagcactttgggaggccaaggcaggagtatctcttgagcccatgagttcaagaccagcctgggcaacacagcaagaccccatctctatttaaacttttttttttttgagacacagtcttgctctgtggcccaggctggagtgcagtggtgcaatctcggctcactgcaaactctgcccctcagatttaagatatcctcctgcctcagcctaccaagtagctggattacaagcatgtgccaccacacctggctaatttttgtatttttagtagagatagggtttcaccatgttggcgaggctagtcttgaactcctgacctcaggtgatctgcccacctcagcctcccaaagtgctaggatacaggcatgagccaccatgcccagccttaaatttttaaaaataaaaaatagagtatgtaataatcatataaagttctaaaacatccagtagcaatgttcttaaatcccagtaattcaggtgcttttttttttttttgagccagtttcactcttgttgcccagactggagtgcaatggcacgatcttggctcaccacaacctccacctcccaggtccaagcgattcacctgcctcagcctcccgagtagctgggattacaggcatgtgccaccacgcccggctaattttgtatttttagtagagatggggtttctccatgttggtcaggctggtctcgaactcccgacctcaggtgatccgcccatcccagcctcccaaagtgctgggattacaggcgtgggccgccgtgcctggcctcaaatactattttaagattgttcatccataatacattgtagtctgaaagaagaataacctctctaaacagtacctattaccttcatcctctctttttccaatataatggcaaaagacagagttgtgatatttttactgtaatcacagaaacatcaattcaacatatataggattagcatatcacacatttcagcaaatatcaaaatacagatgtttcttcatcctgatgaacaaatttattattaaacttgccaactattttccaaatttataaaagaccataataaaatgtgaggcaaaactgttcaaaccagttaaaatgagtctcgatcagctaaaatgattaacaacgccatcttaaagatgatcccatatctgagcacgtgatacctctgtgatttcagggcacaaatccctctatccatcaaactaaatagaagggttagagaggttaatcgagacagagtgtctgtaacagacttctgcatttcattctccactcaatatacttcaaacatcattgaactatttgttatgttcttatgaatcaatgctcccttcacagtcaagatagaggctagaagccactgtgtgaagtaataaagcttacctttgcaaatcctcatcaagctgatctgatgattaagtctatgtgaggcttcctaaacaactgaagtgtaatcacaactttaattagaagctcaaatggcactgctaaacacctaaataaaacatgagcaagtacaatagccacctgcaacgagcaatgccattttccagcctccatttactataaagagatttttctctattcagctgcacaatcacttgggctacatgatctctggcctagcaatagcagtcaataatttaaaatcatgaaaataaattttcaatctatacttaagttctattatgcactggtggtagtcaaaaatgtcacagactgaataaaaatgaagctcactcatttgctaggctggcaccccattctacccgaactgtccattaagagtcaccattaaaaacaaacaaaactcatatggcaaacttctgataaaccaatttactctatttgtggctgattaagggtgatcctggactacatggcttttttagttcctccctgactaatggaaaattactagaagagtaaggactacacagaactagttgcataaattacagttggccaggtgcagtggttcagcctgttatcccagaaatttgggaggccttggtaggaggactgctttaggccaggagtttgagaccagcctgggcaacatagtaaggccctgtgtcttaaaaaaaaaaaaaatttaattagccagaaatgatggcacatgcctgtagccccaagtactcgggaagttgaggcaagaggattgcttgagcccaggagttaaatcagatggcattagtgatggttgcacataccaagaaaaatatatcccagtttccttctttactccctgttttaaacatatatcctatcttcctagttcatctcctctggtctctccttctatgagatatggataatttattccctatccttgctgccttctaacagtagtataagagaaggtataatcagtggtaagaacatttaactaggaaataacccagaggtccactgacagaaaaactgataaagtgtggtctatgctataccacagaatatcacaaagtggtgaaaattaataactaatgctatgtgcaataacacatacatgctgaaaatgtaatgctgagcatttttaaatttcataagactatattcagcaatgataccatttatagggctcaaaaaacaagaaatatatatccgtgttcaagcacacatacatttgtgacaagcatagaaaacatatacaaagcatgtgaaacgtctcagataccctgattcaaagtcaagggtctcatggaaatttattcaggtttggatgcacacctgacttggcatgtatgctgctctacataggacacacccaacacaaccaacctagtgttgctctaaggccgctaacctttaaaataaataaagccagccagcatatcacccttcattgacctatcttaaattcgaatcacaatgatagctgtaagtggaaattttttgcttttcgttataaaagctttacacataccctggtggccaccgctgctgaggtcagcagcaccacggcagctgtgaaaggttagcagttttgtttttgtgtgttgaggccttggctcaagatcccatctgtgctgacttcagactgaagggaacacatttcctccagcctgaaaactgaaacatatgccgcaataattagagcttccttgagtcagttcagctgaacccaggatgctgagactgataacctgtgagcacactagaagacttcacatacggcacccacctgctagacaaagacagacatgaagacatggccacgaggcctccatatccaaaaagacagaagtcccatcatctatatgtattatgtctatatctgcttgcagactcctgcttctgctaaaaagtacagtgaggagtttgcaagttaaagagacagaactaagtcaacaaaactgcagcatttagaaagcccctgcaagcacttgatctctgcgtcctctttacttgatctctgtgccctctttacgtgatctagacttgtgctctccaatactggccacatttggctagttaatgaaaattcaataaaattgaaaatcaacttcctcggtcacattagccacatttcaagtgatcaataaccacatgtgactactggctgattaccatattggacagagcaagtataaaacctttctttcattacagaaagtgctttgggcagtcctgacttagacactaatccacttttttactcttattatattgactcataataattgtaaacatttatgaggtacagcatgattctttttttagacgggatcttactttgtcactcaggctgaagtgcaatagtgcaatcacggctcactacaacctcaacctcccagactcaagtcatcctcccacctcagcctcccaagtagctgggactacaggtgtgcacgaccacacctggctaatttttatattttttgcagagatggggtttcaacatgttgcccaggctggtctcaaactcctggactcaagtgatctgctcatttcagcctcccaaagttctgggattacagggatgagccaccatgcctggccatacagtatgatatttttacacgtatacacaatgtgtaatgatcaaatcagagtaaagtagcatatccaccacctcaaacatttatcatttatttgtgttggtaacactcaaaatctgcctttctagctactggaaaatatacaatacgttgtggttaatagacactaatccacttttaaaacaaaaccaaaaccgccaccagcatgctgaacatcaaaatcccagagctagccagaaaatgtcaaggattagtcacccagcacaattaatctgagatggtccacaggcttccagggttgaggcttctcttaagtggtgtctttattttatttcattgtttactgtcgcacagcgattaaaagaatggactctgaggccaggtgcagtggttcacgtctgtaatcccagcactttgggaggccgaggcgggcggatcacgaggtcaggagatcgagaccatcctggctaatacgatgaaaccccgtctctactaaaaatacaaaaaaaattagccgggcgtggtggcgggcgcctgtagtcccagctacccgggaggctgaggcaggagaatggcgtgaacccaggaggcagagcttgcagtgagcccagatggcgccactgcactccagcctgggcgacagagcaagactctgtctcaaaaaaaaaaaaaaaagaaagaaagaaagaaaaaagaatggactctagaattagacggtttgagcctgaatcgctgcaacagtctgttaattattcaaactctctcattctcctgtaggttaaatcgctgcaacagtctgttaattattcaaactctctcattctcctgtaggttaaaatgggattttttttttttaaatagagacagcgttttgccatgttgcccaggagcttgaactcccaggctcaagcaatctgcctgcctcagcttcccaaagcgctgggactacaggtgtgagccaccgcgcccagccaaaatggggatactaatagtatctacctcatagatttgtttaaaaattaaatgacacaatgtttgtaaatctattagtaccatgcttggcatagagtaagagctctataattgttagctattaactattattatccttgccaaaaggaaggagaagaaaagcatgaggctgaatttttgaattttgcccattaaaaaatatcggagctctggtaaagatgcactatgagagaaaatcaacacatatgatctgtttcatcttcagccttgtagtttaataatttcctttctcacctttaaaaagcttgtccttgccttttcgctcttcttgtaagtctctcttcagtgcaccgtgtccatagtgctacgtgttaggcactattcaaagcacatgacatgtaccagcttaataaattctcacaacaatcctacaaggtagatactcaatgtgcctatttattttcaagtgaaaaaacggagacacttagaggttaggtaactagtgcaggatcacatagctagtaagtgacagtgtcactggctccaaaagcaggcagtatggatgaagaatctctgctccatcacagccatcgtgcaaaattgcttcgatatgcagcagtcctcccttcaaaacaaacaaacaacacctttcccaagctatcgacctggtaatattattatagtttatttaattagattggcaggacaggcaaggagaagtctcttgggatttggatatgacagcagctctcattgtcctgtcttctgactaaatcccctgggggatgtggatggaataaaactctgctattcagaagggttggcattgccccctgggaggtctggaaatttatgaggatagtttggttttcacaataattggggggtaccatcactctgaaggagacaaaggtgcttatatcccacattatctgtcacaatcacatacaattttcaaatgtccactttagacaatttaggtctagattgtaactgctgattatgtataaggagcaattctcatattgttctagtgtatttaatatagttctaagattgcaaccaccaggtaaaatgaaagaaactggtacttttgtcttcaaaaccttagcaggagttgttcatcatctgagactataaggtcatgctatttgaatcccaaagacaacacagctgtatcagtctccaattagagccgcacattcacagtaaggctgcgccatgaccgctctcctagtgccaaaacatttatataaaacaatgtcctaggcagctgaggctgctataacagaataccacacattgggtggcttatatgcaacaaaaatctatttttcggccagacatggtggctcgtgcccgtaatcccagcactttgggaagcagaggcgggtggatcacctgaggtcaggagttcaagaccagcctggccaacatggtgaaacctcgtctctactacaaatacaaaaattagccaggagtggtggcaagcgcctgtaatcccagctactcaggaggctgaggcaggaaaatcacttgaacctgggaggcagaggttgcagtgagccgagatcacgccactgcactccagcctgggcaacagcaagactccgtctcaaaataaataaataaataaataaataaattatatatatatattcactcttgaggaggctgggaaatccaaaaatcaaaacgtctgcatattcagcgtctgagagctcactgctcattcagtgtaaatgaagaaacctgagggcaggtttcttcatttacagatggtgttgctgtgtgtcctcacttggcagaaggggaagtcagctcccttgggcctcttttatgagggcgctaatcccattcatgaggactctgccttcctgagctaattacctccccgaagcaccacctcttaatattatcaccttaggggttaagatcacacagcatataaattttggaaggacacaaacactctgaccacaacaggtaatagacaccatttgataaataattttccatttatttcttctttatattttcattgggtcattatattgctattttgaaactgtctatataaatagttatatattatctaagactctcccttcaggatagcatttgtgtgtgtgtgcgtgcatgtgcatgtgtgtttcaaaatacatgtttataaaaaggggttttgtgcttaataggggtgatgtcctctgctcggcatctctgggaaagaactggtctacagaataagctgttgctgtttcctatcaatattttactatacaggaaaatcagagctacatgtccttaacaccagctttctggtgagggaattactgataagtaatgagaattactgataaacagagagaaaaatgaaatttatgagttctccatcaagttctggcctctccccatcctaatccctatctcagaagcaagtcttttttttttttttttttttttttgagatggagtctagctctctcacccaggctggaatgtagtggtgctatctcagttcactgcaaactctgcctcccaggttcatgcaattctcctgtctcagcctcctgagtagctggaattacaggtgcctgccaccacacctggctaatttttgtatttttagtagagacagggtttcaccatgttggccaggttggtctcaaactcctgacctcaaatgatctgcccgcttcggtctcccaaagtgttgggattacaggcgtgagccaccgcacccagccaagtctttaaagtataaaaccttaaggttcatatccttcacccactttttgatgggtttttttttcttgtaaatttgtttgagttcattgtagattctggatattagccctttgtcagatgagtaggttgcaaaaattttctcccattctgtaggttgcctgttcattctgatggtggtttcttttgctatgcagaagctctttagttcaattagatcccatttgtcaattttggcttttgttgccattgtttttggtgttttagacatgaagtcttgcccatgcctatgtcctgaatggtattgcctaggttttcttctagggtttttatggttttaggtctgacatgtaagtctttaatccatcttgaattaatttttgtataaggtgtaaggaagggatccagtttcagctttctacatatggctagccagttttcccagcaccatttattaaatagggaatcctttccccatttcttctttttgtgaggtttgtcaaagatgagatagttgtagatatgcagcattatttctgagggctctgttctgttccattggtctatctctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatagcttttttcatgatattgattcttcctacccatgagcatggaatgttcttccatttctttgtatcctcttttatttcattgagcagtggtttatagttctccttgaagaggtccttcacgtcccttgtaagttggattcctaggtattttattctctttgaagcaattgtgaatgggagttcactcatgatttggctctctgtttgtctgttattggtatatatgcttgtgatttttgcatgttgattttgtatcctgagactgctgaagttgcttatcagcttaaggagattttgggctgagatgatcgggttttctagatatacaatcatgtcatctgcaaacagggacaatttgacttcctcttttcctaattgaatgccctttattcccttctcctgcctgactgccctggccagaatttccaacactatattgaataggagtggtgagagagggcatccctctcttttgcccattttcaaaaggaatgcttccagtttttgtccattcagtatgatattggctgtgggtttgtcatagatagctcttattgttttgagatacgtcccatcaatacctaatttattgagagtttttagcatgaagtgttgctgaattttgtcaaaggccttttctgcatctattgagataatcatgtggtttttgtctttggttctgtttatatgctggactacatttattgattttcgtatgttgaaccagccttgcatcccagggatgaagcccacttgatcatggtagataagctttttgatgtattgctggattcagtttgccagtattttattgaggatttttgcatcgatgttcatcaaggatattgggtaaaattctctttttttgttgtgtctctgccaggctttggtatcacgatgatgatggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagagtgtatgtgtcgagcaatttatccatttcttctagattttctagtttatctgcgtagaggtgtttatagtattctctgatggtagtttgtatttctgtgggatcggtggtgatatcccctttattttttattgcatctatttgattcttctctcttttcttctttattagtcttgctagcagtctatcaattttgttgatcttttcaaaaaaccagctcctggattcattgattttttgaagggttttttgtgtctccatttccttcagttctgctcttctcaaaagaagacatttatgcacccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaagtaggaacacttgtacactgttggtgggactgtaaactagttcaaccattgtggaagtcagtgtggcgattcctcagggatctagaactagaaataccatttgacccagccatcccattactgggtatatacccaaaggattataaatcatgctgctataaagacacacgcacacatatgtttattgtggcactattcacaatagcaaagacttggaacgaagccaaatgtccaacaatgatagactggattaagaaaatgtggcacatatacaccatggaatactatgcagccataaaaaaggatgagttcatgccctttgtagggacatggatgaagctggaaaccatcattctcagcaatctatcccaaggacaaaaaaccaaacaccgcatgttctcgctcataggtgggaattgaacaatgagaacgcatggacacaggaaggggaacatcacacaccagggactgttgtggggttgggggaggggggagggatagcattaggatatatacctaatgctaaatgacgagttaatgggtgcagcacactaacatggcacatgtatacatatgtaacaaacctgcacgttgtgcacacgtaccctaaaacttaaagtataataaaaaaaaaaaaaaaaaacttaaggtacagcagccactatcctgtctcttccccttgtcacctctccctggctgagccaacttgctttgcgttaactacctttctcacacatccccaagagcctacagaaaaggtctatgatcttggcttgttactaccaaatcatctcaaacctctcagcatctttacctactcagttaagtaaggaaactcacaattccttgagtagttcctgtagccctctcccagcctgaatggctcttcctggtgttgccgatgctaatcaatgactgaacacaggactgctgtctctctcatttctctgaactagctggcatatctttactttcttccctcttggcttctaatgaagacaaaactgcattgcctaattatcctttagaaagaaaaccttaacattctttaatacttgatctcttttcaatgccttctatttgtttctgtaattcagctaaaaatagttcagccattgaaaaaaatagattccaataaaacatattgaatgacaactatttaatgtgttaaaaagaatactacctgatttttttttttcagtaaactaaaaagcttcctgaatttgcagcattcttaaattgaagtaagaagtggagagacactttgggcagccgaggcaggcggatcatgaggtcaggagttcaagaccagcctggccaacattgtgaaactccatctctactaaaagtacaaaaaattagctgggtgtggtggccggtgcctgtaatcccagctacttgggaggctgatgcaggagaatggcttgaactcgggaggcggaggttgctgtgagccgagatcgcaccattgcactccagcctcagcaacaagagtgagactccgtctcaaaaaaaaaaaaaaaaagaagtgggaagaaagggagaagagattaatatagtagcagtttttaaatgttggtatgtaccagatcttcctaattacctgataaggaaggttacccataatttataggttgaagaaatcaaggcagagaggttaaacagtttgctcaaggtcatgtatagacacctccaccctcaccctcaaccagtgctaggattacaacccaatttgtctaattctattacatcatgctaccactctacagtaattataattagtgctaacttcataccaagaactgtgctaagtatctcatttagtctttataataaccctatgacgtaggtaccaaatttagcttcattttacaaatgagaaaattgggcacagaaagaaagtcaggttgcccaaagtcacacagtaaatagtccagcttatattcaaatccaggaacctgactccagaacctatgcccttaatcattaggcggcactctcggatagaattaaaatccaccaggcaaaaaatgagtaaatagctaatttttatcagtaaagattactgaggaaatcacaacagcgctattcccaacagaatgatttaacaatagctatgttcatgaggatgcatgatatagtttgaatatacgtccccaccaaatctcacgctgaattgtaatccccagggttggaggtggggcctgcagggaggtgtctgggtcatgggggaggatctctcgtggcccagtgctgtgctcatgataagatacgctcatttcaaagtgtatgatgccccacccccacacactagctcctgcttcctccatgtgacgggccagctccgctttgccttctaccatgattgtaagctcccagaggcctcatcagaaaccaagcagatgccaggtgccacacatgcttcctacacaggctgcagaagtgtgagccaaggaaacctcttatctttataaattgcccagcctcaggtacttctttatagcaacacaacagcagcctaatacaatgcactagcaaatcaaagtgggatttttgtttagtccacaagtgattaaaactccgaaaaaacaaaaccattaaccttacgaattaaatatcttcttttgatgggctaatgtaatattgaatatgaagtgattagaaagtaattccccaaaatttctgtctgtgggtggaaagaggggtggtatataacagcacaacacagaaatgtatccctacatgtgcctggttgaaaattcattttctctttggaatccaggctcctcctacccctagagcagtcagagagacatagctaccaaatgcaaaacagaatgcagtctttagagagagaccaccagggctgagatatcacccactgttatttacaaataaagccagcagtgagagatgggacagacatattagaggaaatcaaaagagtcatttttaaatgttaaagatttttcttggaaaatatgaaaggaaaaactaagaacattatcttggtaagttagcaaagccctgaagcaagcattggacatcccaaatcagccacatgggacacagaggagggtccacatagaaccaaagcctgtctcttctctacaaggttaaggtttgagtttcctagaggaagaaacaagagatttagaatgcatggtgtcatgtaaatcactctcactgtcattatttttaaggcttttacgtatatattttaactgcatactatatgtgtaaaatatatatattcatatacacataaatgcacacacacacacaaatacatatgtaaaaataaatgtacagctgattcaggtaaatcataccaggaaactgaagccagttttggtttttttgctggttttttttttttttttttgagatagagtcttgctctgtcgcccagaccagagtgcagtggcatgctatcggctcacagcaacctctgcctcctgagttcaagtgattctcctgcctcagcctctgagtagctggaattacaggcacacaccaccaggcccagctaatttttgtatttttagtagagacgacgtttcaccatgttggccaggccagtctcgaactcctgacctcaggtgatccacctgcctcggcctcccaaagtcctgggattacaggtgtgagccaccgcgcccggctggagccaggtttttgacatccacattgggtaaatcctggtgagcagaacagcacccatcacaaaatactgccttaatttaaagctattccagctaggtctgtttcatattactgtaatgaagataatagccaaaacatgataataaaactaacaaacccctggaattgttaacacagatacactgtcaacaatttttctacaaaaactgccatgtcagcttaagtgatcttttcttctctgaacagttacagcatttaccttctctaggcttaggacccagagatgcaaagggaaaggcaagtgttgtgggctcaccccccacttctaatataacagcaataataatagataaaatgtatatcgtacttaccacgtcccagactgtttttaaatgctttaactactccattatttttaatcctcacaacaatcccattattagtccatgtactaacaaggaaattgacccagagttgaggtaaatagtcccaggtcataaagctagttcatagaactagatctagaaccctggcctccagcactaaaaattacataaataaataaataatctttgctcacttatttttttaaagaccagtgaactatgctcagcccaggctagactcaaactattgggctcaagtgatcctcctgcctcagcctcccaagtagccaggactacaggcacacaccatcatgcccggctttcaccattttttcactcttttggttcagtttaagatttcatttagagaaaaaaggttttataccatttaaaataaaaacattgagcaccactagtctatatagtttatttatctattgccactcaaactctgatgtcatttttatggtgttctggttgcactgtttaattctgttagttaactttccgtatgttatgccttgaactgcatacatgtacgtagaaactcccacacgtaagtacactagactggaagttcttagagaacttatattctttgtattaggttggtgcaaaaggaactgtgggttttgccattaaaagtaattaatatctcctatgttgcatacagtacaatgcattcacaaataaattttttgagaaataaacttgatttaactgttcaaataaatttttatcctggggtaaatagttttagtttaaactatgctactggtaataataaacaatccttaagaacatcatatgagacagcagttctgcccaacccactcccaatttcttacccatgcggtgtcactaatcaatttataggttggaacaagaaaaaagttttacattacagaactaataaagcatactttccctgcagagggaccactactgtgacttaaaggttctaattaagtttttttctttgaagcttagtattcaaatctgcattcttacttgattagtattcaccaccattatttttatgcagatcacatgaaaaatgaaccctatgtgccagaataacttgcaagaaattactattcatcagcatgaatcaacaagcccacaattagaacagtgtccactgggaaaagtaaaaaaaaaaaaaaaaaacttttactaaggtcatataaaatgaaagtaaagggggaaaataaagaattcatttttgcattgaaaatcatacaaacgttttcagcagaaaattactatgactattattggggctcagaaaatgatatcctgaagtatggtgctttcatatgctgggcacttccgaattttaaaaaaacagaagaccttagaagctgcctcagaaccaaggactctgtaaccttctcctgtatctctccaactcccaaagcacagagaggggctctctctggaatttccttatcagactaaggaaactttttccttaagaaatacaattctcttaaacctcctccccagaaatctcattaaattaccaggaaagattaacctgagaagaaaagaatctataataagtcattgccaagaccagacagactgttcgtctgttcttcagagggcagctttgagacattacccgagagacttcaactgcataatacaacaacctctgttcaccctacagttcctccctcaacttcccataacttgtgggtcccattcagtttccaaagagaaccatttacaaactactgtctgctccttggatccattaaactctcctaaaatcactatcccccaaaattgcctatattcccccatctccctgactgctagaaagagagtgccatttaagctgtggctatctggcctttctgttacagcccaacaggttcttcttacctgctgcccagaaaagccaatacacggagaacagtaggggtgttgcagcagagaaagagtttaattactgcaaggcagctgagcagaaggaggggaggtatctctcaaatccacctc
